United States Patent 7,625,699 (GENETIC POLYMORPHISMS ASSOCIATED WITH CORONARY STENOSIS, METHODS OF DETECTION AND USES THEREOF) - sequence listing, part 5

SEQ ID NO: 12258 - DNA, 271884 bp, Homo sapiens
  misc_feature (1)...(271884): n = A,T,C or G, or insertion/deletion polymorphism (see Tables 1-2)
atattcaaattctcgttatacattctacatagtgtactcacactcgtccatctggaaaaaacgaggcttcctaattgcaaaaaacactcctgccataaatggctctctcatcagcaaactccttcaagctgccaggcttctacagaaagttgccatcatttattgcaggggccaccaaaccccggatgatcctatatcagctggaaataggctagcagatcagataaccaaacaagtagccctccaacccatgcaaggccagtttctgtccctgtcctttttctctcctctttactcctcagaagaaaaggaggacttccaagcccaaaaccttcaaaagcaaggaccatggtatgtcaaggaaaggtgctttattcttcctcactctcaaagccttcctcacctccaaagcctccacaaccctttccatatcagttacaacctctcttgcaacttctctgccctattctcacttgccctcacctttccagccatgtttgagaaattacctagtcctgctctgtctgccactcagtgtcaccccaaggctccttccagccaccttttcctacccaccaagcccagggccaggtacccaggcaaaattaacaaatggacttcactcacatgctggccaataaacggctccactatcttctagtctttatctgtactttctccaggtagataaaagcattcccaacaacttcagaaggtataaatgtcatcacacaaactctcttcatgcatataattctccgttttggacttccaacattcatccagtccaacaacggaccctccttcatcagccaaattatccaaggcatctctacatccttaggtataaaatgggttctccacacaccctataggcctcaattctcaggcaaagttgaaaaaattacgtctgtccttaaagcccaactcaccaagctggctctaaaaactcaccagtcgtaaacaaaaaatctccctttcacccttataagactccacacaacaccaaaagcaccctctttttatagtccctttgaaatcatatatggccaaacttttgtcttggggtctccacccttaccagactctgagccactcagatattacctcycctccttaatccagacatggtctttcattcgtgaagcagcaaataaggccatgcctctccctgttaacacctttttgtcctctgaacgtaactgtcttacaggcacagacgtgtttccagacaatccagatgatgcttctgctacagcgacatggtaaataccaacccgtctctcaacaatacccccaaaattaagattttctttttccaagatgtccacgtcaccccctatgtcatgcctgaagtaattattgagtaagtggtcccttttcccttttctctaaccaaatagacaggaatgtaagattctcccggggcctgaaagcttaaggagatgaataactcctcccttctcaggcccagtcccaaggcgcaagggccacttgtgtcagcagtgtgcaccagcagcgtgcgccggcaagatagcagaagcatgaaaagggccggccagaagacacctactctggctggaagacacgtacccctgaagatcaagaaagaagctatctgggaacaatgtagcagttacgtcagaccaggacacttcctgtttacaggagactataaaacctttgtcctatcatcacttgatgtggacgccattttaggcctcagcccgcctgcacccaggcactgattaaaacagcatgttgctccacactgcctcgtgttgtctgttggcatgctcttggggttcaaactgatacaagaaccttacactaggagggttgtgtttttccaggaatttattaatctcttccagattttctagtttatgtgtgtaaaggtgttcatattagccctgaatgatcttttgtatttcagtggtgttagttgaaatatctcctgtttcatttctctgtgaggttatttggatagtctctcttattttcttggttaatcttgctaatggtctctcaattttatttatcttttcaatgaatcaactttttgtttcatttatctttcgtaaaattttttttttcaatttcatgcagttcttctctgatcttggttatgttctttgtctgctgggtttgggtttggtttgttcttgtttctctagttgcttgaggtgtaaccttatattgtctgtatgcactttttcagactttttgttgtaggtgtttagggctatgaactttcctcttagcgcctccttagctgtatccgaaagtttttgataggttgtgtcattattgtcattcattttgaagaattttaaaattttcatcttgattttgtttttggcccaatgctcattcaggagcaggttatttaatttccatgtatttgcatggttttgaaagtccttttggagttcatttccagttttattccactttggtctgagagagtatttgatataatttcaattttcttaaatttgttgaggttcattttatggcctatcatatggtctatcttggagaagttccatgcactgttgaatagaatgtgtattctgcagttgttggatgaaatgctctgtagatatctgttaagtccatttgttccaaggtatagtttaaatccattgtttctttgttgactttctgtcttgatgacctgtctattgctgtcagtggagtattgaagtcccccactattatgattctatctatctcatttcttcattctattagtaattgttttataaatttgggatctctagtcttaggtgaatatttgtttaagattatgcggttttcctgttgtatcaggcctttttaccattatataatgtccctctttgtgtcttttaaccactgttgctttaaagttcattttgtctgatataagaatatctactcctgctcagttttggtgtccatttgcatgaaatgcctttttgtacgcctttactttaagtttatgtgagtctttttgtgttaggtgagtctcctgaagacagtagacggttggttaattcttatccattatgtggttctgcatcttttaagtggagcatgtagggtatttacattcaatgttagtattgaaatgtgaggtactcttgcattcatcatgctctttgttgcctgtgtactttgtttttgttgttgttgttttaactcgtgtttttgttttataggccctttgtaatttatgctttaaagagattctgttttgatgtgtttccaggatgtgtttcatgatttagagcttcttttagaagttcttgtaatggtggctttgtaatggtgaattctctcaatatttgtttgtctgaaaatcacagtatctttccttcatatatgatgcttcatttggctggataaaaaattcttggctgataattgttttgtttgagaaggctgaagataggaccccaatcccttctaggttgtagggtttctgctgagaaatctgctgttaatctgttaggttttcctttataggtttcctggtgcttctgtctcaaaactcttaagattctttccttcatcttaactttcgataacctgatgacaatgtgcctaggtgaagatctttttgcaatagatttcccaggtgttctttgtgcttcttgtatttgcatgtctaggtctctagcaaggctgggaaagttttccttgattattcccctaaatatgttttccaagctttcagagttgttttcttcctcaggaataccgattattcttaggtttggttgtttaacataatccaaaacttcttggaggctttgtttatattttcttattcttttttctttgtctttgttggattgggttaattcaaagactttgtcttcaagctctgaatttctttcttctacttgttcaattctattgctgagactttccagagcatcacacatttctaaaagtgtgtccaatgtttcctgaatttttaattttttttttctttaagctatctatttcattggatatttctcccttcactttttgtattattttttggacttacttgcattgggctttgccttactttgatctctccctgattagcttaataactgacctcctgctttctttttcaggtaaatcagagatttcttcttggtttggatccattgctggtgaactcgggtcggggggtgttgaggagccttgttttgtcatattaccrgggttggttttctgcttccttctcatttgggtagactctgtcagagggaaggtctagggctgaaggctgttgttcatattatattttcccacaggctgttccctttatgtagtactctcccccttttcgtgtggatgtggcttcctgtgaactgaactgcagtgattgttgtctctcttctgggtctagccacccagtgagtctacctggctctgggctggtactgggggttatctgcacagagtcctgtgatattaactgtctatgggtctctcagtcatggataccagtgcctgttccagtggaggtgacacaaggggcaatggactccatgggggtcctcagttttggtggtataatggcctatttttgtgctggttggcctcctaccaggaggtggcactttccagaaaacatcagctgtagtagtgtggagagggactggtggtggatagggccctacaactcccaaggttatatgtcctttgtctcctgccaccagggtgggtagggaaggaccattgggtgggggcagggccgtgtctgagctcagactttccttagttgagtcttgctgtggctgcagtggtggatgggggtgagactcccaggtcactggagttgtttaccaaggcagattatggctgcctctgctgagtcatacaggttgtcagggaagtggggtaaagctggtagccacagaccttactcagctctcactcaaaccgaagggctggtctcactcccaccatgccctcagcaacagccctgaacctgtttccaggtgaagggccagtcaggcttgaaaattttcccaaggttttcttcacatttgcaaatgaaaagggctttagttctttccccacctgtgaagtctgcaaactggattcgcgccctcccctgagttctggccttgagacttctcgccctgttcaaattgttagaaatttcagctagagaagttcttctcattgtggagttttaccccctgctcctctggccaccctcctgatggatccctgtggtgccaggcaggaattgtctgcttggggatccagcgagctcccagtgcctttctgctacttcctctatccctgtgtttcgctgggtttggctctctaacttgactcggctccaggtaaagttgggaacttctcccacaaacagaccttcagcttctccattggggatgtctgtttgggagaggagggtctcccttttccacttccatggttggggcactcacagtatttaggttgtctcccgtgtcctgcaggagcagtctgcttcctttagagggtctgtgggtcctctcaggattgctggtctgttattgcagtcgatctggagctaaaattcacaatgcaagcctccgtatgctgctctgtccggagctgcaatctagtcctacctcccatcaaatttacacattttaaaataccatttacttcctaatctgacaggatatcaaaccaggttcgtccagctttcctgtctgacacctctttagtttccttggtaacaaaactttgctccatgattccggtaacaaaactctttagtttccttggtatcaaaactctgctccatgattctggggtctgattttgaataaatgcaacgtcagaagcaagagtgagctgagtactttacagctgtggaacctaaagcaaaaaaaacagacacagcatcccaattctaattctgactctgatttggattcagatccatatttcccccagactctacagacacatcacttctcctcctttgttccccttccagttctgctatggaagaagcaacatctaagatgacggaaattatttcagagcccacagttacactggaaaatgaggtaaaaaaaaaatagaattctgctcactaccttacagaaaaacaagccagacaaaagggtggaatggttaagagacagtgttgacaatgagcacttggactatcgctcatctaaatgctgctgcatttatcaaaagcctcatgcctttggtgaaagctcctcagagagtgaaaaagaggatgaagaaaattgtaatttcatgctatatttctggggtcatcacaatggacggcatcattcccttcccaatagggcttctagtactttatctaaaaaaccttgagacacatctcatcctcttccttcacccatgaagggctaagcttactttgcttcccccatccctgaatgagactggactaaaatatatccacgttgctattcagggattaaacatattttgaatcttttttgatgtgtgttctatctctcttctgtctgatggaaagggtagcaatgaaggaagacaaggggagagaaacaaagggatcaatagaatacctggaagccctggtactgcatgactactattctacaatacacatgtcacatgtatattcttgtcttttttagagatctggaataacttctcctatattttcttggctagtctattatcatgacaccaaacccccactttccacagagctaccattttctctatacttgttacccataatagtttctatcatctaatgagtaccagattattctttaccattaattggaagctttgtaatcttgtcacctgatatttacccattacactttattcttgcttttatcctgggtgatttcaatatccctgtagataagatttcatataaactaggtatttctcctctacttttatttaggaaccccacagccatagtcataccatgaagctaatgagcactagtactattccacatctaagttttataattagggatcttattttctcatcccaaactcctatcttttgacttctgtctcatactcgcttacaacactattttgtgaattcatggagactcctagtcacccaaatttgtgctgacctctcaatcagtcaaccttctgggtataacttcttttccacccaaacttctgacccatcaacagcattctttcccgtgttcttacttcttcactcttttgtgaaacctctcttgccaattccaaattatgacatgtgactcaggaaaactaaaatgaagtgtttgtggacttggggaaaggtggtatcaaagaaacatcaggaaactatcaagaggtagaatagtagtttaaatttattacatgttttgtgtgtgcctagcattttcttcaaggctttatgtataataacccaggaattctgggaaagtctcagtctttatctcttcaaatatattctgcttcattctctttttcctatttctttgagactccaatttaaacctatgttacacttccttctatatttgttaatattatctttatttttctgtctcttttaaacatcatttggatcatttcttcttatcagcatttagttcaccaatatagcttgatttatatctaaaaagctattaaacccatccacttaattttgtttccttatactcttcagtcctagaatttcaacttagtactttttcccaattgttagatcccttattatgaggacctgaataattcaaattctctgtaagaaacttttggcttgactttgatttccttgcacatactaagcataattattttataacttgtgtctgataattgtagtatttacaatcctggtgaatttgtttccattgtctgattttctctcctagttcttgctcatagtttcttgttttcttgcttttgtgctttttttattccttgattatatgctatactctattttaaatattatttgtagaaatttgaggtcgaggataatgatatcttcctccaaaggaagtgtgtgtgtgtgtgtgtgtgtgtgtgtgtgtgagtgtgtgtgtgtttctatgggtttctgaggtcagtagaaatccgggattatcttaatccaaatttagagtttagtatttttgaggattccaaaattaactaaagttgggttgtagctcattacagcttccgtttggttcaattcacttttattcatgattttctggccattataggtcaagatcaaaactacccactcttggtagactgaggactatgaattttatcttcctagcacaatgaagtcaccaaaagtacagatcttcctctcacscattactttagactcagcaaatattcctttcccccagagaaaaataggttccatgttctggactcaacactagattccttttctgttatagacctctgtctaatagttcctcactattttgcctattttttagctttttttgtaattgcaagaatattttgaatttttttgtagccttttgatttgttttccagttccaacccagggaatgttgatctaagttatctttttatacctttatattcactattttatcattacaataatgccatgaggtagataatattgttatcctcacagtacatcttagaaactgagatatagagttaataatttgccttagataacacagctaataagaattagaaatgaaatttgaacccaagcattctggctcaacagtctgaattcctcaacatttgctttttctgaattattaggcaattaatccctctggcaaaacagaaattgttctatgtctacttgggttagagttctggcagaacataaacattagaggttgtaggttaaaacaaaacaagcccctgggatcccaccaagcatgcttttggtgggctaggaagataaattttgtgaccaggatctacttttcyaacaaaggagactttcattctatcaataaatttccatatgcatgatatgcttggaagattcaagccagcctaggggccctcttggaatataaagatactaatagtatgtcttttgactgaaaggccccagtttggattgaactgatatctgtatagatggagggatgaaggatactaattggggaagaaagtgctagccccctcaaggaaagactgacagtctgaatcacagaattgaaagggcatgacaattccatttggatttgacataagttcacaaaggaaatagttgtgtagatcatgaagattcctgcaaggtgaagtaaggtttatgggaagcaaggacaaaattcagaaaatggtgttaagaaaatggtgagggagagggctgaggcccagccaagttctctaagattgttctcaatggggaactaaagtggataaatggaaagtagtgacctacacaaagtgccagtcagccaaacaaaacatgccaaatgtcaagtgagtaggaaaatttcagctcttaaaattacgtaggctttaataattccaaatttaatttgattctcagaatatgggaggagactacatgcacagttctaaagccatcactgtttttgtttttatgatgtttccagttatttctaggctctctagtctctctcgtaactaagatagacatattcaattctgtatttatattcctttgccagtttatacttcataggtacaatccattactgttataactggtctataaatgtcttgttttcttctaactcttagaacagtgataaaaattcattggcatgcatgtagtccgtgttacagcctagatgraacaagcacatatgctcatgtgtcatttctgactcagtggtatctctacaaactctcaaacttcttgtagaaattttttatgttggcctaccagggagatctgttacagtaatgaaggaactacttaactgctccccttgagccctgaagaagttaataaacaaaaacatcactgaagtcttagtaattttgtgtgttatactccctgatgcatttataactgaccagaaaagctggcagatttgtaaagagattcctcctctgctcatgagatataggaatgcctacaaccaggtctatggtaytatgtagatcaataactgtcttatgaggagtagctagccaggggctttttcttctacttctgttatgactagtagagatatgtcattttgtgtcattgttccctggtggtcacgtgatagatagtgtgggagagttggcattttagtcaaatatctgacctcccctctttctattgtaaacactttggttttagctgggcaaaatacccgccatgagctgcttaagtcagggatttaatgtaagataattcaacttctaccttatttaaaaaactgtcattgtggtttctgaaaaactgaatttatagctttactaatacagaatcaaactattttttaacagggtgacaaattgcaacattgtaaaggaaggcttaatagaaaaaaaaaatagtacatagtaatagaactgcttgctgagttccaaracttttagaacaaggtgaggggggaggacttttccttccaattccttcttcataacattggatggagtccttttggtgggtattttgacagcttcctttttgttttgttttcttttgttttgtttttggagacagtctccctctattgcccaggctggagtgcagtggcacaatctgggctcactgcaacctccgactcctggactcaagtgattctcatgccccaacctcccaagtagctgagattacaggcgtgcgccaccacgctggctaatttttatttcatgatattttgtggagatagggttttgccatgttggccaggctggtctctgaatttctggccttaagtgatccgcccgcctctgcctcctaaagtgaggggattacaggcatgagccattgtgcccagtggacagcatcttttgttactgctcttttcctagaaaatctccagtgtggggttgctaggtaaatacaaaacatgcatttaaatttgaactttggataatgaataatgtttacttcatgcatatttaaaagatatttgtgaaaaaawttattgttcatctgaagttcaaattcaactgggcatcttttttaagtttttgtattatttatttatttttttaaatgatgtgctaagtttggcaacacacctccagagttttctgtttttctgactactttcttcaaacttcactttataaaatgtcaaaaagcagcacaccacaggtcttaattgatctctccattgctgttcctactttaacatcattccattcacctcacacaccaattttatctcactcaatgagaaatcaacccacttttaaactatttattatattttcaggagtgtgtgtaaggttaactttaaatgtaaataagttaggggcctttcactatatttttacatttgttgcgcactttagttctattattattatattgtaatatataatgaaataattatacaattcaccataatttagaatcagtgggatgcctgagcttcttttcctgcaactggacagtcccatcttggggtaatgggagacagtgacagatcatcaggcatccaattctcataagcagcatgaaaccttgcatacacagttcacaatagggttcaatctcctgtaagaatctaatgcagccagtgatctgacaggaggcggaactcaggaggtagtgtgaaggatggggagcagctgtaaatacagatgaagcaggctggtccccatggttcacacctgtaatcccagcatttgggaggctgaggtgagcagatcacttgaggtctggagtttgagaccaacatggcaaaactctgtctctactcaaaatacaaaaattaaccgagcatggtggtgcaccctagtaatcctagctactagggaggctgagacaggaaaattgcttgaactttaaaggcggaggttgcagtgagcccagatcgtgacactgcactccagcctgggtgacagagcaagactctgtctccatggcccagggactgggggcccttgctgtataggatgtgtgaaaactctgtgcacacaatccaggtgtgtagcagtggtgtatgatcaggaacaaggtactgaaattagtcccttgtctaatccaagctgtagctatggcttaaggaagtgtgagggtaagttagcatctggtggtcagtgagctgcaattgtctcgattttgcttattttggggccagtgtttgttcagttgctagagaaaaagaaagaaaaaaaaaccttgttgcagttagaatatagtctaacctttaggtgttggggatggtacatgacttatccctttcctggcatgcctttaggtcttgtttataatttggtatcttgttgctacaaaaagtccttttccatcactcttatgatctctactttaatactatcatcaaaactgattacacaagttcatctgttaatgttcatttttattgagattttatatatttacacttcaaaaatttcttttcacacatatrgaaacatatatgaattttaaaatatgcatcttcatgaaagtccaaataacactatttggactatagtttgagttcagaaattatatctgctgaaaatttgggtgggagtaaatatcttccttcttagtttaactttattttcaagtgtttgtctttattttgtttataattggcatgtaatcgttgtctatgcttatgcaatacagtgtgatgtttcaacatgtgtgcattgtataatgataaactcagtgttgttagcatgcccatcccaccaaacctttgtcattttttgtgaagataactttcaagattgttatttacagctgcctgaaaatatacaaacatatttattagttattgccatcccactatgtaagagagcaccaaaacttattctttctttctgactggaactttgtaccaattgagcaaatgtttccatcttccattctccactcccatccccagcctctggtaaacagtatgctactctttacttctgtgagatcaacttttctaaattacacctataagtgaaatcactgtagttttctttctgtgcctcgcttattttccttaatattgtgtcctttaggttgatcccttctgccattaatgacaggatttttccatttttatagcagaatagcataccactgtgtatgtataccrcattttctttgttaattcatctgctaaaggacacttaggttgattccttttattggcaattgtgaatgatgctttataaacacaggagtgcagatatgttttcaacatactgatttaaatatctttccatataaacccagtggtgaaattactaggttatgtggtggtttaatttaatattttgaggaatctccgcagtgttttccataatggccaggctagtctacaatcctagcagtagtgtacaatagtttcctttcttcgtgtccttgacagcatttgatattttactttcttcttgatagtagccattctaacaaaagtgaggagatatctcattgtggttttgatttgcatttccccagtgattagtgatattgtgaatttgtgaatttcttatatgcctgctggccctttgtatgtcttcttttaagatatgtcttttcagaccttttgtccatttattaatcagattatttgggggggggtgtttttctattgcatgatttgagttcgttatatatcatgaatattagcctattatcagatggatggtttgcaaatattttcttccattctgtaagttgcctctttgctctgttcattgtatcttttcttgtacagaagctttttagttcagtgtaatcccatctgtctatttttgttttattgactgtgcttttcatgtaccaccaaaaaaaattattgatcagactaatgttatgaactgttttccttgtgkttttttctgatagttttatagttttgagtattatacttaagtctataatctattttgaaatgatgtttgtatgcagttaaagataagggtctagtttcattcttcttcatatggatatccagtttttccagcaccatatattgaagagactatcttttcttccatgtgtgtttttggcagctttgtcaaaaaatatgtgaccataagtgtgtagaattaattttgggttctcaattttgtcgcattgatctttgtttttatttttatacaagtaccatgycgttttggttattattgctttatacagtatttggaagtcaggtaaggtgatgcctccagctttgctccttttttatttgttttattttttattctgatatgtatttaaatacaaggtaaaatattacaatcatactaacagaaatatgagaatttttagtgaaacaagatgagtgattctagagcatttattttcagtaaattttaactcaattttatactatatatactatgctatttgtactagaagtatttgtaattttagttaatattgataatttattttggtgaagagaaatttcatgaacctatctattctgacacctctctatcatgacaaagagatatataaataatttaaaaaattaactccttttcaattgcaacaaaaacaaaaattgacaaatgaagtctaatcaatctaaagagcttctgcatagcaaaaaaacctatcaaccaagtaaacagacaacctaaagaatgaaataaattttttggaaactatgcatctgaaaaagatctaatatccagcatctataagaaacttaaaaaaaatctactagattaaaacaaacaatcccattaaaaagtgggcaaatgacatgaacagacacttttcaaaagaaggcatacctgtggccaatgagcatattaaaaaagcttaatatcactgatcataagagaaatgcaaattaaaaccacagtgagataccatctcacaccagttagaattgttattattaacaacaaaacatagcaggtattggcaaggttttggagaaaaaggaacacttatacactgtttgtgggtgtgttaactagttcaaccattgtgaaaggcagtgtggtgattgctcaaagacctaaaaacagaaataccattcaacccagcaatcccatgactgggtatatattcaaagtaatataaatttttctgccataaaacatatgaatgcttatgttcactgcagcactattcacaatagcaaactcatgaaatcaacctaaatgtccatcaatggtagaaaggatgaagaaaatatgttaaatatacaccatggaatactatgcagccagaaaaaagaatgagatcatgtcctttgtatgaacagcaatggagctggaagccattatccttagcaaactaacacaggaatagtaaaccaatactgcatgttctcacttataattgggggctaaatgatgagaacacatggacacatagaggggaacaacagacagtggaagggaggagggggagaggatcaggaaaaataactaatggacactagacttaacatgtgggtgatggaacaatttgtamaacaaacccccatgacatgagattacctgtataacaaacctgcacaggtacccctgaacgtaaaatgaaagttaaaaaaacttccttttaaaaattttattttagtttcagtgagtacaggtgaaagtttgttacctgggcaaattgcacgtcaggctttgatgtacaaattgttcacccaactattgagtatagtacctgatatgcatttttttaatcctcatcctccttccacccctcaccctcacgtaaactatgrtgtctattgtttccttttttgtgtacacgtgtattcaatatttagttcccatttatatgcagtgttaggttttctgtttctgtgttaatttgtttaagataataacctccagttgtatccatttcactgaaaataaggttatttcattttctaaaaaaattacttccaaccatggtgatgggattattttgtttttctttatgcctgcatagtattccatggtgtataagtacaacattttctttatctagtacaccattgataggcatttaggttgattccatgtctttgctattgcaaatagtgctctattttttggaatagtttcagtggcaatggtaccaggtcttctttatattttggtagaattcggatgtgaatccatctgcaggaaagtctggtccagggctctttctgrttggtaggtttttcattattgatttattactgatgttcattattgatcatatttctcatttgtttatgaagattagtttggccggatataaaattcttggttgaaattatctttaagaatgatgaatatgggctccaatctcttctgacttgtacagattctcctgaagaatttgcaagtttcttgatggggttttcttttgtgagcaacctgtcccttctctgcagctcttttatatataatatatatttcattgaccttggggaatctgatttctatgtgtcttggaaatggtcatcttgcaggggttctttgtattttctcaatttgaatgtgaacttttctagtatgcttcagaaaattttcatrgacaatatgcttaaatatgttttccaagttgctttttgtctctgtgtctctttcaggaatgccaattctttgtaggtctggtctctacataattctatatttcttggaggtattgtttattttaaaaagaattaaaatttctttctgrtagagttgatttgaagaactggccttaaaatcttattctattttgctcatcttagtctrtcttcctgttaataatttctgattgtattacagaattcttgtagtgagtatttcagctcttatgatcagttttgttctttcttaaaatggctattttgtctttcagttgttgaatcatttttggattccttatattccttggattttgttttgactttctcctgaatttctgtgatctttgtttccatccagattctaaattctgtttgtcgtttcagccattttggtctggttaaaaaccattgctagggagctagtgcagttgtttggggataagaagacattctggcttttagagtttcagagttcttgcactggttgttttgtatgtgtgtgggctgatgttcatttaatctttgaagtcrctcttctttgtatggtgctttttgcttgtattttctttggtgtccttgaaggtttgactggtataagttgggtttagttgatggccttcatttctagatgattcagggggccaacattcagctctgcactactgggctgtgtaatttaaccatgggtagatggtaccaggcctgtgattttgttctctgtctcctccaggttaagcacctgctgtgctggatgggccaaggtgctccctgtctggtggcaacaatactccaatgggagtgctggcgaaagtgattcatttgagtagtggcagtgggttccatgcatgcatgcatgcttgtgtcagcaggatcggtgtgcaagtgtgtatccaagcagtggcatggcattgacatggtcgkgtctgcaagtgcacacagtctccactggcagagtgcagtggggtctgcacatgtgtgcacaccaccagcagcagcatggcagtgttcacatgtgcatgtgccagcacatctgtaggggagactgtgrgtgagtgcacatcagcagaagctgcgggtggtgcttatcagcagaagctctctgatggttaagcaagatctgtcagtgtaggagctatgaagttggctgctgggaaatgcctcagttgggcatctgagtctgtgctacaagcaactatagccaggcagggaccctgggaaaggctggtagatagggggatgctcagatcacactggccgcatcctacaggcaacataaccctattctgtacaggactgatagtcaacaaaatccaaatccacctacatgaacatgttatgcctcagggaatgggcatccatgatggtgctccactgcagccattctggcaccaaaacctctgagtcccatgcaggctggagccctgtccctgccaactccccaagaagctctttctgctagctcaaatgcctgttagggacatggggttttctgcagctatgattctggaggtttgtggactccttctttacaccaaatgcaaaaattaaatcaagatggattaaagatgtaaatgtaaaaccaaaaactataaaaatcctggaagacaacctatacaatactgttctccacataggaatcagcaaagattttatgatgatgccaaaagcaattgcaacaaaagcaaaaatcagcagagtaaacaaacagcctatggaaaggaaaataaattttgcaatctatgcatctgacaaagtctaatatgaagcatctataaggagcttaaacaaaactacaagaaaaaaaaacagmcctattaaaaagtgggcaaaagacataaacaggcacttttcttcttttctktaaatagctacctttatttgtaaagttcatttttaaaaattttgtatttcaatagttttggcggtacaggtggtttctggttacatgtatgtgttctttagcagtgatttagagattctggtgcaccatcactaaagcagtatacactgtactcaataggtagtcttttattcatcaccccaatcctacctttccccttgtgtccacaaagccaattatatcattcttatgcctttgcatcctcatagcttagctcccacttataagtaagaacatacatcatttggctttctatttctgagttacttcacttagaataatggcctccggaactcaccacagcacagaaaagcagctatggccagactgccttactagattcctccccactgggcagggcatctctgaaagaaaggcaacagccccagtcagaggcttatagataaaattcccatctccctgggacagaacacctgggggaaggggaggctgtgggygcagcttcagcagacttaaatgttcctgccagacggctctgcagagagcagcgtatcctgacaaggaggattctcccagcacagaacgggagctccactaagggacagactgcttccttaagtgggtccctgacccccgtgcctcccgactgggagacagctcccagcaggggtcagcagacaccttatacaagagagctccagctggcatctggcaggtgcctctctgagacaaagcttccagatgaaggagcaggcagcagtctttgctgttctgcagcctctgctggtgatacccaggcaaacagggtctggagtggacctccggcaaactacagcagacatgcagaaaaggggcctgattgttagaagaaaaactaaaaaacaaaaagtaataacatcaacatcaaagaaaaagaaggaaccccatttaaaaaaacccatccaggcatggctggcaatatggctaaacaagaacagttctgatctgcagctcccagcaaggtcaacacaaaaggagggtgatttctgcatttccaactgagttacctggctcatctcattgggactggttagacagtggatgcagcccatggagggtgagcagaaacagggtggggcatcacctcacccaggaagtgcaaggggttgaggaactccctcccctagccaagggaagctgtaagggactgtgccatgaagaatggtgcattccaacccacatactatgcttttcccatggtctttgcaacccacagaccaggagattccctcggtgcctacactaccaaggccctgcatttcaagcacaaaactgggcatctgtgtgggcagaaactgatctagcagcaggagtttcttttcgtaacctagtgacgcctggaatgccagtgagatggaaccattcacttccctggaaagggggctgaagccagagagacaagtggcctagctcagtggatcccacccccggaaagcccagcaagctaagatccgtgaaattcttgctgccagcacagcagtatgaagtcaatctgggatgctccaggttggtggggggaggggtgtccactattactaaggcttgagtaggcggttttccaatcacagcataaacaaagctgccaggaagttcaaactgggtgragcccaccacagcttggcaaagccactgtagccagactgcctctagattcctccattctgggcagggcatctttgaaagaaacacagcagccccagtcaggggcttatagataaaactttcatttccctgggacagagaacctgggaaaggggtggctgtgggcgcaacttcagcagacaaatgttcctgcctgccagctctgaagagagcagcacatctcccagcacagcactcgagctctgctagggacagactgcctcctcaactgggtccataacccccatgcctcctgactgtgaggcacctctcagaaggagtcaacagacacctcatataggagagctctggctgacatctggagggtgcccctctgggatgaagcttccagaggaaggaaaaggcagcaatctttgccattctgcagcctctgctggtgatactcaggcaaacatggtctggagtggacctacagcagtctccagcagacctgcagcagaggggcctgactgttagaaggaaaactaacaaacagaaaggaataatatcaacatcaacaaaaacaaccacaccaaaaccccatccaaaggtcaccaacatcaaagaccaaaggtagacaaatctataaagatagagagaaacaagcgaaaaaaggctgaaaattgcaaaaactagaaggcctcttctcctccaaaggatcacaattccttttcagcaagggaacaaaactgaacagagaatgaatttgacaaattgacagaagtaggcttcagaaggtggataataacaaactcctctgggctaaaggagcatgttctaacccaatgcaaaaaagctaagaagcttgaaaaaaaggttcgttgaattgctaactaggataaccagtttagagaacataaatgacctgatggagctgaaaaacatagcatgagaacttcgtgaagcatacgcaagtatcaatagctgaatyaatcaagcagaagaaaggacatcgaggttraagatcatcataatgaaataaagcgtgaagacaagattagagaaaaaagaataaaaagaaacgaacaaagtttccaaagtatatgggaccatgtgaaaagaccaaacytatgtttgattggtgtacctgaaagtgatggggagaatggaaccaagttggaaaacactcttcaggatattatccaggagaacttccccaacctagaaagacaggccaacattcaaattcaggaaatgcagagaacaccacaaacatactcctcgagaagaggaaccccaaggcacataatcgtcagattcaccaagggtgaaatgaaggaaaaaattatcaggtcagccagagagaaaggtcgggttacccacaagggaatcccatcagactaacagcagatctctgttagtcagaagagtggggccaatattcaacattcttaaataagagaattttcaacccagaatttcatatccagccaaactaatcttcataagtgaaggagaaataaaatcctttacagacaagcaaattctgagagattttctcaccaccaggcctgccttccaagaactcctgaaggaagccctaaacatgaaaaggaacatctggaaccagccactgcaaaaacataccaaattgtaaagaccatggacactatgaagaaattgcatcaattaacggacaaaacagtgagcaagcatcataatgacaggwtcaaattgacccataacaatattaaccttaaatgtaaatgggttaaatgccccagttaaaagacacacactggcaaattggataaagagtcaaaacccattggtgtgctgtattcaggagacccatctcacatgcaaagaaacacataggctcaaaataaaaggatggaggaatatttaccaaggaaatggaaaacaaaaaaaaagcaaacattgcaatcctagtcgctgaaaaaaacagactttaaaccaacaaagatcaaaagagacaaaggagggcattacataatggtaaagggatcaatgcaacaagaagagctaactatcctaagtatacatgcacccaatacaggagcaaccagattataaaccaagttcttagagacctacaaagaaacttagacacccacacaataatagtgggagactttaacaccccattgttaatattggacagatcagtgagacaaaattaaccaggatattcaagacttgaactctgctctagaccaagcaggcctaatagacatctacagaactctccaccccaaatcaacagaatatacattcttctcagcaccacatcacacttattctaaaattgaccaaataattgaaagtaaaacactcctcaggaaatgcaaaacaatggaaatcatatcaaacagtctctcagacaacagggtaatcaaattagaactcaggattaagaaactcactcgaaaccccacaacttggaaactgaacaacctgcttctgaatgactactgggtaaataatgaaataaagacagaaataaataagttatttgaaaccaataagaacaaaaacacaatgtggcagaatctgtgggacacagctacagccatgtttagagggaaaattatagcactaaatgcccacaagagaaagtgggaaagatctaaaattgaaaacctaacatcacaattaaacgatctagagaagcaagaacaaacaaattccaaagctatcagaagacaagaaataactaagatcagagcaaaactgaaagagatagagacatgaagaaccctttgaaaaatcaatgaatccaggagctgttttttttaaagatcaacaaaatagataatctgctagccagactaacaaacaagaagagaaagaagaatcaaataggtgcaataaaaaatgctataggggataaactactgatcccacagaaataaaaacttccatcagagaatactataaacacctctatgcaaatatactagaaaatctagaagaaatggataaattcctggacacataaaccctactaagtctaaaccagaaagaagtcgaatccctgaaaagaccaataacaagttctgaaattgatgcagtaattaatagcctaacaaccaaaaagagtccaggatcagatggattcacagccgaattctaccacaggtgaaaagaggagctggtagcattccttctgaaactattccaaacaatagaaaaaaagggaatcctccttaactcattttaagaggtcagcatcatcctgataccaaaacctggcagaaacaaaaccaaaaaagaaatttcaggccaatatccctgaggaatatgtgaaaattctcaataaaatactagcaagccaaatccagcagcacatcaaaaagcttatcraccatgatcaattcggcttcatccctgggatgcaaggctggtacaacatacctgaatcaattttaatgcaatccatcacataaactgaatcaatgacaaaaaccagattatctcaataatactgggtatatatacagcattgcataataaaaatcatgctttgttattattcaataacaaagtaagtcttgtggcactgtgccttaaaagtgtgkcattaaaagtccacttaattcttcctttcttttcttgacatggtgagtatgcagtaaaaataattgtgggttggtgatatatgggacactcaaaacacttttgagttgtgactgcatcactgcaatttttagtgggttgagctgcagtgcaaagtgacattgggtcagttttgcagctactcaatactgtcagtgtggctgaaaacagctatgcataatataaaaacaaatccatatggctaggtataaaaactttatgaggaatgaaatttttattttatatacttttcatattttataaaatattattttattaatcattaaaaatgtaaaagccattcttagctaatgggtaatataagaatatatagcaggccatgcttgacatatagtttgtaatttgctaatttctcttttagaaaactgtgatatactagtttaggttaataattgttgagaagatttacagaggctctgagggaaaagaacagataatgcattggaagaaataaggataagttacatattagactcactttaatacaaataagaaaagttttttttaccttctttattatgacagaaaaacagaatgatcaaacaggcttccactcaagagatactgtcctgcaagtgaggcatttgaatagtataaaattagaaggatgtgaaggaagaggggtagtgtattaacatatcaattttaaaatacagccatttaaagaagagtttctctctctctctccctccatccctctctctctctctcttaacagcaccagagcaggccatttatctgtgttcttgtggcactttaactatataaggccattcagaaaatgattcatgctttttttatcttgtttgtctaccattctgtacaatgtggtcttcatctgtatgatcaaaggcaaatcaccaccatatttgtattccaggctgtaagacagggagaagtaaaagaccaggacaagtgactttaactaagtaatacacatcgctttcattcacatctcatcagccaggacaaaatcagatgaccacacctagctgcatgggaggcaataaacttgtctctagttaagtggtcataggcgagtgcttcaaacgtgttttccctattactgaaagagagtgttgtagatgagagaccgaagatacagtctctttttacttgataaaagtggtaaattttcttcaacagaatttctattttacttcttaataaatttattagaagtgttttacagaaattttcagatcatttatttatttaatgagtcaaacacgcatgaacaggcactcttccarataatccaaataaagtatctagctagatgacatatttactcacatggagctaacattctagagaagaacatatagaataaacaaagattcaatttaataaaaatgttaagaacaatgacatttagataagttgggttaataatcagattactgagtagcaaaattgtaagtggaaacatgcaaaactttaaagctagttctggctcttgcaccaacaggtaattttctgcatttgttttttaatagattacatcgttatcttaagtcatctgaacctatagagatacatacagggaacacctgctaggagtaaggttaggcaaagaaattcagttgtgtctttctcatgttgatccatctgataaaagaatagctagaatagatagataaagaatagcaatttttgcactataaatctaataatgtgggccaggcatggtggctcacgcctgtaatcccagctgtttgggaggcggaggcgggtggatcacctgaggtcgggagtttgagaacagcctgatcaacatggaaaaaccccatttctactaaaaatacaaaattagccaggcttggtggtgcatgcctgtaatcccagatactggggaggctgaggtaggagaatcgcttgaacccgggaggcggagtttatggtgagccaagatcacgccattgcactccagcctgggcaacaagagcaaagctccgtctcaaaaaaaaaaaaaaaaaaaaaaaaaaatcgaatagtgtgtcttttttttttttttttttttttctgttaagcatgtgaacgttggaatgctggagatgacctttgtactatttggtacttgagtctttttaattatcttctttgcttattccaagaagaagtttagatattcccttatttgggcttcacataatatgtctgcctaattctgccaatatgtaccaaagtgtattttgcacttttatgaaaaatagagaaggttcaatgatggcctaagacatagagtgcttttgtgatgtagttttaagttatatatgtcattttacaaaatactatgtgaatttccaaactttggaagtaaaatttgtctagatattgaaatatgagtttggagccaaagaatgttttttaaatargattgttatcatagtgctattgtggcaggccaggtctccattagcaaccagaacagtsagtttccactaaccctttactatagttytgatgaatgtataagttaaacattaaagaattggagaaactagtgctttagtacaagggctgggatgtgaaaacaaaaccattaagaccttgcctgggttttctcagaacttaaagcctgataaaataatgaaggcattcttacacacaccttgttccagggcccattaagattaacaaatttttccaaggctctgaattaaacttccaggccccagaccctagttaaagattagattgagtgaaacactcctgtttatagttgcacacgtgcatgcaggcatatagcttgaatgtattaatgtataarcaagtgctgaaaaaaatcttgtaactttgggttggtctggtgaactaccctgaccttctccttatggccagttacagaaataaactctcttctttcccagtctgtctgtaactcgttaattggaccatgagaccaagtagctggactccagttttttctgggtatactatgtttgcttgacttttgatatgctgggttctttgaatatgcaaatgtctttatttaaaatccattttaatttccctgctgaagccattgaaggaaggccacagattggatgaatcatgaagactaatattttacttgatttaggaggaatgcagttcaaaatgactattgcttagagattctggtcacaataaatataaccttgactgcatttaaatggaaagtcttttatacttctgaaatggctagtttagtgtcctaaactaatgtgtggaccattgtaatttaccatgaagacttcataaaacaaaggccatagacattgaacaaactgtgagctttatttagatggcatttaaaaatttattttgacatatccttgcaaaagtgattggaaccataattggaagttggatacagcaataattgtgagcaatttattgtggcatctccttacagagatatatattctatacaactaaactccttcaaatacttgaagaacatctgtaagggatcaaaatatgccagctcagttccctttctacacattaagtagaagctatcaaaaaaataaattaagaaaaccatatcatttgtaatggcatcagtaagaataaaatagataggaataaatttaaccaargaggtgaaacattatggcattcaacactttaaatgtgtgaattgtatgatatatgaattgtatctcaataaagctgtttaaataacaatgtactatattcttaaaatttgctatgacagtagattgaaagtgttctcaccaaaaaaaatagtgcgtttgttaggtaatgcatatgttaataagcatgatctagccaatccacaatgtaaacatattttaagacaccatgttatacaccattaatatatataatttttgtctactaaaataattataaataattaaaaaacaggagatattacaattgatactacagaattacaaaagttcacactagttgagtatgaacaattgtacaccaacaaaaaagataacctagaagaaataaaaaaaaaactaagaaacattcaacctaaaaagactgaatcatgaagaaatagaaaatatgaacagactaacaattattaaggagattgaatcaataatcaaaactttcccaacaaatagaatcccaggacctgatggcttccctggtgaattataccaaacatctaaagaagaattaaaatctatcttctcaaacacttccaaaaaattcattaggagataacacttccaaactcattttgcaaggccagtattagtccaaagcctgacaaggatactacaagaaaagaaaatatargtgaatatccctgatgaacaaaacacaaaaattctcaacaaaacgctggccaactgaattcaaatgcatattaaaaggatcatacaacataatcaagtggaatttatttctgggataaatggatggttcattatatgcaaaacaaataaatgtgatacattactttaaaagaatcaaaaacaataaccatatgattatcttaatagatgcagtgaaagcgtttaatataattcaacatctttacatgataaaatctctcaaaaaactagagttagtaggaaggtacctcaacacaacaaaggccatataccccaagtcaacagctaacctcatactaagtggtaaaatgctgaaagtttctcctctaagatcaggaacaagacaaggattctcactgatgccaattcaattcaacgcagtactaaaagtcttaatcagagtagttaggcaagagaaagaaacaaagtcatccaaattggaaacgagttaaaatgtctctgtttgcaggtgacatgatcttatatacagaaatccctaaagaccccaccaaaaactgttaaaactaacaaattccatgaagctgctgaacaaaaaatcagttctctttctatacactagatagaaactattcaaaaaagaaatgaagaaaatcatgagagtcgcttccaagacggccgaataggaacagctctggtctacagttcccagtgagatcgacacagaagatgggtgatttctgcatttccaactgagttacctggttcatctcactaggaatggttggagagtgggtgcagcccatggaaggtgagccaaagtggggggtgggggagtgttgcctcacccaggaagtgcaaggggtcaggggatttccctttcctagccaagggaagccatgagtgactgtacctggaggagcggtacactcctttccaaatgctgtgcttttcccatggtcttcacaaccaacagaccaggagattcctggagacctgcagaccaggagacctgcctggcttggtggttcccacacccacagagccttgctcgctgctagtgaatcaatctgagattaacctgggatgctgaagtttggcagggggaggggcgtctgccattgctgaggcttgagaaggcggttctatgctcacagtgtaagcaaagcaacagggaagctctaacagagcagagcccaccgcagctcagcaagacgtactgcctttctagattccacctctggggagagggcatatctgaacaaaaggcaggagacagcttctccagacttaaatgtccctgacagacagctctgaagagagcagtgattctcccagcatggcgtttgagctctgctaacagacagactgcttactcaagtggatccctgacacccgtgtagcctgattggtagacacctcccagtagggactgacagacacctcatacaggacatctctggctggcatctagaggttgcccctctgggacaaagcttccagatgaagaatcaagcagcaatatttgctgttctggagcctctgctggtgatacccaggcaaacagggtctggagtggacctccagtaaaccccaacagacctgcagctgaggggtcagtctgttagaaggaaaactaacagaaaggaatagcatcaacatcaacaaaaggacgtctacaccaaaaccccatctgtaggtcaccaacatcaaataacaaaggtagataaaaccacgaagatgggaagaaaccagagcagaaaggctgaaaattctaaaaaccagaatgcctcctctcctccaaaggaacacaactccttgccagcaagggcacaaacctggatggagaatgagtttgacaagttgacagaagtaggcttcagaaggtcggtaatcacaaacttctccgagctaaaggagcatgatctaatccattgcaaggaagctaaaaaccttgaaaaaaaggtaagacgaatggctaactagaataaccagtgtacagaagagcttaaattacctgatggagcggaaaaccacagtactagacttcgtgaagcatacacaagcttcaatagccaattcgataaagcttaagaaaggatatcagtgattgaagatcaaattaatgaaataaagccagaagacaagcttagagaaaaaagagtgaaaagaaacaaaaaaaaaagcctccaagaaaaatgggactatgtggaaagaccagatctacgtttgattggtgtaactgaaagtaatggggagaatggaaacaagttggaaaacactcttcaggatattatccaggagaacttcccaaacctagcaaggcaggccaacattcaaattcaggaaatacagagaacaccaaaaagatactctttgagaagagcaaccccaagacacataattgtcaaattcaccaaggtaaaaatgaaggaaaaaatgttaatggcagccggagagaaaggtcaggttacccgcaaaaggaagcccatcaaacgaacagtggatctcttggcagaaaccctaaaagccagaagagattgggggtcaacattcaacattcttaaagaaaagaattttcaatccagaatttcatatccagccaaactaagcttcataagtgaagaggaataaaattctttacagagaaactaatggtgagagattttgtcaccacaaggcctgcctcacaggagctcctgaaggaaatactaaacatggaaaggaaargagcaacccataccagccactgtaaaaacatgccaaattgtaaagaccatcaacactatgaagaaattgcattaattaatggacacaataacgagctaacatcataatgacagggtcaaattcacacataacaatattaaccttaaatgtaaataggctaaaggtcccaattaaaaaacacaaatctttatccaatctggcaaattagataaagagtgaagacccattggtgtgctgtattcaggagactcacctcacgtgcaaagacacacataggctcaaaataaagggatggaggaagatctaccaagcaaaaaaaaaaggcaaggggtgcaatcctggtctttgataaaacagactttaaaccaataaagatcaaaagagacaaggccattacataatggtaaagggatcaattcaacaagaagagctaactatgctaaatatatatgcacccaatacaggagcacccagattcataaagcaagtccttagtgacctacaaagagacttagactcccacacaataataatgggagactttaacaccccactgtcaatattagacagatcaatgagacagaaaattaacaagaatatccaggatttgaactcaactctggatcaagtgagcctaataggcatctatagaactctccactccaaatcagcagaatatacattcttctcagcaccacatcgcacttattctaaaattgaccacatagttggaagtaaaacactcctcagcaaatgtaaaagaacagaaatcacaacaaactgtctctcagtccagagtgcaatcaaattagaactcatgattaagaaactcactcaaaaccacacaactacatggaaactgaaaaatttgctcctgaatgactactgggtaaataaagaaatgaaggcagtaataaagaagttctttgaaaccaatgagaacaaagacacaacataccagaatctctggggcacatttaaagcagtgtgtagagggaaatttatggcactgaatgccctcaagagaaagcaagagacatctaaaattgacaccctaacatcaaaattaaaagaactagagaagcaaaagcaaacaaattcaaaagctagaagacaagaaataactaaaatcagagcagaactgaaggagattgagacacaaaaaaaccctgaaaaaaatcaatgaatccaggagctggttttttgaaaagttcaacaaaattgatagaccactagcctagcaagactaataaagaagaaaagagggaataatcaaataaatgtaataaaaatgataaagggstatcaccaccgatcccacagaaatacaaactaccataagagaatactataagctcctctaaacaaataaactagagaatctagaagaaatggatcaatttctggacacatacaccctcccaagactaaaccaggaaaaagttgaatctctgagtagtctaataacaggttctggcattgaggcaataattaatagcctaccaaccaaaaaaagtccaggaccagacagattcacagccaaattctaccagaagtccaaagaggagctggtaacattcttctgaaactcttctgatgagtagaaaaagagggaatcctccctaactcagtttatgaggccagcatcatcctgatacaaaagcctggcagagacacaaccaaaaaagagaattttaggccaatatccctgatgaagatcaaggagaacatcctcaataaaatactggcaaaccaaatgcagcagcacatcagaaatcttatccaccacaataaagtaggcttcattcctgggatgcaaggttggtccaacatttgcaaatcaatgaatgtaatctatcacataaacagaaccaacaacaaaaacctcatgattatctcaatagatgcagaaaagaccttcgacaaaaattcaacgcctttcatgctaacaactctcaataaactgggtattgagggaacatatgtcaaaataataagaacaatatatgacaaacccacaaccgatatcatatcaaatgggcaaaaactggaagcatttccttggaaaactggcacaagaaaaggatgccctctctcaccactcctattcaacatagtattggaatttctggccagggcaatcagtcaagagaaagcaataaagggtatccaaataaaaagagaggaagtcaaattgtctctgtttgcagatgacatgattgcatatttagaaaactccattgtctcagcccaaaatcttcttaagctgataagcaatttcagcaaagtttcaggatacaaaatcgatgtgcaaaaatcacaagcattgctgtaaacaaataagagacaagcagccagattatgatcgaactcccattcccaatcactactaagaaaataaaatacctaggaatccaacttacaagggatgtgaaggacctcttcaaggagaactataaaccactcctcaggaaataagagaggacacaaacaaatggggaaacattccatgctcatggatagaaggaaccaatattgtgaaaatgaccttcctgttcaaagttatttatagattcagtgctatccccatcaagctaccactgactttcttcacagaatttgataaatctcctttatagttcatatgaaatcaaaaaggaccccgcatagccaagacaatcttgggcaaaaagaaaaaagttgaaggcaccacgctacctgacttcaaattgtattacaaggctaaaaatcaactcaagatggaccaaagacttaaacataaaacctaggaccataaaaatyctagaagaaaacctaggcaataccattcaggacataggcatgggaaaagacttcatgtctaaaacaccaaaagctatggcaacaaaagccaaaattgacaaatargagctaattaaactaaagagcttctgcacagcaaaagaaactatcatcagagtgaacaggcaacctacagaatgggagaaaatttttgccgtctatccatgtgacaaagggctaatatccagaatctacaagaacttaaagaaatttagaagacaaagcaaaaaaccacatccaaaaatttgcaaaaatatgaacaggcacttctcaaaagaagaaatttatgcggccaacagacatatgaaaaaatgctcatcatcactggtcattagagaaatgcaaatcaaaaccataatgagataccatctcacaccagttagaatggcaaccattaaaaagtcagaaaacaacagatgctggagaggtgtggaaaaataggaatgcttttacattgttggtgggagtataaattagttcaatcattgtggaagacagtgtggtgtttcctcaaggatctagaactagaaatactatttgacttagcaatcccattatttggcatatacccaaacaattataaatcattttatgataaagacacatgcacatgtatttttattgtggtactattcagaagagcaaagacttggaaccaacccaaatatttatcagtgatagactggattaagaaaatgtggcacatgtacaccatggaatactatgcagccagaacaaaaggatttgttcatgtcctttgcagggacatggatgaagctggaaaccatcattctcagcaaactatcacaagatcagaaaaccatacaccacatgttctcactcataagtgggagttgaacaatgagaacacatggacacagggagaggaatatcacacaccattgcctgtcggggggtgggggtctaggggagggataacattaggagaaatacctaatgtagtgacgggttgatgggtgcagcaaaccaccatgacacgtgtatacctatgtaaaaaaactgcacattctgcatatgtaacccagaacttaaagtataattaaaaaaagaaaataaaatcataccatttgtaatggcaccaataagaataaaatatatagaaacaaatttaaccaaggatgtgaaaaatctgraccccaaaatctataggagagtgattaaggaaactgaaaaaaagaaataattgaaaatatatcttgtggttcatggattagtaaaatcaatattgccaaagtgtccatattgtttaaagcaactagagattcaatgctatctctatcaaaattccaacatcattcttacagaaatagaaaaaaattaaacctcaattatctgtctcaattttgaacaagaataacatagctagttgcatccgagttgctgatttcaaattatattatacaattatagtaatcaaaacagcatggtactggcataaaaacagacacatagaacagtggaacagaatagaaagcccagaaatataacctaaactctatggcatattgatttttcattaaagcatcaggaattgacaataagaaaaggatagtgtgacctataagtagtgatgggaaattgaatatctatatgaaaaaaatgaaactggatccttatcacaaaccatacacaaaataaactcaatatgaattaaatatttaaatgtaagacctgaaaccataaatcttagagaagaaaatataagattaaaaactccataatattgatttggcaataatttttttaagctaacccccaaagcaaaggtaacaagagcaaaaataaataattgggactatatcaatcaaaaaagtttgcttcactgtaaaggaaaccatcaagaaaatgaaaagccatcctagaggatgagataatatatgtgtaagccatatatgtgataaagggttaatattcaaaaaatatgaggaactcatacaacttaaaaacaaaaaagaaataatctgattttttaaaaatgaccaaaaaacctgagttgccattcttccacggaaaacttaccaacgatgagcatgactataaaaaggtttttttgttgcctttttttttttttttttgagacagagtcttgctctgtcacccaggctggagtgcagtggcgctacctaggctcgctgcaagctccgcctcctgggttcacgccattctcctgcctcagcctccgaagtagctgggactacaggcacctgccaccacgcctggctaattttgtttttttttttttggatttttagtagagacgagctttcaccgtgttagccaggatggtctcatctcctgaccttgtggtctgcccgcctcagcctcccaaagtgctgggattacaggcatgagccatcacgcctggtcaatataaaatgcaaatctaaactacaatgatatatcaccttacatctgttaggatgactatcaacaaaaaatcaaaagataagcattggtgaaaatgtagtgaaaacagatctcttatacatcatggatggaaatgtaaattggtatagtcattatgaaaaacagcatggatagaggtctcccaaataattaaaatagaaataccatataatccagtgattttagttctgtgtatatatctaaaagagagaaaaattactatttccaagagatataggcattcccatgatcgttgcaacattatttgcaatagctaagatatggaaaacacccaaatgtcagttgatggataaataaataaagaaaatggggtgtttgtatgtctgtgtgtgcatgtatgtgtgcatgcagtggaatattatgcaaccttacaagagaaggaaactctgctatttgtggtacaatagatgaacctgatggactttatgctctgagaattaatccagacacagaaagacaaatattgcatgtttccacttatatgtgaaatcttaagaacctgaagtaatagaaacataaagtaaataggtgattttcaggggttagaggtgggggaaatagaaaaatattggtcaaatttgctaacagagtaaatcttaagttatctcattccccccatataggtaactatgtgaggtgatggatatattaattagcttgattgtggtaataattttacaatgtacacatgtatcaaaacaccacattgtataccttgaataaatgaaatttgtatttgttcattataccttaacaaagctggaaaaaatatttaaagaattattcaagcttctgtaggacaatcttcctttctactgttatttgcttgtggtaaaaaatttatttttacaaattttaataatagtgactgaaatatcacacttaaaatctaataatatttaccatttggaattacwaatttgtttatattagtatttgcagagtaaacacatgaataatataaatatatgtagtgtaatataacttcaaacaatcattgatatgtttaaggattttcctagcattttttactttaaaaacccttcaaaataattttgaaagaagaaaacgcagttgaaaaactattaccttatgtcaagacctattataaagccatagtaatcaatacagcagagtatccttgtaatgaaagacattcagatgaatgaaacagaaaatagagttcagaaatagacccatgcatataagggcaaatgctttttcaccaaggtaccaagacaatttaatttaaatggtaatattttcaacaaaatgtgccaaaataattgcattaaaaatgaatcttgatcctaaacatacatcagctacaaaacttaacttgaactgagttattgagctaaaaactatcaaaagtgtagaagaaacgatagtaaaattttttgggatcttaggtttggcaaagatttcttaaacagaacaaaattaagcacaaattataaaacaaaagatcaatatattggagttcatcaaaattaaatgatttgctcttgaaaacacagtgatgtaaatgagaaaatggcaaaacatgtatttagcaaaatacttcatatcaagaatctacaaaaaatcttagaagtcagtaataataagtcaagaattagaaatgagtgaaaaatttaaacaaacactagggatcaaaggatatgtgtgtgtgtgtgtgtatatatatatgaatggtaaataagtgtataaaatatgtttagtatcattagtcatcagaaaagtkcaaattaaaattttaatatgataatatatcacactcacaaggcggctaaaaagtaaaaaatgacaaccacaagtgttggtgagaatgtagtgcaactagaaatttcatacactgctgttgggaatataaattgctaaaacasttttaaaactattttagtagctatgtacaaaattaaacatacatctaccataaaacccaatcttctagatgtttttctaaaatataataaagcttttgtttatacaaagacttgtattaaataattataaaattacacttgtaattataaaaacgtgaagccacacaaatgtccatcaacagagaaataatcaataaattttcgtagacccatgcagtgggattctaatgagcaattaaagggcacatattatagatacattaaacaacatggataaatctaaaaaacaattttgtggagtgaaaaaatctatatttggccagatctgtaatcccagctctttgttagggcaaggcgggtggatcatctgaggtcaggagtttgagaacagcctggccatcatggtgaaaccctgtctctactaaaaatacaaaaattagctgggcatggtggtgcgttcctgtaatcccagctactcaggagtctgaggcaggagaaccacttgaacccaggaggcggaggttgcagtgagcagagactgtgccattgcactctagcmtgggcaacagagcgagactctgtctcaaaaaaaaaaaaaaaaaaaaaaagaaaaaaataagaaaaaatctatatttatacagaattccagaaaatcaaaacgaatataaagtgaaacaaatcagattaattgttgccagggatgggaggtggaatatacggaacatgaaaaaaattgtgggtggttatgaatatatttgttatcttgatgtgtttaccttaaagtaaatcactctgagttcaatgtgaaagataagtttaaaggtaatgagttaggaagcaggaatattagttatgagattaattcataattaagatgagaaataacaaaggcttaactaaggcattgctggtgatgttgcaagaaagaaattagaataaaatatggaaattaggaaacatcaatttcattaaatgagtatatrtggatgctgaaagagaagaattaagtatsacatctgtatttattgtttacgtgacttkgtgtcatcaactgagtcaaataatataggatatgacattttaacttattggaaatggaatatatatatatatacttttctttactcctsctactaaatgcaactaaaaatctcaggcattgtatctaaaacaaacataaaaagactcctaaaggtgaagagaaggtggcagaccagctcggactctcaggacctgagtaatgacacattggtgagtatactggtgtgttgttttgcctcatatattctaacttggaactgaataaactgaaaactcagatatgtgcttcaaaacacacttgaaataaatgaaactataaaatttctctgcaaagatagggaagataattatatcaataattgtattattagattaattgttataagtgagagaaggtaaagacattcacccaatataaaataaattatttgaataaccctataatttaagagttaattatattcatgaattaaaaattgttccccaaggaaatctccaaactcagatagtgtcaatggagaattataccaaaggtttaaaaaagaaataacaccaaattcaagtctctttcagaaaatggaagagaacactttctaactaattgtatgaaggtagtattactctgwtaacaaatctaaataaagatagtctaatgaggaaatctcagactaatagctctaattaatttggatttaaaacttctaacacaatattagtaaatacaatttagcaatatattaaaataattatacactatgaccaagtggggtttattccaaagatacaaggctggttcattactcaaaatcaacaatttattccctatatattaatagactaagaaataaaattatatgaccatattaatcaatgcagaaggaacatttgacaaaattctacattcattcataataaaaactctcagaaaaatcagaatataggggagctttctttatttgaaaaatagctctaagaatactacagctcacatcacacataatggtaaaagtgtgagagcttttcccctaaaattargaaacagrcaaaaatttttattctcaccactcttaattacaatgctggaagttccagacaatgcagttagacaagaaaagtaaataaaattctgatcagaaaggaagaaataaaattccttctagttgaagttgacatgattgtctatagaaaatcgcaaggagtgtacaaaaacctcctagaactaataagttatttcatcaagtttgcaagatagaagatcagattacaaaatttagatgtatgtctatatgctaggaatgaacatgtggacattgaaattaaaagtacaataccacttagagtcactcaaaaattaaaatacttagttgtaaatataacaaaacatgcactggacctgtttactgaaaactacacaatgctgatgaaataaatcaagsgttatctaaataaataaagagatatgccacattcacgattggaagattgaacatagtaaagatgttaattcctccaaattaatatacaaatttaacacaattcttgtaaaaacttttgcaagattttttataacaacaggtgataaaaagtaaataaattataacatttataagtgaaggcaaagaaaatagaatagcttattgtagtaattatttaacaacaaatacatatatctatcatcacattatacaatttatgtatatacaattgtatctgtctattatacctaaataaatctggaaaaaagaaaagaagaataaaacatgaagaatctttctacccaattgtattacattatattgctcttggaatcaagactgtgtggtattggaggaaggacagaaacatagataaatggaaccaaacacaaaacccagaatacacatatagatatgccaaattgatattttataaagatgtaaaagcaattcaatggagaaaagagtcttttaaacacatggttttggagcaattagaaatgtataggtcaacaaattaaaatactgaaatactaaacatacttaaacatacttaaaatactaaacataaaccccactcctagaaattaatgcaaactggattacagtcttaaatgtaaaactataatatttcagaaaaaaataggagaaaatttttagaatctagtgttgacaaagagttcttagaattggcattgaaaacatgatatataaaaggaaaaactgatcaattgtaccagaccaacatgaaaaacttttgttttgtgaacaaatctgtaaaaaagataaaaatacaagctacagattccacatatctggcaaaggactggtttctagattatatacagaaatcttaaaataaacaatcccattaaaaagtgggcaaaagacatgaacagacacttttcaaaagaagacgcatatgcggccaacaagcrtattaaaaaaagctcaatatcattgatcwttagagaaatgcaaatcaaaaccacaatgagataccatgttgcatcagtcaaactggctataattataaagtcaaaaaataacagatgatggtgagtttgcagagaaaaaggaatgcttatacactggtggaggtagtgtaaattagctcaaccattgtggaagacagtgtggtgattgctcaaaaacctaaaaacagcaataccattccactcagccatcccattactgggtatatacccaaaagtacataaatcattctatcataaacacgcatgcacacatgtgttcattgcaggactattcacaatagcaaagacatggaatcaaaccaaatacccaccaatggtagactggataaagaaaatgtggaattaggagtggccaagatggccatctagaagttgctaatgtgtgtgcctctcacggagaggaaccaaaggggcaggtaaatayagcaccttcaattaaaatattcaggtactcgcattgggactattcaaacaacttgatccatggagaacagagaaaagcaaggcaggacgatggcccactcgggagtgacacagagccaagggaamctctctcacccagggaagtgrtgagtgaacatgtgaccacaggaaaccacacttcttctatggagctttgcaaactttgggtcaggtggtccccttgtgaacccactccacgtgggccttcagtctgacacagagagctacatggagtcttggcaaagcatccactcaggcatgcacgagactcaggagctttagatactccasctttctgggcttcctggcagaagtaactgcaaccccaggtggttagacccctgtacatacccctaagaaagaagttgaatccagggggccaagctgcaatggtctgtgaaccccacttccgttgcacctcacaggataagacccactggcttaggattccagccagttacaggtagcagagttgtgtctctctgtgatggagttcctaggggaaggggtgggctactaactctgctgtttgggtgacttagccatatggccttcaggctttggagagtccaaaccaaacgggggcagaagagatcccccagcacagcacagctgctttaccaaaacatggccagattgcttctttaattgggtctcaaatcccctttctcmtcacttggggggtaactcccaaccaaggcctgcagccccctctgccagtgttctctggccagtagagattttaaaattccatgggaaagagctcccagagggaggagtggaccattatctttgttgtttggataacttagccattttatcctttgggctttggagagcccaagccaacctggggtggaagtggtacaccagcacagcacactgccctatgaaaaagtggccatactgcttttttacgtggttccctgatcctgtccttcatcacagtgtggagcctcccaaccaggatctccagctacttccactggtgttctctggctgacagaggtttcagacctccctgggatggagctcccaggggtaggggtgggccgccatctttgctgtttgagcaaattagctatttcagccttcaagcttcagagtgtttgaggtgactgggggctgatgtggactcacaatacagctgctctatgaaaacatggccagactacttttttaaccaactccgtgatcccattcctcctgactgaacaagacctcccaacaggggtctttagccacctcctacaggtgtgttcgggctggcaacaggcctctgcctccctgggatgaagctctgagagggaggagcaggctgctatctttgttgtttggcagccttaactggtgatacttccaggcattggaaaacctgagacaactagggactggagtggatgctcagcatacccagcgaccctatggaaaagtgaccagactgctacatgagtgcccattcccatatctcctcaccaggcaggtcctccatgcctgggcctacagccactctctgccagagctgtcaagcctctctggacggagccgccaggggcaactgaaagcctctctgccactgcctttgcagtaggcctctccttgttactcttgaactataaaaagagcaaagaccttaagtgcctatccacamctttaacaactggtagttgacccaaggagagtaggcctgtctatccccatgggttccacataccccacattgctcatcactagacagggaatccctggctggggcccagagcacagaccatccatcctgggatgattgcactgagtgactgctgacccacatctctctgggatggaggctccaggagacaagcaaagtggtggaacagcaagccagatgatgtggagcccagggggtttagtgcaagagcatctgtcgtggagcagggccagagatggtcattcctctaggctcaacttgctcccacaagaggctttagccctagggaaaccattggacctgatctctgcagggcagccttgcacatcagatggggctagtcccacctgagcactccttggtctgctggcctcctggggccccatcctggccatgcctgcttataagacagtctcaggtgcsctgcgagcccacaccatagcttctgcaccagtggaccatgcctgycccatggaaagctccagcaaggtggcccctacaggtgtgcaccagcctgcacattcccttgccatagtgcagcttctcatgagcccatggcaaatccccaagtcgtttttctggtgcatgtctgcatggcaggttttgctttccttgccccttcagcatgcaggagtgcactacttcccccatcccagcctactgctattgcagacttagccttggctggcacagagccagtaagccctgcctctgccagtgctctgcttttttgttaatgctgcacagagaacagggaattcttttacaacctgggcaatcacgcatgcttgtggggcacagaataagcacccaggcctgcactggccagcattccaccacaaaccaggaccatctccastgcaacagtgcacacagtctctagcagggtactaccataaccccaacccttggctgccttgcctccaccactatggtgaatgcccacagggaggcaggtaccccctgcatccagtagcactttgctgcagctgacacacctcagttcccccagtgcagtagactccaaacctcaaggagccagagaacaaagggcccaatacaagtcctgcagatttacagcacgcagcccagaagttcagagatgaaggttggatcccctaaaatcttccagaaacaaaaccagttggctgaatccaccttatatcacaatcaaacactcatggttatcaaataggataaaagaaaaaaaattaaaatgtcagcaacatcaaagatcaaaggtagataagcccacaaaaatgagattcagtgcacaaatgctaaaaactcaaaaagccagaataccttctagcctccaaatgaccacattcactcttcagcaaggattcagaactgagctgaggctgagatggctgaaatgacaagtacaattcagaatattgataggagcaaagttcactgagctataggagtacactgtaactcaatgcgaggaatcaaaaattatgataaaaaattacagaagctgacagacaaaatagccagaatagagacgaacataaccaacctgatagagctgaaaaacacactataaaaatttcataatgcaatcacaagtattaacagcagaatagaccaagtggagaaaaaaatcttagagcatgaagactggctttctaaaataaggcaggcagacaagaatagataaaaaaagaattaaaaggagtatataaccccccmaaaaaaatgagattatgtaaagagaccaaatctatgactgattggtgtacctgaaagagataaggagaatgggaccaacttggaaaacatatttcaggatatcatccatgagaacttccctaatccagctagagaggataacattcaaattcaggaaatgcagagaaccccagtaacatgctccacagaaagaccatccccaagacacatactcatcacgttctccaaggttgaaatgaaagaaaaaatgttaaagggaggtagagagaaggaccaggtaaactacaatgggaagcccatcagtgttaacagtggacctctaactggaaaccctgaaaataaaagattgggtgtcaatattcaatatttttaaggaaaagaaattccaactcagaatttcttttctcactaaatatggaaagaaaagaccattacccaccactacaaaaacacactgaagtacacaaaccagtgacattataaagcaaccacataaaaaagtctgcaaaataaccagctaacaagatgatgacaggatcaaatccacacatatcaatactgattttaaatgtaaatgggctaaatgctccaattaaaagacagtgtggcaagctgaataaagaatcaagacccatcagtatgctgtcttcaagagccctatctcatatgtaatgtcacacataggctcaaataaaaggaggaaaatctatcaagaaaatgaaaaacagaaaaagaagggattgaaatcttagttcttgacaaagtagaactgacaagcatcaaaaaggacacagaaaaacgtcaaataatggtgaaagactcaattcaacaagaagatgtaactattctaaatatatgcacccaacacaggagcatctcgatttataaggcaagttcatagagaccttcaaagagtcttagactaccacacaataatagtgggatattttaacaccccattgacaatattagacagattattgaggcagaaaattaacaaatatattaatgacctgaactcagcactggacaatatgggcctgatagatatctacagaactctccaccaaaaaaataacaaaatatacatttttctcaccaccacatgggacatactctaaaaccaactgtataattagatgtaaacctttcataagcaaattcaagagaactgaaatcataacaaatagtctctaggactatggtgcaatgaaactagaaatcaagactaagaagttcactcaaaaccatataattatatggatattgaataatctgctcctgaatgattttggggtaaaaaatgaaattaagggagaaatcagtaagttatttgaaactaatgagaacaaaaatacaatataccagaatctctgagacacagctaaggcagtgttaagagagaaatttatagcactaaatgcccacagaaaaaagttagaaagatctcaagttaacaacctaacttcacaattaaaagaatcagagaaccaagagcaaaccaaccccaaagctagtagaagacaaataaccaaatcagagctgaactgaagaagagataaaggcacaaaaaaacattcaaaaggtcaacaaatccaggagctgcttttaaaaaaataataaaataaatagaattctagatagactaatgaagaagaaaagagagaatatttaaataaacacaatcagaaactacaaggggatattaccactgaccccgcagaaataaaattatcaatgaatgttatcaacacatttatgcatataaattagaaaatctagaggaaatgaccaaattcctggacaaatacaccctcgcaagactgagccaggaagaaattgaattcctgaacagaccaataatgagctctgaaatggaggcagtaataaatttcctatcaaccaataaaagcccaagaccagatggattcatggctgaattctaccaaatgtacaaagaagagctggtaccattcctattgaaattactttaaaaaattgaggagaatggacgcctccttaattcattctatgaggycagcatcatcctgatagcaaaacctggcagcaatgcaacaaaaaaagaaaacttcaggccaatatccttgatgaacactgatgcaaaaatcctcatcaaaataccagcaaactgaattcaacagcacattgaaaagcttattcagataattgctggaggtgggggattcaagatggcctaataggaaaaacacctgtgtgcagttcccagcgagatcgatgcagaaggtgggtgatttctgcatttccaactgacgtacccggttcatctcaatgggactggttgcacagtgggtgcagcccacggagggtgagctgaagtcaggtgggttgttgcctcacctgggaagtgcaaggggtyggggaattttctcccctacacaagagaacccatgagggtctaagcctgaggaactccagcacagatactgagcttgtccctcagtcttcacaacctgcaaaccaggagatcccctctggtgcctaccccaccaaggccctgggtttcaagcacaaaactgggtggccagttgggcagtcactgaactagctgcaggagctctttttttcccataccccagtggtgcatagaatgccaatgagacagaaccgttcactccccttgaaatggcagctgaagccagggagcaaagtggtctggcttggtgagtcccatccacatggagcccaggaaactaaaatccagtggcttgaaattctcacagtcagcacagcagcaatctgaggtccacctgggacattcaagcttggtggagggaggggcatctgccattgctgaggcttgaataagcggttttatgatcacagtgtaaacaaagcttctgggaagttcgaactgggcagagcccactgtagctcagcaaggatgctgtggccagactgccagatttctcctctctggacagggcatatctgtaaaaaaggtagcagccccagtcaggggcttatagcagacataaaagttcctgcctgatggctctgaagagtacagtggacctcccagcacagtgttcgtgctttgctaagggtcagacrgcctccacaagtgagtccctgacccccgtgtgtactgactaggagacacctccaagtaggggccaacagacatctcttacaggagagctctggctggcatctggaaggtgtacctctgggtcaaaacttccagaggaaagaacagacagcaatctttgctgctctgcagcctccactggtgatacccagggaaacagggtcgggagtggacctccagcaaactccagctgactggcagcagaggggcctgactgttagaaggaaaataaacaaacagaaaggaatagcacatccactcaaatgccccatctgaagttcaccaacatcaaagaccaaaggtagataaatcyacaaagataggaaagaaaaaaaaaagtgctaaaaggatataaataccaaaatccagaatgcctctcttcctcygaaggatcacaactcttcaccagcaagggaacaaaactggacagagaatgcatttgatgaactgacagaagtagccttcagaaggtgggtaataacaaactcccctgagctaaaggagcatgttctaacccaatgcaaggaagctaagaaccttgaaaaaaggttagccgaattgctaactagaataactaatgtagagaagaacatatatgatctgatggagctgaaaaacacagcatgagaacgtgaagaatatacaagtatcaatagctgaatagatcaagcagaagaaaggatatcagtgattgaagaccaacttaatgaaataaagagagaagacaagatcagagaaaaaaaaaaagtataaaaagaaagaacaaacactccaagaaatctgggactatgtgaaaagaccaaacctgtgtttgattggtgtatctgaaagtgatggggagaatggaaccaagttggaaaacactcttcaggatattatccaggagaacttccccaacctagaaagacaggacaacattcaaattcaggaaatgcagagaacaccacaaagatacttctagagaagagcaaccccaagacacataattgtcagattcaccaaggttgaaatgaagggaaaaatgttaagggcagccagagaaaaaagtcaggttacccacaaagggaagccaatcagactaacagcagatgtctctgcagaaaccctacaagtcagragagagtgggtgccaatatttggtgttctcaaagaaaagaattttcaaaccagaatttcatatctagccaaactaagcttcataagtgaagaagaaataaaatcctttacaggcaagcaaatgctgagggattttgtcaccgctagatctgccttacagagctcctgaagtgagcactaaacatggaaaggaaaaacagttaccagccaatacaaaaacataccaaattgtaaagaacatcaacactatgaagaaaccgcattaactaaccaacatccagcaaaacaaccagctagaatcataatgacagaatcaaattcacacattacaatattaaccgtaaatggaaacaggccaaatgccccaattaaaagacacagactggcaaattggataaaaagtcaagacacctcagtgtgctgtattcagaagatctacctcawgtgcaaagacacacataggctcaaaataaagggatggagggatacttatcaagtgaatggaaagcaaaaaagaacgtgagttgcagtcctaatctctgataaaacagactttaatccaacaaagatcaaaagagacaaagaagggcattacattttggtgaagggatcaatgcagcaatgagagctaactatcctaaatatatatgcacccaatacaggagcacacatattaataaagcaagtttttagagacctagaaagacttagactcccacacaataataatgggagaatttcacactccactgtcaatattagacagttcgaggagacagaaaattaacagtgatattcaagacttgaactcagctctggagcaagccgacctaatagacttctacagaattctccaccccaaatcaacagaatatatattcctctcagcaccacatagcacttattttaaaattgaccacataattggaagtaaaacacttctcagcaaatgtacaagaatggaaatcataacaaactgtatctcagaccagagtgcaatcaaattagaactcaggataaagaaactcactgaaaacctcacaactacatggaaactgaacaacctgcttctgaatgaytactgggtaaataatgaaataaaggtaggaataaagacgttctttgaaaccagtaagaataaagacacaacgtaccagaatctctggacacatttaaggcagtgtttagagggaaatttatagcactaaatgcacacaagagaaagcaggaaaaatctaaaattgatgccctaacatcaaaattaaaagaactagagaagcagaagcaaacgaattcaaaagctagcagaagacatgaaataactaagagcagagcagaactgaaggagatagaggcacaaacaaccctccaaaaaatcaatgaattcaggagttgtttttttagaaaaatcaacaaaatagatagactgctagccagactaatacagaagaaaagagagaagaatcaagtagacaaaataaaaaatgatataggggatatcaccactgatcccacagaaataaaaactaccatcagagaatacaataaatgcctctagcaaataaactagaaaatctagaagaaatggataaatccctggacacatacaccctcacaagtctaagtcagaaagaagttgaatccctgaatagaccaataacaagttctgaaattgaagcagtaattaatagcctactaaccaaaaaagtccaggaccagacagattcacagccgaattctaccagaggaacaaagaggagctgctaccattccttctgaaactattccaatcaatagaaaaagagggcatcctccctcatttcatgaggccagaatcattctgatatcaaaacctggcagagacacaacaaaaagagaaaamttcagaccaatattcctgataaatatcgatgtgacaatgctcaataaaatactagcaaactgaatccagcagcacatcaaaaagattatccactatgatcaagttggcttcatacctgggatgcagagctggttcaacatatgcaaatcaataaacgcaatccatcacaaaaacagaacaaatgagaaaaaccacatgattatctcaatagacacagaaaaggcctttgataaaaatcaacgcctcttcatgctaaaagctctcaataaactaggtatcgatggaacatatctcaaaataataagagctatttatgacaaacccacagccaatatcatactgaatgggaaaaaactggaagcatttcctttgaaaactggcacaagacaaggatgcctctctcatcactcctattcaacatagtattggaagttctggccagggtaatcaggcaggagaaagcaataaagtgtattcagatatgaagagagtaagtcaaattgtctgtgtttgcagattacatgattgaatatttagaaaaccccatcatctcagcccaaaatctccttaagctgataagcaacttcagcaaagtctcaggacacaaaatcaatgtgcaaaaatcacaggcattcttatacaccaataacagacaaacagagagcaaaatcatgagtgaagtcccattcacaattactactaagagaacaaaatacctaggaattcaacttacaaggtatgtgaaggacctcttcaaggagaactacaaaccactgctcaatgaaataaaagaggagagaaacaaacttttacatttatctcttcattgctgaacatatttgtcaagatttcaaaatgtccagatgtggaaagcaaggtggaaaggcctgagccaaggctaagacttgctcttctagggttgggctccagttccccgtgggtcaagtagctcctgacagaagcaaaaaacatggaaaaagacaaccagtaccagccactgcaaaaacacgccaaattgtaaagaccatcgatgctaggaagaaactgaatcaattaacagttaaaataaccagctgacatcataacgagaggatcraattcacacataacaatattgaccttaaatgtaaatgggcttaaagccccaattaaaagacaaagactggcaaattggatagagtcgagacctgctagtgtgctgtattcaggagaaccatctcacgtgcagggacacagataggctcaaaataaagggatggaggaagatctaccaagtaaaaggaaagccaaaaaaagaagcggttgcaatgctagtctctgataaaacagactttaaaccaacaaagatcaaaagagacaaagaaggccattacataatggtaaagggatcaaatcaacaagaagatctaactatcctaaatatctatgcacccaatacaggagcacccagattcataaagcaagtccttagatacctacaaagagacttagactcccacacaataataatgggagactttaacaccccactgtccatatcagacagatcaatgagacagaaggttaacaagaacatccaggaattgaactcacctctgcacccagtggacctaatagacatctacagaactctccaccccaaatcaacagaatatacattctactcagcaccacatcacacttattctaaaaatgaccacataattggaagtaaagcactccttagcaaatgtaaaataacagaaatcataacaatctgtctctcagaccacagtgccatcaagttagaattcgggattaagaaactcactcaaaaccacacaactacatggaaactgaacaacctgctcctgaatgactactgagtaaataatgaaatgaaggcagaaataaagatgttctctgaaaccaacaagaacaaagactcaacataccagaatctttgtgacacatttaaagcagcgtgtagagggaaatttatagcactaaatgcccacaagagaaagcagaaaaaatctaaaatcagcaccctaacaccacagttgaaataactagagaagcaagagcaaacaaattcaaaagctacccgaagggaagaaataactaagatcagagcagaactgaaggaaatagagacacaaaaaacccttcaaaaaaatcaatgaatccaggagctgggtttatgaaaagatcaacaaaattgacagactgctagcaagactaatatagaagaaaaaagagaagaatcaaatagacacaataaaaaataataaaggggatatcaccaccaatcccacagaaatacaaactacctttagagaatactataagcaccggtacacaaataaagtagaaaatctagaagaaatggatgaattcctgaacacatataccctcccaagacaaaaccaggaaaaagttcaatctctgaatagactaataacaggctctgaaactgaggcaataattaatagtttaccaaccaaaaaaagtccaggatcggacgtattcacagccgaattctaccagaggtacaaagaggagctggtaccattccttctgaaactattccaatcaatagaaaaagagaaaatcctccctgtctcattttatatggccagcatcagcctgataccaaaacctggcagagacacaacaaaaaaagagaattttagaccaatattcctgatgaacatcattgggaatatcctcagtaaaatactggcaaaccgattccagcagcacatcaaaaagcttatccaccacgatcaagttggcttcatccctgggacgcaaggctggttcaacatatgcaaatcaataaatgtgatccatcacataaacacgaccaatgagaaaaaccacatgattatctcaatagttgcagaaatggccttcaacaaaattcaacagccttcatgctaaaactctcaataaactaggtattgatggaatgtatctcaaaataataggatctatttatgacaaacccacagccaatatcatactgaatgggcaaacctggaagcattccctttgtaaaccagcacaatacaaggatgccctctctcaccactcctattcaacatagtgttggaagttctggctagggcaatcaggcaagagaaagaaataaagggtattcaattaggaaaagaggaagtcaaattgtctgtgcttgcagatgatatgattgtatatttagaaaaccccattgtctcagcccaaaatctccttaagctgataagcaacttcagcaaaatctcaggatacaaaatcagtgtgtaaaaatcacaagcattcctatacaccaagaacagacaaacacagaaacaaatcaagagtgaactcccattcacaattgctacaaagagaataaaatacctagcaatccaacttacaagggaggtgaaggacctcttcaaggagaactacaaaccactgctcaaggaagtaaaaccggagcaaaacaaatggaagaacattccgtgctcatggataggaagcatcaatatcgtgaaaatggccatactrcacaagatgatttatagatttaatgccatccctatcaagctcccaatgactttcttcacagaattggaaaaaaactacttagtttcctatggaaccaaaaaagagccctcattgccatgacaatcctaagcaaaaagagcaaagctggaggcatcacgctacctgatttcaaactatactacaaggctagagcatccaaaacagcatggtactggtaacaaagaagatatatggaccaatggaacagaacagaacagaggcctcagaaataacaccacacatctacggccatctgatctttgacaaacctgacaataacaagaaatggggaaaggattccctatttaataaatggtgttgggaaaactgtctagccatatgtagaaagctgaaactggatcccttccttacaccttatagaagaactaattcaagatggattaaagatttaaatgctagacctaaaaccataaaaaccctagaagaaaaaacctaggcaataccattcaggatagagacatgggcaaggacttcatgactaaaacaccaaaagcaatggcaacaaaagccaaaattgacaaattgcatctaataaaactaaagagtttctgcacagtaaaataataataataacaataaaacaaaaaaaaacctatcatcagaatgaactggcaacctacagaatgggagaaaaatttttgcaatctatccacctgacaaagggctaattgaatgtacaaagaagttaaacaaatttacaagaaaaaaacaaaaaaacacattaaaatttgggcaaagtataagaacagatacttctcaaaagtagacatttatgcagctaagaggcatatgaaaaaatgctcatcatcactggtcattagagaaatgcaaatcaaaaccacaatgagataccatctcacgccagatagaataacgatcattaaaacgtcgggaaacaacagatgctggagagatgtggaaaaataggaatgcttttacactgttaggggagtgtgaattagttcaaccattgtggaagacaatgtggcaattcctgaaggatctagaactagaattgccatttgtcccagcaatcccattactgggtatatacccaaaggattataaatcattctatgataaagaaacatgaacacgtatgtttattgtggcactattcacaatagcaaagacttggaaccaaccaaaatgtcatcaatgatagactggattaagaaaatgtggcacatatacaccatggaatactatgcagccataaaaaaggatgagttcatgtcctttgcagggacatggatgaagccagaaaccataattctcagcaaactatcacaagagcagaaaaccaaacactgcgtgttctcactcataagtgggagttgaacaatgagaacacatggacacagggaagggaacatcacacactggtgcctgttggggactgggggactaggtgagggataacattaggagaaatacctaatgtaggtgacgggttgatgggtgcagcaaaccaccaaggcacgtgtatacctatgtaacaaaacacgttctgcacatgtaaccccaaacttaaaggataataataataaaaaagaaccacaacaaaaaaagaaaagcttatttatcataatcaagtaggctttaatgctgggatgagagtttggttcaacatatgcaaatcaataaatatgattcatcacataaacagaactaaagacaaaaaacacgtwattatctcaatagatggagaacaggctttcagtacaattaaacattccttcatgttaaaagttctcaacaaacaagattttgaaggaacatacttcaaaataatgagtcacttatgacaaactcacagccaacatcatactgaatgggcaaaagctggaagcatttcccatgagagctggcacaagacattgattccctctctgaccactcctattttacatagtattgggagttctagctaggtcaatcaggcaagagaataaaatgacagcatccgaatagatagcaaggaagttaatctataaaatattgctgaagaaattaaagatagctaaataattgagggcttatgtatgcatgtgtatatgtatatctcatattcatgattggaagaccccactttgaaaaaatgtcagctgtccccaaattggtctatagattcaatggaatcctaataaaaatctaagcagatctttttttttctgtactctgattataacatttacacggatatgctaagaatctgaaatatcaaaaaacagtctttaatagaagaaacaaaacgactgggctttcacttttttcaccttttgactttaattaaaaaaccttaatatcaagcaaaaaaaatccaattagaaaatgaacagaagacatgaaaagatttttcaccaaaatgaatatatagatgtcatataagcttatgaaactgttttaggccctagggaaatgcaaatttaaactatgttaagctatcactttacacctattagaatggctaaaatttaaaaaaaaaatggtgactgtaagaaatgctgctgagcatgcagtgaaactggatgacatatattgctggtggcataaaatggcatagccactttacaagattatttggaagcttcaaaaaaaaaaaaacactaaaaatgcatctaccatatggcccagcaattgcactcttaggtatttatcttagagaaattaatacctttgttcacacaaaaagttgtacatgaatgtttacagcagctttattcaataataaccaaaagatgtaaatgaataaaaaccttacagatatccttcaatagtgaaaaggttaaacaaaccatggcacatccatgtaatggaatactaggtaacaatgaaaaataaatgattattgatacacatacaacctggctgaatctccagtgattgtgcagagtgaaagaaacaaaccccaattggttacaatactgcacgatttgttttatttgacaatcttgaaatgaaatcatacaaatggagaacagattgggggtagctatggaataatgaggggattgggcagtggtgtggacataaaaggacaacatgagagatctgtgttgtgaagaaaatgttctatattaactacagtattctcattatgacattgtacttatttggaggatgttaccattgggggaaaatgagtaaagggcacctggaatctctctgtattatttcttacagcttcttgtaaatctacaattatcttaaaataagaagtttaattaaaataatgtatgcaaaataagcttatttggtggtggacatggtcaaaagtttatcatttcctatttacttacctattgtgttacacttattaagacacacccacttttgcctactttaagcacaagtttatagttactaagacatacatttgtttttatattagttagtatttgggaatgggtaayaagaaatttgatttacatagttgtatatgtgcatgtgtgcatcctcagatataagttcatgttttcattatgagtatatgtatttttatgtgttttttaaatgtttattttaggtttagtggtacatgtataggtttgatatattggtaaattgcatgtcatggaggtttggtgtgcagattattttgccatccaggtaatttgcatagtaccagtcaggtaattttttggtcctcagcctcctctctccctccaccttcaagtaggctgtggtgtctgtttttcccttctttgtggccatatgtcctcattgtttagcttccactcataagtgagaacatgcagtatttggttttctgttcctgtgatagttttcttaggataagggcctccagctccatccatgtttctccaaagggcattatctcattcctgtttatggctgtgtagtattccatggtgtatatgtaccacatttttgttatccagtctaatgttgatgggcatttcggttgattacatgtctttgttattgtgaatagggctgcaaagaacatacagatgcatgtatttttgtggtcgaacaatttatattcctttgtgtgtatacccagtaatgagattgcttggtcaaatggtaattcttctttcagttctttgagaaataaacaaaatgccttccacaatggttgaactaacttatatcgcctatagcagtgtataagctttcccttttctgtacaacctcaccagcatgtgttagttttttgacattttaataatagccattctgactatgtgagatggtatctcttcgtggttttgatttacatttctctgacgattagtgatgatgagcatttttttaatgttttttggccacttgtatgtcttcttttcagaagtgtctgtttatgtttcttgctcactttttaatggggttatttgtttattgcttgttaagtttcttagagattgtggatattagatctttgtttgatgtttgtgaatatttcccccattctgtaggttgtctgtttactccgttgatggtttcattctttctgtgtgggttgatgttccttcaactgtagtgtaatatgagtataatcagttgacttcttttctgaatgttttcagcagtctaagcatttttgcaggatctttatttgtagcttagttcttgtccttggtttcactgggggatatattaacagtattttcggtgttgaaatttggttgtaatccactagatggtgcttaaatgtaatggttaataggtacgctcttgcttagccatgtggctcgcctgtatttcctcatgattgccatcaaattttctgttactgttctgaaagtgtaggctcctctcccacwgaagtgctgtctgtagacctctgtttggcacttgcgagctgtacagcacaaccttgtggtgagctcatctttattttccttccccacttttgaggcagcaggggacaagaccttggcagtggctatggcagagggtctttcccgtgtcttttggtgctctaccctagagaaattcagagcggatatcaactggtgcaatcagtcaagggtggggcagctgcgtttttggcccaagccatgggaacctgcctggggatgggaaggggattgcggagggaacagaccagcctcttctccttatggtggctgtggctttctggaggtgtggttaaagcactgtgcgtctttgcttctttcccagtctgagggcagcaagggcactaccattgcagtggcaggggcagaaaggcttttggttgtctctgggacctccatctcagaaaaaaacacagagtcactgctactggggatgttcagccagggggtgaggcaactgtgctgttggcctgaggtggggaccccgcttggggaagagtsggggttcgagggataacagggaggagagagtgggctcttctttgtatggtgactgtgtcttgctagaaatgtgagtaaagccctcaggatcttcatttcttctccagcctgagggcagcaggggaagaaccactgcaatggcagtggcagaggggctgtcagttgcctctgggagcccctcccccagggaaatacaaagccactagcagagggaatgctcwgccaagggtgggacgtctgtgtagatccaggcttggggccctrcttggtgaagagtgtggggtgggagcctacatggaagagagactgggctcctctctgtatggtggctgcagcgtgctggaggctccagtgtagcaactcgaccttttgttttattccctggcctgaatgcagcagaacagtaccactgcagctgcaatggcagagaagctgtgggttgtctctgggatttcctcctcagaaacgcagagctgctaccgagtaaagtgtttatgtggaagcagagtgattgtgcttggggcccaggtcaagaggcactgctcagtgaagagcagcggaggtggggacacacgtgaaaacagtctggccgcttttcctttaaggtgactgcgctgtgctgtgggttcgcgtcagtccccaacttctatactacctccagagcctgatgagaacatgagcgtggaaaaacgtcagcttgcctgctccctctgggagctctgtcccagggaagtgtggagctgcttccagcctgagaactcaggcagggctggggtagccttgttagtgtcccaagctaatgggccttatcctgcggcgtgcccgggaagaaagcctgcaatctgggcatggtggtgggtgcttataataccagctacttggaaggctgaggcaggagaatcacttgaacccgggaggcaaaggttgyartgagccaagatggtgccactgcactccagtggcgctccagcctgggcgacagaatgagacaccatatcataacaaaacaaaacaacaacaacaacaacaacaacaacaaaacctggaatattaytcagcttttaaaaagcaggaaatttaacatytattttaaagataaatcttaatggtcttatgataagtgtaataagtccatcataaaaagtatgaatccacttatacgagttagctaaagtagttgcacttttaaaaagagaaaatagaatggcatttgtaaagggccagtcaatggggaaaacaggtagtcgattcatgtatagtatgtattcattttgcaagataaaaatgttctggtgatatgttgccaacaatggcaatatacttaacatggtctaactattaatataaaattaaaatatttaagattgtaaaaaaaaaacagaagctttacatccatatgtgatttaatcttcataacaccatatggcagctgttattctactttacagatgagaaaacacacctagggacattaagtgatttgttcaaggtcaaaaacataatgagtgctggatctaggatttggattcaggtctgtctggtcagagcccaatcagtgagcattctttgtacctcaggctcacatatttgtcatttacaacttaaataaagtaacaaaagttgggcaaagtaaatattttcattttgacaaaacctttctctggtaaggaagtttcactcagctaacaggttttgctcagaactgtaatggagcctagattatgacaacctgctttatcagctttctttactggatctgctagatgtgcctgtcatgattaacctgctttctaccaggtgcttgaattaggctagaagtgctgtgatgacactttcagtatcaacctaagttctgcaggtgaaaagacagtgacctggatgacgttgtcatttcacctacccaagaccttaaatgccaagctcgaatccctatcttcaacgctcattatctcataatcacataccttcagcctacaaacctgtattgacttctcatcaagccctatgtcaggctctggcaatacaaagaggaattagaatgaccctgttcttcgaggagtttatatctagatggggcatagacacaaaaacctaacacataacagagggttgtaagtgctatgattttgttaatctgtggagtgcagggttacaaaagagtggcatcacacccagttgtaagttcagggaagacttactggaggaggtggtacttgtcctgaactagatgaagaggttgggaaagcagatgcaaagataaggagggaagagagaactttcggatagttgtttgtcaggagcttagcatgtgagggatagaaggggttagggatgaagcatagagtttttcagacaccagtcatgagagtcgaatgctggacaaagtagatgggtcttgaatctgtggaaaatggagaattattgcggagttattggcaggggtgtaatattgtcagatttacatattagaaagaacactctataaataaaggcagagtgatcagctagattatttgtagaagttcatgtaaacctcagtgagatctgagccagactgagttgagaaggaagggctggattctgtcatgagaataagagaaatggaagaatctgaagtgattctagatttttggcatggctgactgggtggatgaaaattccatttgtagacctgtaggggcagcagtctgggggacaaaaggatgagttttggacttgttgagtttgaacgatctggaagacattcacatggatatgtcaaaaaaggcatttcaagtgtccagtttaggagacagatgggctggagatttgatgttcatcagtactacctgttagtgatcttataaggattaaataatatgcatatggaaaatatatatatacttgccatttagttgtttgttgagcatactgaatatttgyatacaaaggtatacttacaacacttttttcacaagcacagctgaaataaactataacaactaccacttatactatttaccataaattgtgctaaatgtttttacttattatctagtgtttatggtaaccctttgatataggagtagttattcccattttttttcttatgagtaaactgactaggagatatagtgtaggttggccagggctacacagtagcagaactggggaattccaaggccagtgttctttcttatgacgcattttctgtcttgggttacaacagcactaacgacaggtagcattgcacacaggcagctgctgggaagtctccgcccccatctctggctaggagccctgcaggtgatgataaacaagctcctgtggaattgtgggtagacactggacttgtaaacgaaaagcttcataagtccctctttgcttagtacttttctcgtcctttccccagggtgcacgtaaccctcaagcactaggaccgtgcggaatccaggctgcgatggcaccttcatttaccgcccgcattcagttgttcctcttgcgggcgctaggctttctcataggcttagtaggccgagcagctttagtcttagggggyccaaagtttgcctcaaagacccctcggccggtgactgaaccattgcttctgctttcggggatgcagctggccaagctgatccgacagagaaaggtgagaatgcaattcagaagaggctggagggacaggtcttttagcaggatccaggaagcttagtggtggcggtggttgtggtttcctttccattctctactagggcgacttaggagaggcatttattggggatgaagggagacttctgggtgttgtagtacgtttatttttaccaaggacatttactgtgggcatgggttggactattttggtaccgtcatagtccttcctatccatttgtcctatttgtgcataattactgtgtgtggggtaaagcaggtgtgaatttcaaactgattctcagctatggaaagtcagtctctctctttctctctccctctccctttctctctctctattcttccgtctctcacaggccccagatcaacctgctgcttaccattcaaccaattctttttaaaattgatttaaagtaaaagtagtacttggtctaggatagtaaaagctgcgtctaccatatatttattgcatagtatatgtgaaatactctgcctgggtacttaaacatattctatttcacggatgcagttatataggcaatattcatattttatgcataaggaaactgaagtaaaatgatttgcacaaaaattgttgaaagttctaaattaaaaaaattaagcagctcattcgttctctatagaattgtgcaggcaggactattcatctctgtcatataagtgattggttacctggagatcttgagctacagtctagtattgtttatttatactctgcttgttttcacctctctgctgtttcatttgtttttcgtcattgctttatttccagaatctacaatactacttaacaaagaataggcatgcagcaaatactatctcagtatgtgctcctgaatgtatgaattattaatatttgtattgtactcctggttacctttcaaagacatatcctgtcttcttgccgtaccccctccccagcctctacccactcatgcatgcttttctaccagttagggaggcaatgggatgtattcggttggtgcaaaagtaattgtgattttgtaattgagattttgacattacttttaatggcaaaaatcacaattacttttgcaccaacctaatagtagaaagatgatatatttcaaattttggactgtctgttcatggctctgtgaccttgtgccacaccaatagcagataatacatatcaagaacctggcacatagaagattgtgtaacataatgattagaaggatggactctagagtcagactccctgggttcagaaatcctagcttttctacgatctagctctgtgatcttaaaaacatttctttttttttttttttttttttttttttttgagacggagtctcgctctgtcgcctgggctggagtgcagtggtgcgatcttcgctcactgcaagctccgcctcccgggttgacgccattctcctgcctcagcctcccgagtagctgggactacaggcgcccgccaccatgcccggctaatatttcgtattttttagtagagacgggttttcatcgagttagccaggatggtcttgatctccggacctcgtgatccacccacctcggcctcccaaagtgctggaattacaggtgtgagccactgcgcccggccttaaaagcatttcttaactttttgkgtctctgatgtcctttaagaaaaatggatttgataatagaatctaccttttagagttattgtgatgaattaaatgaattcatatatgtaaaacttatagaatattgtctggcatactaatcctatataaatgttaactattactattattactatcatcaagtttttggtaactagccattttttattcatgcttgcccatgagatgagatgatctagatatagtttatctagatttataaaaatgttctgaaggggagaagtggagtggatacaaagttttatttatcccttagtttctgacwtttttaaacatggaaatattgttactgcaaaacaactaaatttcttaaacacctaccatgtgccacttgataaggcaaacattttacttagatttttgtaaattgaatcttcataatgacattttgaggtacatatgattatcatcatcttacagagaaggaaaataaagtttagagctttctaatagcttgtccaatgccacacagctagaaagtggtagagccaggtaaatcttactcaatttttgttggcactttatggaagagtatgcttcttgataacgagctctgattgaacagtcagtttcctgtgagtcagtgtctactgtcttttgcttgcttttgtgtccctatgattactcttctattattcagaattcaggctaccactatgtcttctgaacctccacagcctcagttggtatccaaggttgggccttgccaaaaatacatcaacttatggccaccatcatacatagcctggtcatttggatatttgattttgttgatgatccgaaagtcaatgaggttttgaaaccgtaagtcccaccctttattcatctcctttgttaggagacaagggtggaaagaggcttcattgcatgatcttttttactttcagatttttgaaacgtgtgctcatgttacctatttataataaatataatcaatactttagaaaattagaaaaaagtattttcagtttttagataagtaataaaaaataagtatgaagttgatctaaaggaacagatacgtaaatagttctgaattatgttacgtggtaaaaatataaggtactgaacaatgaatataatatgattccttttgtgtgaagaagggagagagagctgaagagaggggaraagggaataagggagagagggagggaaagagagagagagtgagaagctttcacttttcatttgtacttttctgtagtgaatggattttctaacgatgtacctagtcttcatttctcttacgacagcaaggttcatttggaataagcaaacacaaatatccaggctcagctatgtgactttggttaagtcacttaacctcagtgagcctcaatgacttcatctgtaaaatggggataacattacatgtgttgctaggaatatttaatgacataatatatataaagttcttggcatataataagtatttagcaaatggcaattatggtcatgttaacttctacctctaacccctgcttttttttttttttttctcacgtgctgcatgctacaaactcaattacggtagcagtggcagttgaagatctttggggttgtatacgttgatggagtgaccaggtactagacatcagcttgacaatccaggctcttaatgctagagctctgtatacactagactattgagttatggtggctgaaatctctgtctgtgcatgcatttaacaaacatttactgaaaacctactagacgcataattctaaaggacaagtagagttaacccaaaagaaaaagtacatgtaactttcttttataatttcataaatctcccctgtatctatggttgtaccttattttttcattcttaatactaaccatttttctgcacacactctttctccatcatgcttgttgcagtttatccatttgatagatatttaaaagttagttcatctttttatactggttttgttgttactgttcctattttatttctgttattaaattttatcttgatcttgttattctttaaaaaaattgctttatttttctattattttaagttgaataccttatatattgtcttactttttataaataaaagcatattaggacaattttagccacaatcaatatatttgataagaaatgatcctctttttgtgaatttcctgataatttgccattttagttttgtttacctcttagatccattggttatatggaagaatgtttttgaaataattaagccttctaaatatcactgtttaattttgggtttctaatatttctggatatgataatttgtcaaattgacttagaaattctctaaaaccatttgggatttaagatttgctttgtgtgacatgattattttttgttaatgattgatgaataaagaacatattcttgatggagtaaaaattctccctcactatgcatttgagcatgttggttgtattattaaattcttggatatatcctcactttttactccttggtctgtgagtctctgagggagctatattgtttactactgtacttatacatctggtcaacttctctttgtatttgtagtatatgcttcatgyatttgccagctttattaaaacagaaaagtatatgactgttacagcatcctcatgtatcataccattttaggtttcagttttaaaatttgctttctctaatattaatgataccacctctcctttcttattgtttgttttcacctagtatatgtttgcctaactctttgttttcaatctttcattgtctttttgttccagatgaatttcatataaacattgtatagctgagctttttttaaaaccaaatttaatgcttttgccctctggcaggggaattcagtccttcacacttattatgtaattggtttaatccttttcacttgatgtaatgtttataatttatcatacttgctttttcttttcctttccttcttttttctgtcttgatctgatttctttttaattatttttctctcctcattacttgggggttctgttttgctttgcaattttctaatgtttattgtctcatgtctaagaattaacattaaaactacaattgtatataataattaaattataatcctgtagcacccacccaggatgttttacttgtctcattcctgctcacatgcttaacttaagacctttggtttagtgttggtaaatttagcaaacaaaagtacaatatgcttagctaaatttaaatttaagataaataacaaatagatttcagtataatcatcctcatgcaattattgggacatacttatattaaaaattactctctattcatttgaaattcaaatttaacttgatttcctgtattttatctggaaaccctamctttatgcccttttatgtctccactctccaactcttggttttgcagagttgatgtatactgttaagtttcagtgtattactgaaacaatatctatttttttattgattatttactagaacaaaatatttgctagtttagtatatatacataatatctctgaactccaatttatatttaatttcagcagagtttattccttttatccctactcattgtttggaactttcttatactggtatattcctgacttcttaccttcaaagtagacatcttatacctccttagcttcatattttgcctcatgggggactrcactgtgtaattcactgaaagtgtctcaaaaaatgattaatgtacataggagtctttcaggaaatacttgttgaatgaattgtttagtgaataaatggctgcwgactaaagtattgtattttgcaggtgaaatgtatagatgttgttcaggcttatatcaacagaatcaaggacgtgaacccaatgatcaatggaattgtcaagtacaggtgagcatttccactctctcaaggagtcatttatggtggtttttgttctacttctgtggtcatgccaccttagcatatttcctagattcttctttctctttgtccttcccttgttctcactgggaacttctctgacttctaatttcagtattttgtcctttgttgagtgtttatgattatttgtctgcatcctcctcctattaactgcaagatccttgatggcaaggactaaattttgttgtttttgcatatccaacatccagaacaaggtctacagtttggtaggcatcattgaacatttactgaatagattaatatttggcagtgactctaataggagaacccccctacacatgcacacttttttgaatgtgtatttagcatagtagatagtattttatataggtatcatatacgttacttctgtgtctctattgctaagtaaacacttctcagcagctctgaggtattagagggccaaaaacytggattattttctttgtaatattctgtttaatgggtagtacagttcttcttagcacaccatgacatagggtgccatcgtgtagctctcagccattcatgtaccatctttaggatttttgtcttgtttgcacgtcagctttgttgttgttaatatacttattaaaattgagtcacttattctaacttaatcattttaaaatgaaactttatatcactacacatattgaaaacctatcatttaacatggatggttaatataaataaaatgaaaactagccaatatcatgaaattatagacatttaaaatattttaatgaaatataagtactgcatcaaatggatttgtatcataatagatactttatacatgttttctcatttgatcatctcaacagcatttcaaaaaatgtatgtgacaaccatgattcaagaatatggatatgtgatgccaagcttacataacagaactatggggtggttctatgtttcaggaggtcctgacttgtctctttcttctgtgaaccaacttttacctgaaatgtaatttgggggtacttttggggcagagtgtatctttaaacatttgagagagattctattatttaaattttctgttgccttttaaaaaggagtttcgaagaagggggtcagttgttgcagagcttgtttttgtgtatgaggacatagataaagacctgagagaaaatcaaaattttgaccttgttgaaaataatgagtttgggctactactaggagactggagagggtgcttgtgggtaaatggggggagcatggcagggcagtgactgtcaggggattggagatttgaagagagagaaaacaggactgtttctaagacagagaccttaggtaaaataaaaagatgctcagaaataattttatgaagttcatgcatgctatgtgtgacatctgtgcttttttcctccctcctgtaaagggcccccaaatgggcttactgtcctgataacagtgtttttattttactagaaatttaaaacactggcattaagatgaaaaatatgtgtaaagcacctagtatagaaccttccatcaatccctcagtgttagctcttttattgttatggttgttattacaacatgagctcaataaatggagctgtccttatgattacacacagttctattgcattgttatccctgtttgcttggcactaaaacttactctcaaggcagttcaatgattaaaatcacacagctacaaaatagtaggaagatatgtgaactttaattatgctggcttctagctttgtctttctttggcttccagctttgtgtttgtgattgactgatgagaaaatagtcactgcttttttacctccttcccaaacctgttcttccatccagtcacacaagcaagatacctaggtgtacccctagactctaccttcttccttcttttcccaaatctatcttctaactctaattaatcaacaagttttactggctcttcttctttatttatcatcatgtcaaacttgttttccttcatatcctattctaatcgtacggaactactctatttctcctgatccatttatgctctctatcatctgcataactttgcacatgttattacttttgcctggaacactttccctttccccacctctcctttatttggcttagttaattttttaggactcagtccagttctcaattttacattatctaatcatctcagtctctgtgagatttctactctgagctcccagagcacattgtgctcatgtcacttttgtatcatgaagggcccagaaaccacactattttaacaaagaatttaatatagggaattggtagaatagatgtttaaggaatgaaaaaacaaaaaaaaagtaacactgaagtaacaccaagatgataactgcaggaaacagcaaactgagggaacaccctaggtatgagggaacaaagggaagaaattgggattatcagaatctaggagctcaaaggaaatgcctgcagagctgggaccaagacatctgtgaagagggtgttgcctggctgctgcttctacctcagaaactttgaaaggggacctcatattcagagctgtggttcagaattctgagaagcagctgccagctgactggtgccagtatttctgagggtgtgtgatgagactagttctagagtgtgggaagaaataggaaactggaatcaactactgttgcctggatgaaaggctattgytgaaacaatggtgtcaggaacagcaggcaaactggaagaaacaaaccccttcacctcttttctttcctcctagtctttctctggcacccatatttgaaggatccaagagggcacaaattatcaaaggaaagtttagttttctgagtcccatcagaaagtggcatatagagggggtggagccaagatggccgaataggaacaactccagtctacagttcccagcgtaagcgacgcagaagatgggtgatttctgcatttccaacggaggtactgggttcatctcactggggagtgctggacagtkggtgcaggacagtgggtgcagtgcaccgtgcatgagcagcagcagggcgaggcatcacctcacccaggaagtgcaagggatcagggaattccctttcctagtcaaagaaaggggtgacagatggcacctggaaaatcgggtcactcccaccctaatactgtgcttttccaacgagcttaacaaaggacacaccaggagattatatcccgcacttggatcagagggtcctacgcccacggagcctcactcattgctaggacagcagtctgagatcaaactgcaaggcagcagcgaggctgggggaggggcgcctttgctcaggcttgagtaggtaaacaaagtggccaggaagctcaaactgggtggagcccaccacagctcaaggaggcctgcctgcctctgtgggctccacctctgggggcaggacacagacaaacaaaagacagcaataacctctgcagacttaaatgtccctgtctgacagatttgaagagagtagtggttctcccagcacgcagcttgagatctgagaacaggcagactgcctcctcaagtgggtccctgacccccgagtaccctaactgggaggcacccctcagtagggccagactgacacctcacattgcccagtactcctctgagacaaaacatccagaggaacgatcaggcagcagcatttgtggttcaccaatatctgctgttctgcagccaccactgctgatacccaggcaaacagggtctgcagtggacctccagtaaactccaacagacctgcagctgagggtcctgactgttacaaggaaaactaacaaacagaaaggacatccacaccaaaaatccatctgtacgtcaccatcatcaaagaccaaaggtagataaaaccacaaagttggggaaaaaaacagagcggaaaaaccagaaactctaaaaatcagagcaccactcctcttccaaaggaatgcagctactaatcagcaatgcaacaaagctggatggagaatgactttcacgagttcagagaagaaggcttcagatgatcaaactactgcaagctaaaggaggaagtttgaacccatgacaaagaagttaaaaaaacttgaaaaaagattagatgaatggctaactacaataatcaaggcagagaagtccttaaaggacctgatggagccgaaaaccacagcaccagaactacatgatgaatgcacaagcctcaatagctgatttgatcaagtggaagaaagggtaccagtgatggaagatcaaatgaatgaaatgaagtgagaagagaagtttagagaaaaaggaataaaaagaaatgaaccagcatccaagaaatatgggactatgtgaaaacaccaaatctatgtctgattggtgtacctgaaagtcacggggagaatggaaccaagttggaaaacactctgcaggatattatttaggagaaattccccaatctagcaaggcaggccatcattcagatccaggaaatacagagaacagaacaaaaataaccctcaagaagagcaactccaagacaaataattgtcagattcaccaaagttgaaatgaaggaaaaaatgttaagggcagccagagagaaaggttgagttacccaaaaagggaagcccatcagactaacagctgatctctcggcagaaactctacaagccagaagagagtgggggccaatattcaacattcttaaagaaaataactttcaacccagcatttcatatacagccaaactaagcttcataagtgcaggagaaataaaatcctttacagacaagcaaatgctgagagattttgttaccaccaggcctgccctgaaagagctcctgaaggaagcactaaacatggaaaggaacaaccgataccagccactgcaaaaacctgccaaattgtaaagaccatcaaggctagggagaaactgcatcaactaatgagcaaaataaccagctaagatcataatgacagaatcaaattcacacataaaaatattaaccttaaatgtaaatggactaaatgctccaattaaaagacacagattggcaaattggaaaaggagacaagacccatcagtgtgctgtattcagcaaacccatctcacatgcagagacacacataggctcaaaataaagggatggaggaagatctaccaagcaaatggaaaacaaaaaaaggcaggggttgcaatcctagtctccgatacaacagactttaaaccaacaaagatcaaaagagacaaagaaggccgttacataatagtaaagggatcaattcaacaagaagagctaactatcctaaatatatatgcacccaatacaggagcacccagattcataaagcaagtccttagtgacctacaaagagacttagactcccacacaataataatgggagactttaacaccccactgtcaacattagacagatcaacgagacagaaagttaacaaggatatccaggaattgaactcagctctgcaccaagcggacctaatagacacctacagaactctccaccccaaatcaacagaatatacattcttctcagcaccacattgcacttattccaaaattcaccacatagttggaagcaaagcactcctcagcaaatggaaaagaacagaaattataataaactgtctctcagaccacagtgcaatcaaactagaactcaggattaagaaactcactcaaaacccctcaactacatggaaactgaacaacccgctcctgaatgactactgggtacataacgaaatgaaggcagaaataaagatgttctttgaaaccaatgagaacaaagacacaacataccaggatctctgggacacattcaaagcagtgtgtagagggaaatttatagcactaaatgcccacaagagaaagcaggaaagatctaaaattgacaccctaacatcacaattaaaagaactacagaagcaagagcaaacacatttaaaagctagcagaaggcaagaaataactaagatcagaacagaactgaaggaaatagagacacaaaaaacccttcaaaaaaatcaatgaatccaggagctggttttttgaaaagatcaacaaaattgatagaccactagccagactaataaagaagaaaaaagagaataatcaattagacgcaataaaaaatgacaaagggcatgtcaccactgatcccacagaaatacaaactaccatcagactactataaacacctgtatgcaaataaactagaaaatctagaagaaacggataaattcctcgacacctacactgtcccaagactaaaccaggaagaagttcaatctctgaatagaccaataatgggctctgaaattgaggcaataattaatagcctaccaaccaaaaaaagtccaggaccagatggattcacagcagaattctaccagaggtacaaggaggagctggtaccattccttctgaaactattccaatcaatagaaaaatagggaatcctccctaactcattttatgaggccagcatcatcctgctaccaaagcctgacagagacacaacaaaaaaaagagaattttagaccaatatccttgatgaacattgatgcaaaaatcctcaataaaatgctggcaaaccgaatccagcaacacatgaaaaaacttatccaccatgatcaagtggggttcatccctgggatgcaaggctggttcaacatcggaaaacgaataaagttaattcagcatataaacagaaccaaagacaaaaaccacatgattatctcaatagatgcagaaaaggcctttgacaaaattcaacaacacttcatgctaaaaactctcaataaattaggtattgatgggatgtatctcaaaataataagagctatctatgacraacccacagccaatatcatactgaatggacaaaaactggaagcattccctttgaaaactggcacaagacagggatgccctctctcaccactcctattcaacataktgttggaagttctgtccagggacatcagacaagagaaggaaataaaggacattcaattaggaaaagaggaagtcaaattgtccctgtttgcagatgacatgattgtatatctagaaaaccccatcgtctcagcccaaaatctccttaagctaatatgcaacttcagcaaagtctcaggatacaaaatcaatgtacaaaaatcacaagcattcttatacaccaataacagacaaacagagagccaaatcataagtgaactcccattcacaattgcttcaaagagaataaaatacctaggagtccaacttacaagggatgtgaaggacctcttcaaggagaactacaaaccactgctcaatgaaataaaagaggatacaaacaaatggaagaaaattccatgctcatgggtaggaagaatcaatatcatgaaaatggccatactgcccaaggtaatttatagattcaatgccatccccattaagctacaaatgactttcttcacagaattggaaaaaactactttaaagttcatatagaaccaaaaaagagcccgcattgccawgtcaatcctaagccaaaagaacaaagctggaggcatcacgctacctgacttcaaactatactacaaggctacagtaatcaaaacagtatggtactggtaccaaaacagacatatagaccaatggaacaaaacagagccctcagaaamaatgccgcatatctacaactatctgatctttgacaaacctgacaaaaacaagcaatgcggaaaggattccctatttaataaatggttctgtgaaaaccggctagctatatatgtagaaagctgaaattggatcctttccttacaccttatacaaaaattaattcaagatggattaaagacttacatgtcagacctaaaaccataaaaaccctagaagaaaacctgggcaataccattcaggacataggcatggacaaggacttcatgtctaaaacaccaaaagcaatagcaacaaaagccaaaattgacaaatgggatctaattaagctaaagagctcctgcacagcaaaagaaaccaccatcagagtgaacaggcaacctacaaaatgggagaaaattttttgcaacctactcatctgacaaagggctaatatccagaatctacagtgaactcatacaaatttacaagaaaaaaacaaacaaccccatcaaaaagtgggcaaaggatgtgaacagacacttctcaaaagaagacatttatgcagccaaaaaacacatgaaaaaatgctcatcatcactggccatcagagaaatgcaaatcaaaaccacaatgagataaccatctcacaccagttagaatggtgatcattaagaagtcaggaaacaacaggtgctggagaggatgtggagaaataggaacacttttacaatgttggtgggactgtaaactagttcaacccttgtggaagtcagtgtggtgattcctcagggatctagaactagaaataccatttgatccagccatcccattactgggtatatacccaaaggattataaatcatgctgctataaagacacatgcacacgtatgtttattgcagcactattcacaatagcaaagacttggaaccaaccgaaatgtccaaaaatgatagactggattgagaaaagttggcacatacacacaatggaatactatgcagccataaaaaaggatgacttcatttcctttgtagggacatggatgaagctggaaaccatcattctcagcaaactatcacaaggacaaaaaaccaaacaccacatgttctcactcataggtgggaattgaacaatgagaacacatggacacaggaaggggaacatcagacaccggggactgttgtggggtggggggaggggggatgggaatacattaggagatatacctaatgctaaatgacgagttaatgggtgcagcacaccaacatggcgcatgtatacatatgtaacaaacctgcacgttgtgcacatgtaccctaaaacttaaagtataataataataataataataataataaaagaaatatcttcacataaaatctaataaaaaaatgtggcatatagaatacttgtttcagggctgagagataataatataaaaactggttcaacattgcatagtcattgtggtgttggttgtctcacccaccagactctgagttcctcagtggcatggaccatatctttttaatcttattgtcttcagtgtgtagaacatgatctgagatttagcatttcttcagtaagtaacgaattaatatacatgtgtttagacaatgtttgttttggagctcctgaatgcagtttcgtcttatgctctgcaatctgttggcttcctatatcttcctggattatgatttattgttcactgtttttcttgcttgcctggaaaagtacaaatttgttactagttttagactttgctccctgaagcatctattgtcatgcatttcatccaataggtatattcttcccaatctgtgaatgacatagaaaatggtcacggcaaactttctgggagccctagagtccagagatgtcaagactcaaaatacacacttacagaatcacacagacctgggacaaaattcttcctctgttagttatttcatgaacttaggcatgtttttgaatctctgtgaatctttgttttatcctttctaaaggggaaaataatatggaccctcaaaatttatagttttatggatttaaatgcttgaaaacactttcattcatttatcccacaaatggttattgaatgcttactatacacctggtagcatgctaggtgttgaagatataaagataaacacaacagtccctgacttctttcagctcccagtctggtggttgaagcatgagaataaccattatttacagcacagtggaattagtgctctgataggggaagaaaagagtactgtggtatcatagagaaggttactgatccaagactggagaggtgtcagaaaaggctttctggagaaagtgatataatgtgttgctttccaccaaaaagctatccaaggagtagaatcctccttggatttcgctcccctaccactggctgtacttgaatcactgagcaagtgcaggatttcaagatatatagatttttttaaaaaccctctcagacctcaataaatctttcactcaacccacattggccagcctatgtatcatctggtgtcacagccacccttaggcctcatcctgtttgtctccatagaagcaagggtaaggatttttggctgaggttccttgtttcagcttggctgaaactatgaggatttccttggtctcaggagtctagtgctgccctgtgccactgaggccacatgtaagggtatccaatttcctttatgcctttatcaaccttcccttggaagttctctgcttgtgctgattgtatgtggctgaagttkgggcaatgctaatsaaggggatttcaagaccttaggaaagtgtacatacttaaggcactaccttttctccatccttggaaagaacaggactgggaagcctgattgccctgccccacctggttgggaaactcctgggagacaagtgtttcaggaaccctgtcttgcatgaacaaatattgtgccagtaaatgttgctgataacatcagtattggtaggacttgttgaagaaatagctgctgcagttcttctcattgtttttctgatatagagacttgtaacccacttcctaaatttcattttgccacttccctaagctctatggtttgggtgacatggctttggcttaatcttctgtgattctaatcctttgattttcctgacaagaattttgttgactgtcaggagaacctgatgaattagaaatgatgatagtgatagccaccatttactgagtggctcttctgtgctaggtactgtgtttatgcattatgacatttaaataacaaagcatgtagattttattgttaccaccattttatagctggagaaacagtttaggaagttgtcacttgcaaggttatataaccacctcagatcagtctttctccaaagcctgggatttgaccactctgctacactgctttttggatagccaggttctttgtgtttgtaagaggccagattgcaacattctcagattaatattttgccgtgcctaattcgctaccaaaattgtctcactttttttaacataagtaagcttctaaaaaatgtagtcaatacttatttttctgaatccttacctctaatttacacctatactcactgaaatctagcttctgttcctatgactcaattaaaaataacctgctggctgggcgcggtggctcacacctgtaatcccagcactttgagaggctgaggcgggcagattacctgaggtcaggagttcgagaccagcctggccaaaatggtgaaaccccatctctactaaaaatacaaaaattacctgggtgtggtggcacatgcctgtaatcccagctactcagggggccgaggcaggagaattgcttgagcccaggaggtggaggttgcagtgagctgagatcttgccactgcactccagcctggccgacagagagagactgtctcaaaaacaaaacaaaacaaaaaacaaaacaaacaaacaaaatagcctgctaactctatcagtttgggctgtttccactgcaaagaacagaaaatccaattcaaaatgactgaaagcaatacggaaaatatactatcccacaaaccagtaagtcttttggtatgttagctctagaattgattgactcagcagctgaaaaatgtcatcattaacctgttttcagtcttttgccttggacatcctagtttgtcagccttattagactagatcttctcattgtcataagatggctgctatgccttatgtctcaagagacaaaattgtgaccagataccactggtaaaccaatttttggcaaggtgaawaacattactgtgattgcactaaacaaataagaaatcacacacttaaggttagagattgggcctattccctgtaaggcatatggcagtacaataaagagagttgcctgaaaaattgaagttatatttataaagggaaaaagtggattttggataggcagcgaacaatgtctgcaactcttgacaatatgactttgagtgagtccttaacctctctttatctcagtttcctcataatcataatgaagcagttgttatgtacctaatgggattattgtgaggatggaacaacttaatgaatttaaaacacaataattggcacataaaatagactcagtatattgtacatgttggtcttattatcaaaatgataattgtcctgttcttgaagtcattgctacctttggcttctagacagtgctcttctattattttattatttaactcttacacatctaaatacattttattcttccttaaggtgtgattctgtaattttgtgtgtgtgtgtgtgtgtgtgtatgtgtataatggttcatgtagttataaatatacttagccttggtcttctatgacttcaaatatcatttgaacactgataactcctggaactttgtctgcagcccagacctttcctctgagctcaattcccatatatgtatatctacctacttgacacctctaccaggaagtcacatgggcaccaaaagtcaaaataattaaaatcaaactcatgaaatgaaaatttcagtgaatgacattgccaactactataagccagaaaaactggaaaaaaaaattccttcatcccccacattctaaccttctaatattttataagagttctaccttctaaatatctctctcaagatctcatctctaaataactctacttttctctacctcaactgctgtcactttagtcccaatcaccatcatctttgcctactgcagtaatctttatgtttctagttttgctctcccttccccatactttttattttgcaaaagccaaaggatatctgtaaatcactaaagagattatgcccctttcctgctttaaacatttcaatacccagactccctagaacgccatgtaagggccctttgtaatctggcataccttagtttttcagctttatcttgtgccattctcccacatataacttcctttttactccacttgggtatttttgccattcatctgaagggtcccttctagttcagtccagctttttgagttattttcacctcctaatcacagactttctccttcagctactaccccatctgatatctatctttctgagtactcttttcctcagactggttgcagactgggacactgtgcctcaaggttttctttcctaacgtttcctaaacacaaggctacaggccgttttgccttggatgaggctcacatccagagaagctttcagtaactagcagtcttaggcatgtggatgctttactgaggttccaagtttgtgcctattggaaatattggtcttaggttcccaatccttctgaattggcaactgaaagctttcttatttccagaaagtgggtaacttcaacttcacacccttctgcttctttttgtgcaaccaaagtgtgagggatgggatataagcaaagcaaaaagtgtccttttccccaagtagacagtatgtatctgcaaggcccccagaatgtgtaacacttagagtgctggcctttactctacaaatggtaatgatgctactttgtaactagctatagacacacagaaatgtctatagtttctaaatggctgtgctgacaattattcttttcattgcaatagaattgtacttttactggcttatgggtgtgaaaaggtagtggtgtggccaataatcataaagatcctcacaatttgacaaattatgagacatttgaacaactagaccctgggaagttcagggactgatgtagctctggactctcaaacgtaggasatttgtgggccttcatttaagagccctgccattaatgtgttctaaccaaccccagtccttctttcttttagttgaacctctagggaaagagataattttatttgtttcacttggctcaagtgttcagtacaacgagactagcaacatcttgtgtgtgtgtgtgtgtgtgtgtgtgtgtgtgtgtgtgtgtatatatatacacacacactatatgtatacactatatatataccatatatatgtatactatatatacactttatatacaccatatatacactatatatatactatatatgtactatatatgtgtatatatatacacactatatatacactatatatacaccatatatacatatatagtactatatagtatatatagtgtgtatatatactatatagtactatatatgtatatatacacacacgtatacacacacacacacacagatacatatatatatatatatatagcctttgtcctctgagtaccgctggcccaccaatagggttatatgcatgacaacagggtttttacccctatcgttgggccagtagtactcagagaacaaaggctagacaaataaccaaataagttttcattagaatgagccatgttttctcatcccttcatctttctattctctctgtttggggttcttcttctctataataagaagcattagtagtatcagtgatagttagcacttgtgtgcttacaatgttcccggtactgttgtagtgctttacaaatgcagtagctaattgcataatatcaacaattctatgaggtaattatttttagctccattatacagatgaggaaactgaaatacagaaaggttaagttaagttttcgaaggagatacagtaaatagtggagctgagatacaaaactatgcattctctctctagattaatattgttcaatagaaataaattatgagggaaatgtgcaatttcacatattctagcagctgtattttaaaaagtgaaaagaaacaggtggaattaattttcatagtacatattatttaactaaatatgtcaaaatactttcaacatattgcattagccacattttaaaaatataatatcaacttttatcttaaattcaaggggcacatgtgcaggtttgttatatgaatatattgtgtgatactgaggtttgggatgcaaatgatcccatcacccagatagtgagtatagtatccaacagtttttcaaaactttccctcgctcacacacttccgcatctgttagtccccagtgtctattgttgctatctttatggccgtgagcatccagtatttagctcccactgagaaatgagaacaatgtgatatttggtttttgtgcctgtgttaattaggttaggataatgacctctgggtgcatccatgttgctgcaaaggacatgatttcattctttctgtggctgtgtagtattccatgatgcatatacaccaaattttctttatccaatccaccattgatgggcatctagattgattccatgtctttgcgattgtgatagcatagtgatgaacatacaaatgcaagtgtctttttggtaaaactatttattttcttttgggtatatacccagtaatgtgattgctgggtcaaatggtagttttgttttaagttatttgagaaatctccaaactgctttccactatggctgaactaatttacattcccatcaacattcccttttctctgcagcttcaccggtatctgttgtttttttacttttaataatagccattctgactggtgtgagaggatatctaattgtggtttttatttgcatttctctgatgattagtgatgatgagcattttttcatatatttcttggctgcttgtctatcttctttggagaagtgtccattcacatcttttgcccacttttaagtggggttatttattttttgcttgtttaattgttgaagttccttatagattctggatattagatctctgttggatgcatagtttgtaaatattttctcctattctgtaggttgtttattacatcacatgagtgtcaggattaactgactgtacaatatttaaagtactgcccaatacctgaaatatatcattaattgttaaatatcattatatcattatcctggcatactctgtaactcctgtctcctccatttctagcatattgtcatatacacatggcagtaaaaaatcctcctttttagaaacttccaacagttctttatatccattttcccaatgcattctcactaccaccatgttagatagatattattgtccccaatttacaattgaagcaactaaaatccagtgaaatgaaagagcttgcatagttcacaaaactaggaaatgagagttccctaatttttattcatcttaaaagcatagacattatcatattcattttttaatactttgaatatttgttgaagtaatcaataaatgtcattggtatttccagtgagcccaaagatattttattaaagttattttaagtcacatgaaaggttatgtaaaggattttaaatttcattttcaagaattaatatttgtgatactgagaaatcacactggaattgcatactttagtgattgtattaccacatacatttaaactgtgttcttttgggcatattgacttattgtttcattctggaaattgctgtaattatgtccattatagaacatttgcaaaaaacaacaaaaaattacctataatcatagcaccaaaagagtagttattcactgttaatgttttgcttacgattttcacatgattgaggttatactaggaatatactgctataaccttctcttttcacttacattaaatgacattacatcataggaatttccgaagtgcagtaaaacttttaggaaacaccactttttattttattttattttaagtactggggtacatatgcaggatgtgcaggtttgttacaaggtaaacgtgtaccatgatggttttctgcacctatcaatccatcacctaagtgttgagtccagcatgcattagctattttatctgatgctctttccacccctgagaggccccagtgtgtgttgtttccctccctgtgtccatgagtcctcatttttcagctcccacttatgagtgggaacatataatgtttggttttctattcctgcattagtttgctgaggataatggcttccagctccatccatgtccctgaaaagaatatgatctcatttctttttgatgtaccacattttctttatccagtctaccattgatgagaatttgggtggattccatgtgtttactattgtaaatagtggcgcaatgaacatatgtgtgcatgtatctttataataaaatgatttatattcttttgggtatatatccaataatgggattgctggatcaaatggaatttctggttctaggtctttgaagaattgtcacaccgtttttcacaatggttgaactaatttacattctcaccaacagcgtaaaagcattcctttacctctgtagcctcggcagcatctgttgtttcttgatttttaacaattgccattctgactggtgagagatggtatctcatttaggtttttatttgcatttctctaatgatcagtgatgttgagctttttttcatgtttgttggctgcataaatgacttcttttgagaagtgtctgtttatggcctttacgcaacaccacgtttattggccatacagttgtctcttgtagatatctataattatttatttggtgacaaggagattttatttgtttttctaatataaataatgatgcactgaccagctttctgtatggataattcttactaggttggattactgttcttatgatggattcctaaaaggagaatcactggctcaaatggtcagctttataaggctcttgacaagtacattaactttaatatgttgattacatattaacatgttgatatgggtattcttttaataaagttggttggatgacttgtttagttaaagtttgcattgttttatttcttcttaggtttgaggaagcgatgaaggaggctcatgctgtagatcaaaagcttgcagagaagcaggaagatgaagccaccctggaaaataaatggcccttccttggggttcctttgacagtcaaggaagctttccagctacaaggtactattcttttatttttggctacatgagtttaattcacaagttgctacattttctaaacttataaactaaaaaggatggtataaaagtgaaggacaaactcatgctgcttcctcagtttgaaatgagaggaaatattcagcaagttccattgggaaaataaatgataatggtcatcctctgttagctctgtatggcatatgggggcactatgctcagtatccattaatccttacagcaaacttataagaatagtattattgatctcatttttcagataagaaaattgaggctcatgaccctaaagtagttaggctaaagccaagcttgaattctgataaatacctgtgctttctctgtaatacagttcttattttgtaacttcctgctagcctcaaaagtaaatgaaaatcccaaatatttggaaagtaaacaacgtatttttaaataacccataagtcaaagaaataaatcacaaggaaatgtttgaactgaaagaaaaaatataataatataacaaaacttatgggatgtagctaaattagtacttagagggaaatgtatggctttcagtgaatatacatgaaaagaaagatttaaaatcagtaactgaagcctggccttaaatggctcctgcgaaaggggtcagtgagggaactgaggcctcaccttcaccaggaatctttgggatcctagctataggggaacccttgtcgcccgtgggtgtatgagctggcaggaagatctgatggagagcaggcagagatgggccttcagagggcttggagcctggaagcttttggtgctctgggcagctccagctgagagtagccataggcaccaatccccaagtcttcccattcctccraggaggtgcaggccgggatgacctctgacccaggagagagcagagccagcttcttcatgggactgaggtgcatctgctctgcaagctttcctgcctttcagctactcccagcatccatgcctagctactctgcaggagcaggtgcacataacagcccctgcagcccaacctcagtgtattgatgcacgtgagtactttcctagctagcctggagcatattggatcccctagcacaggcagaactgagtcccagctaagagacagtcaggtgcacccagggctacagcgtgctacttgagagtaaggagcagagatctgtggacagtaatgaagctggggaggagctcccaaccccagaacactgagaagggagagatgcatgggtttctgrgcaaggtgagatggggcatgcctccctccacagggtgggtccatagagtgtggcatatctctgctgcagcccctgcccaagagggctggtggtacagaatagctaataaaagaaatgccagcacagcaccattgatcacagggggctctcccaaatcccaggagcagatctggtgagggaggtgctgtctctttctgctctcccaactcaagagcatgcctgcatactaagggaaatacagaagagctgcacagcttggtattaaactagctaccggccattactcttatgcttcatctactggattgcagcccaaactacaacatcaatcaatcatccggctaatatgtgcacctgtgaaaccaagtgcaagaattcaaacacacataaagatcctatagaggccaggcacagtggcttatgcctgtaatcccagcactttgggaggccgaggcaggtggatcacctgaagtcaggagtttgagaccagcctggccaacatgatgaaaccacatctctactaaaaatacaagaaaaaaaaattagctgggcatggtggcgggcatctgtagtcccagctacttgggaggctgaggtaggagaatcgcttgaacctaggaggtggaagttgcagtaatccgtgccattgcactccagcctgggcaacaagcacaaaactccatcaaaaaaaaaaaaatcctatacagaacactagccttctgaaaggatccacaaatatagccaactaactatactgaacttacaccacagttacagaaataccaatcctcaaatattagaataaatcagtgcaagaactctggaaatccaaaaagtagagtatctttattgacctcaaaacaagtccaatagctccccagaaatggtttttgaccagtctgaaatgactgagatgacacagtcttcagaatctgggtgtcaatgaaacttactgagattcaggagaaagttgaaatccaatccaaggaatgcaaagcatccagtaaaatgatccaagagatgggagaaaaaatgggcattttaggaaacaacaaaacagagcttctagaaattaaagactcactatgagaatttcataatacaattagaagtattaacagcagagtagaccaagctgaggaaagaatccaatcccagagcttgaataccgttttttcaaatcaccttagtcagacaaaaataaagaaaaaagaaattagaaaatgaatgaaacctccaagaaatgtggaatgatataagaaaaccaaacctatgactcatcaggattctcaagagagaaggagagagaataatcaacttggaaaatatatttgaggtgaagaggttgacaccagtctcggtgaagaggttgacatgcaaatcaaagtggtacagataatggtggccacatactatataagatgaccatccccaaggaacatagtaatcagattcaccaaggtcaatacaaaaataaataaataaataaataaatacatcttaaaggcagctagagagaagggttaagtcacatacagagagtactccatcaggcaagcagtagatctctcagcagaaaccttaacaatgagaagatattgggggtctactttcagcatccctaaagacaagaaattccaaccaagaatttcatttcctcgcaaataagcttcataaatgaaggagaaataaaattcttctcagacaagaaaattctgagagaatatttttcaactagaccaaccttacatgaggcccttaaggaagtgctaaacatgagttcaaaagaatgacaccggctgtcacagagacactcaagctgatagcttgcatgcactataaaacaactatgcagtcaagtctatataacaaacagctaatagcatgacttgaataaaatcacacatatttgaatgtaaatgaactaaatgtcccaattaaaatacagggtgtcaggctggatgaaaaaacaagacccaaccatctgttttctctaagaggcccatctcacatgtaatgacacccacatgctcaaagtgaaaggatgtaggaagatctatcatgcaaacaggaaacaaaaaagagcaggagttgctattctttttatcagataaaacagatcttaaaccaacaacaatcaggaaatacaaagaagggcattatataatgataaatgttttaattcaatgagaagactgaaccatcttaaatatgtatgcacccaacattggagcactcagattcacagaaaaaatcttcatgacctgagaaaaatcttagacagccacacaataatagtaggagatttcaaaaccccactgacagtgttagacagatcatcgaggcagaaaactaacaaaagaaactcagggcttcacctcaacacttgagcaattgcgcttaatagacatctacaaaatactccacccaaaaaccatggaatatacattcaactcatctgtacatggagcatactctacacggtcagtcatacttcaagtctcaataaattaaaatattgaatcttaccatgcacactcttggaccagagtgaaataaaaatagaaatcaatatcaatatctcccaaaactacacaaatacatggaaactaaacaactttctcatgaaaaactcctagatggacattgaaattaaggcataaatcaaaaaaagtgattaataactcttaggtgaacatcaaaattaaggcagaaatacaaaaaaacaaaaaaaatctctaaaattaatgaaaatagtgacacatcttaccaaagtcattaaggcgccactcaagcattgttaccaggaaagtttatagaactaaatccttcttcaagaagttggaaagatctcaaattaacaatataacataacgccaatgtgaactacgataataagaaaaaatcaattccaaagccagcagaagaaaagaaataactaaaattagagaacttagtaaaatatagatgcaaaaatctatacaaaagatcaatgaaattaagagtttgtttttcaaaaataagttagactgctacctagattaaaaaagaaagagaagattcaagtaagtacaatcagaaatgacaaacataacattacaacttatttcatggaaatacgaaagattgtcacaatcaattcaatgcacacaaattaaaaaatatatagaaaatgtaaatattcctggaaacacaccttcttccaagattgaatcaggaagagagtgaaaccttgaacagcccaatattgagctgtgagatggaatcggtaataagaaacctaccaatcaaaaagtgtcctggactagatggattcacagccaaattctaccagacatacaaaaaagagatgctaccaatactactgaaactattctaaaaaatggaggaggagggactcctctctaactcattctatataaagctatcatcaccctaatacaaaaatctggcagagacacaacagaaaacaaaaacttcagaccaatatccctgattaacataaactcaaaaatcctcaataaaattctagcaaaccaaatccagcaacacaacaaaaagttaactcattatgatcaagtagggattattcctgggatgcaagattggatcaacatatgcaaatcatttaatgtgattcaccacgtaaatgattaaaagtaaaaaccatgtgatcatctcaatagatgcagaaaaataacttttgatataattcaacaccccttctttatactaactcccaacagactaggcatcgaaggaacatacctcaaaataataagagtcatctataccaaacacacaggcaatgtcacactaaatgggcaaaagctggaagcattcttcctgagatctgaaacaaggaaagagtgcccactctcactactcctatttgacatagtactggaaatcctagccagagcagtcaggcaagagaaagaaaaggcatccaaataggaaaagaagtcaaactgtctctctgttgatgatatgatcttatgcttagaaaatcctaaagactccatcaaaatcctactaaaactgataaacaattttagcaaggtttcagaatacaaaatcaatgtagtaaatcggtagtataatgatgtcctggttgagattcacacaatcccatttacaatagtcagaaataaaatggaatacctaggaatacagctaaacaaggaggtgaaagatctctacgagaactgcagaacactgccgaaagaaaccagaaatggtataaataaatgtaaaaacatttcatgttcttggattggaaaaatcagtattgatgaaatcgccatacatccaaaaacagtttacagatttaacgctattcctaccaaactaccaaagacatttttcaaagaattggaaaaaacctattttaaaattcatatggaatctaaaaagagcctgaatagccaaarcaatcctaagcaaatagaagcagagatatcacactaccccacttaaaactatattataaagctacagtcaccaaaacagcatggtgctggtacataaacagacacatagaccaatggaacagaacagaaaactcagaaataaagtcacacacatacaaccatctgatctttgtcaaggccaacaaaaataagcaatgggggaaggactccctattcaatacatggtgctgggataactcactagccatgtacagaagactgaatctacactcttatctttcaccataggcaaaaactaactcaaaatagataaatatttaaatgtaagacgtcaaactctaaaaaagttgagatgaaaacctaagaaatacccttctctatattgaccctgtctccccccaccgcctccaaaaaaacatggtcaactccctaaagctattgcaactaaatgaaaaatttacaagtgggacttaattaaactaaagaccttctgcacagcaaaataaaccatcaacagaataaacaggcaacctacagattgggaggaaatattcataaactatgcatgcaataaaggtctaatatccagaatctataaggaacttaagcaaatcaacaactaataaacaaataacccattaaaaagtgagcaagagacatgatcagacattactcaaaagaagacagacaagtggccaacaaatatttgaaaaatgctctcaggatcaagttcacaaataacaatattagccttaaatgtaaacgggctaagtgccccaattaaaagacacagactggcaaattaaataaagagccaagacccattagtctgctgtattcaggagatccattgcacatgcaaagacacacataggctcaaaataaaaggatggaggaatatttatcaagcaaatgtaaagcgaaaaagagcaggagttgcaatcctagtctctaataaaacagactttaagccaacaaagatgaaaaaagacaaagaagggcattacataatcataaagggactttgtaccaagaagagttaactatcctaaatatatatgtacccagtacgggagcacccagattcataaagcaagtttttagagacaaacaaagagacttagagtcctacaccataatagtgggagactttaacaccccactgtcactattagacagatcaacaagacagaaaattaacaagaatatttaggacttgaactcagctctggaccaagtagacctaatagacatctacagaactctccaccccaaatcaacagaatacacattcttctcagcatcacattgcacttattctaaaattgaccaaatatttggaagtaaaacactccttagcaaatgcaaaataatggaaaatataaccaacagtctctcagaccacagtgcaatcaaattacaactaaggattaagaaactcactcaaaacggcacaactacatggaaactgaacaatctgctcctgaatgactactgggtaaagaaattaaggcagaaataaacatgttatttgaaaccagtgagaaaaaagacacaatgtactgggatctctgagacacagctaaagcagtgtttagagggaaatttatagcactaaatgcccaaaggagaaagtaggaaagatctaaaattgacaccctaacatcacaattaaaagaactagagaagcaagagcaaacaaattcaaaagctagcagaagacatgaaataactaagatcagagcagaactaaaggagatagagacacacaacaaacccttcaaaaaaaataaatgaatccaggagctggttttttgaaaagattaacaaatagatatactgctagccagactaataaagaagaaaagagagaagaatcaaatagacacaataaaaaatggtaaaggggatatcactactgatcccacagaaatacaaactaccatcagagaatacttataaacacctttacgcaaataaactagaaagtgtagaaaaaatggaaaaattcctggacagataaatcctcccaagtctaaagcaaaccaggaagaagtcaagtacctgaataggccaagaataagttctgaaattgaggcagtaattaatagcctaccaataaaaaaatcccagaactagatggattcacagccaaattctaccagaggtacaaagaggagctggtaacatttcttctgaaactattccaaacaatagaaaaagagtaactcctccctaatccattttatggggccagcatcgtcctgataacaaaccctggcagagacamaacaaaaaaagaaaatttcaagccaatatccttgatgaacatctatgcaaaaatcctcaataaatactggcaaactgaatccagcagtacatcagaaagttcatctaccactatcaagtcagcttcatccttgggatacaaggctgattcatcatatgcaaatcaataaacataatccatcacttaaacagaaccaatgacaaaaaccacatgattatctcaatagatgcagaaaaggccctccataaaattcaacaccctttcatgctaaaaactctcaataaagtaggtattaatggaacatatctcaaaataataagagctatttatgasaaacccacagccaatatcatactaaatgggcaaaaactggaagcattccctttgaaaactggcacaagacaaggatgccctctctcaccactcctattcaacatagtattggaagttctggccagggcaatcaggcaagagaaagaaataaagcatattcaaataggaagagaggaagtcaagttgtctctttttgtagatgacatgattgtatgcttagaaaaccccatcgtctcagcccaaaatctccttaagctgataagcaacttcagcaaagtctcaggatacaaaatcaatgtgcaaaaatcacaagcattcctgtacaccaatagtagacaaaaagagagccaaatcatgagtgaactcccattcacaattgctacaaagagaataaaatacataggaatacaacttacaagggatgtgaaggacctcttcaaggagaactacaaaccactgctcaaggaagtaagagaggacacaaacaaatggaaaaacatttcatgctcatgggtagaaagaatcaatattgtgaaaatggccatactgcccaagtaatttatagattcaatgctatccccattgaactgcaattgacttttttcacagaattgggaaaaactactttaaatttcatatggaaccaaaaaagagctccgatagccaagacaatcttaagctaaatgaccaaagctggaggcatcatgttaccttactgcaaagtatactacaaggctacagtaaacaaaacagcatagtagtggaaccaaaacagagatatagaccaatggaacagaacagaggcctcagaaataatgccacacatctgcagcaatctgatctttgacaaacctggcaaaaacaagcaatggggaaaggattccctatttaatggtgctgggagaaatgactagccatatgcagaaaactgaaactggacctctttcttacaccttatacaaaaattaactcaagatggattaaagacttaaacttaagacttaaaaccataaaaaccctagaaggaaacctaggcaataccattcaggacataggcatgggtaaataattcatgactaaaacatcaaagaaaaaatggcaacaaaagccaacattgacaaatgggatctaattaaactaaagagcttctgaacagcaaaagaaactatcatcatagtgaacaggcaacctatagaatgggagaayatttttgtgatctatccatctgacaaagggtaatatccagaatctacaagaaacttaaacaaatttacaagaaaaagacaaacatccccatcaaaaagtgggtgaaggatatgaatagacacttctcaaaagaagacatttatgtggccaacaaacatatgaaaaaaagctcatcatccctggtcattagagaaatgcaaatcaaaaccacaatgagataccatcacatgctagttagaatggtgatcattaaaaagtcaggaagcaacagatgctggagaggatgtggagaaataaaaatgcttttacattgttggtgggagtgtaaattagttcaatcattgttgaagacaatatggtgattcctcaaggatctagaactagaaataccatttgatccatcaatcccattactgggtatacacccaaaagattatatatcattctactataaagcaacatgcacatgtatatttatttgtggcactgttcataaaagcaaagacttggaaccaacccaaatgccaatcagtgatggactggataaaggaaatgtggcatatgtacaccatgcaatattatacagttataaaaaaagatgagttggctgggtgtggtggctcacgcctgtaatcccaccactttgggaggccaaggcaggtggatcatgaggtcggcagatcgagaccatcctggctaacatggtaaaacccccgtctctactaaaaaatacaaaaaattagctgggtgtggtggtgggcgcctgtagtcccagctactcaggaggctgaggcaggagaatggcgtgaatctaggaggcggagtttgcagtgagcccagatggtgccactgcactccagcctgggtgacagagcgagactccatctcaaaaaaaaaaaagaaaaccggatgaatgcatgtcctttgcagggacatggatgaagctggaaaccatcgttcttagcaaactaacacaaatcggaaaacactgcatgttctcactcaggagtgggagttgagtaatgagaacacatggacacagggaggggaccatcacacattagggcacattgggggttcgggatctaggggaaggatagcattaggagaaatacctaaagtagatgacgtgttgatgggtgcagcaaaccactattgcacatttatacctatgtaaaaacctgcacgttctgcatatgtatcccataacttatagtataataataattattattatactatttaaaaaaatagttttccaattgaaaactatttttcaattattttttaattaaaaaaataggtttccaattgaaacctctgcttttttctggtttccatttgcttggtagatttttctcaatttttaaaattttgagccaatggatgtcattgcatgtaatatgggtgtgttgaagacaacataacaaggagtcttgcttctttatctggcttgccactctgtgccttttaattggggtatttagcctgtttacattcaaggttagtattgatatgtatggatttgttgctgtcatcatgttgttacttggttattatgcagatttgtttgtgtttttgctttttagggtcaccagtctgtgtacttgtgtgtttctgtagtggtttgtaattacctattatttccatatttagtgcttcttccaggagctcttataaggcacatctggtggcaacaaatttgcttagcatttgcttacctgaaaaggatcttatttctcttttgtttatgaaacttagtttggctgaacatgaaactccagattgcatttttttttttttgagacggagtctcgctcagctcactgcaagctctgcctcccgggttcacgccgttctcctgcctcagcctcttgagtagctgagactacaggcatccgccaccgcgcctggctaattttttgtatttttagtagagacggggtttcaccgtggtctcgatcttctgacctcgtgatccgcgctcctcggcctcccaaagtgctgggattacaggtgtgagccaccgcacccggcctgcattttttgtttttaaagaatatttgatgtaggtccccgatctcttcttccatgtaggatttttgctgagaggtctcttgttagtttgctggacttccttttataagtgacctaccctttctctctagcctttaacttttttttctttcatttcaactgaagagaatttgactattatgtgttttggggatgaccttctcatgaagcattttgcgtgggttctaagcattttctgaattcgaatgttggcctctctgtctagtttggagaactttctcattggtgatatcctgaaatatattttctaatttgccttctttctctttttcttttctggaatgtcaatgagttctagattcggtctctttatgttattccataattcatggaagttttgttcattaaaaaattcttttttctttactcttgtttcactgttttattttaaaaagtcaatcttcaagcttcaatattcttttctcagcttgggtattctgctgctaatgcttgtgatttctttttttttttgttttgttttgttttccttttttttaattatactttaagttttagggtacaggtgcacaacatgcaggtttgttacctgtgtatacaagtgccatgttggtgtgctgcacccattaacttgtcatttaatattaggtatatcccctaatgctatccttccccactttccccaccccacaacaggccccagtgtgtgatgttccccttcctgtgtccatgtgttctcattgttcaattcccacctatgagtaagaacatgcggtgtttggttttttgtctttgcaacagtttgctgagaatgatggtttccagcttcatccatgtccctacaaaggacatgaactcatccttttttatggccacatactattccatggtgtatatgtgtcacattttcttaatccagtctatcattgttggacatttgggttggttccaagtctttgctattgtgaatagtgtcacaataaacatacgtgtgcatgtgtctttatagcagcatgatttacaatcttttgggtatatatccagtaatgggatggctgggtcaaatggtatttctagttctagatccctgaggaatcaccacacggacttccacaaaggttgaactagtttacagtcccaccaacattgtaaaagtgttcctattactccacatcctctccagcacctgttgttcctgactttttaatgattgcctttctaactggtgtgagatggttatctcattgtggttttgatttgcatttctctgatggacagtgatgataagcatttttttcatgtgtcttttggctgcataaatgtcttcttttgagaagtgtctgttcatatccttcacccacttgttgatggggttgttttttttttttttttttgtaaacttgtttgagttctttgtagattctggatattagccctttgtcagatgtgcagattgcaaaaattttctcccattttgtaggttgcctgttcactctgatggtagtttcttttgctgtgcagaagctctttagtttgattagatcccatttgtcaattttggcttttgctgccattgcttttcatgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctgcttatggctagccagttttcccagcaccatttattaaatagggaatcctttccccattgcttgtttttgtcaggtttgtcaaagatcatatgtttgtagatatgtggcattatttctgagggctctgttctgttccattggtctatatctctgttttgataccagtaccatgctgttttggttactgtagcctttagtatagtttgaagtcaggtagcatgatgcctccagctttgttcttttgacttaggattgatttggcaatgcgggctcttttttggttccacatgaactttaaagtagttttttccaattctgtgaagaaagtctttggtagcttgatgcggatggcattgaatctataaattaccttgggcagtatggccattttcacgatattgattcttcctacccatgagcatggaattttcttccatttgtttgtatccacttttatttcattgagcagtggtttgtagttctccttgaagaggtccttcacattccttgtaagttggattcctaggtattttattctctttgaagcaattgtgaatgggagttcactcatgatttggctctctgtttttctgttattggtgtataagaatgcttgtgatttttgcacattgattttatatcctgagactttgctgaagttgcttatcagcttaaggagattttgggcagagatgatggggttttctaaatatacaatcatgtgatctgcaaacagggacaatttgacttcctcttttcctaatgaataccctttatttccttctcctgcctaattgccctggccataacttccaacactatgttgaataggagtggtgagagaggacatccctgtcttgtgccagtttccaaagggaatacttccagtttttgcccattcagtatgatattggctgtgggtttgtcatagatagctcttaatattttgagatacgtcccatcaatacctaatttattgagagtttttagcatgaaggttgttgaattttgtcaaaggccttttctgcatctattgagataatcaaatggtttttgttgttggttctgtttatatgctggattgcatttattgatttgtgtatgttgaagcagccttgcatcccagggatgaagcccacttgatcatggtggataagcttttagatgtgctgctggattcagtttgccagtattttattgaggatttttgcattgatgttcatcagggatattggtctaaaattctcttttttggttgtgtctctgccaggctttggtatcaggatgatgctggcctcataaaatgagttagggaggattccctatttttctattgattggaatagtttcagaaggagtggtaccagctccttcttgtacctctggtagaattctgctgtgaatccatctggtcctgaactttttttggttggtaggctattaattattgcctcaatttcagaggctgttattagtctattcagagattgaacttcttcctggtttagtcttgggacagtgtaggtgtcgaggaatttatccgtttcttctagattttctagtttatttgcatacaggtgtttatagtagtctgatggtagtttgtatttctgtgggatcagtggtgacatgccctttgtcattttttattgcgtctaattgattattctcttttttcttctttattagtctggctagtggtctatcaattttgttgatcttttcaaaaaaccagctcctggattcattgatttttttgaagggttttttgtgtctctatttccttcagtctgttctgatcttagttatttcttgccttctgctagcttttaaatgtgtttgctcttgcttctgtagttcttttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgctagattggggaatttctcctaaataatatcctgcagagtgttttccaacttggttccattctccccgtgactttcaggtacaccaatcagacatagatttggtgttttcacatagtcccatatttcttggatgctggttcatttctttttattcctttttctctaaacttctcttctcacttcatttcattcatttgatcttccatcactggtaccctttcttccacttgatcaaatcagctattgaggcttgtgcattcatcatgtagttctggtgctgtggtttttggctccatcaggtcctttaaggacttctctgccttgattattgtagttagccattcatctaatcctttttcaagtttttttaacttctttgccatgggttcaaacttcctcctttagcttgccgtagtttgataatctgaagccttcttctctgaactcgtgaaagtcattctccatccagctttgttgcattgctgattagtagctgcattcctttggaagaggagtggtgctctgatttttagagtttctggtttttttgctctgttttttccccatctttgtggttttatctacctttggtctttgatgatgtgatgtacagatgggtttttggtgtggatgtcctttttatttgttagttttccttctaacggtcaggaccttcagctgcaggtctgttggagtttgctggaggtcccctgcagaccctgtttgcctgggtatcagcagcagaggctgcaaaacagsgaatattggtgaacagcaaatgttgctgcctgatcgttcctccggaagttttgtctcagaggagtacctggccgtgtgaggtgtcagtctgcccctacttgggggtgcctcccagttagggtactcgggggtcaggacccacttgaggaggcagtctgtccattctcagatctcaagctgcgtgctgggagaaccactatgccacttgttattttttcatgaaatttttatagtatgtttttctgctctatcaggttgattgtgttttttttctatactgactattttgtctttcagctcctgtatgtttttattgtgaattctagcttccttagattgggttttaatattttccaggatctcaatgatctttctttctatctatattctgaattctatttatctcatttcagccatctcagcctgcttaagaatgcttgcttgagaactagtgtgtttgtgtggaggaaggaaaacactctgattttttgaattgtcagagttcttgtgctggttctttcttatttttgtgggtctgttgtttcttcaacatttaaagttgttttttgggtgagagtttttcttttattctagttgataaccttgggcgatttgattatggtataaggtaggttcatttgactggcttcatttctggaacatttaaagtggccaagactcagctcagtactcctggattgcatgctctaactctgggggactggtatgaggtccccactttcttctctgacttttgaaggttaggaaccttctgggagggctgaggtcctcctggaccactagaagggacaaggtgctgccagatcactggtcataatacttcaatgggtaagtgccagccaaagaacttcatagggctctggcagcagtatctgcccttatttttatgtgccagttgcaactcccactgcagtatgtatgggtttatgctcctcagctgcagcacagtgctagcaggtaccagggtgctgacctttgtgagatcattcacagcaattggcaatattgactgcattgccttttgtgggccagtaggtggccatcatgcaggtgtttgcagttgttggttgcattgacagtatgactgggggcatagggctttctagcagcaactgtgcatacatttacactggtggcattgttatcatggaggtggggtgctctggttggcacaagtctgtgtgggccctctatgcatgttcctgtaggtggcagtggctactcagggtgagggtgggtccactttttgcatgcctagtttctgccggcagctgtttcagcactgaaagtaggtactgttgggggcagtgctgatgtgctttctgcttgccaatgatctgacaacaatggtggtgcagtggggggaagaggtagggtgcactcatgccaggagtagtggcatggcagggtgcacacaattatgtgtgctggtagagaagggaagacaaggtccacacacacacacacacacacacacaagtaccaataaagcaatgttggaggtcatcgtgggcgagtgcatgtaggcaaagtggcacaagggaggctgccgtagtggcagggtgttgcaggaagtcagggaccccaaacagaaggaccagctgaagccatggctgaagaacttggattgtgaagatttcgtggacatttattagttccccaaattaatacttttgtaatttcttatgtctgtctttactgcaatctctaaagataaattgtgaagatttcatggacacttatcacttccccaatcaatacccttatgatttcctatgcctgtctttactttaatctcttaatcctgtcatctcacaagctgaggaggatgtatgtcacctcaggaccctgtgatgattgcgttaactgcacagattgtagagcatgtgtgtttgaacaatatgaaatctgggcaccttgaaaaaagaacaagataacagcaactgttcagggaaaaagagagataaccttaaactctgaccaccggtgagccgggtggaacagagtcatatttctcttctttcaaaagcaaatgggagaaatatcactgaattctgtttctcagcaaggaacatccctgagaaagagaatgcgccccaagggtgggtctctaaaatggccccgttgggtgtggccgtcttctgtggttgaaactttagggatgaaataaatcccagtctcccatagcgctcccaggcttattaggaaaaggaaattcctgtctaataaattttgttcagactggttgctctcaaaccctgtctcctgataagatgttatcaatggcaatggtgcccgaaacttcattagcaattttaattttgccccggtcctgaggtcctgtgatcttgccctgcctccatttgccttgtgatattctattatgttgtgaagtaggtgatctttgtgacccacaccctatttgtatactccctccccttttgaacgtccctaataaaaacttgctggttttgcggcttgtggggcatcacggaacctaccgacatgtgatgtctcccccagatgcccagctttaaaatttctttcttttgtactctgttcctttatttctcaaactggctgatgcttagggaaaatagaaaagaacctatgtgactatyggggcaggttccccaataggagggtatgggctagctgggcttgtcttctgtggcaggtctgttccaggactttgcaggtcaggtgctatccacctgacaggtcaggaattgtgatgcagggccccaggaggtacttaggggctgcactgcaagcaggcaggatcagacttgggccctgggagaagccagcagaatgaggggtgctcagattggactggacctgaatcatgggcaaaaccaccctgcagatttcaggtctgacagttcccctagggcttaagtctcctgtgggagccagtctagcctaggggcatgggcaacccttgttgtgctcctccagatgttctggcatcaagtcttccaggctctgctccagcttgagttctgcccctaccacttctctgagcacctctccctgctaatccaagtgtccatggtggtcaagggtatttttccttctatgattctagaggcccatgtagaaagtgggttgctccttgactgttcaactcaccttttccccaggtgttgctgggagcaaggagcaagtcccagtgaacagtagccctgtgcagggttcccagcttcctccccattcagcccagcatctgtgtcttccctccatccaccctcaatgccttctctctgaagatctgctagcagtgtgccagtctttccaatgccccaaccctttgtgggagatgttccttctggctacatctagttggccatcttgcccctcaggagaaaacaactatttttatttaataatttttaaacattcttttctgtgactcttttaggaatgcccaattcttctggactcatgaaccgtcgtgatgccattgccaaaacagatgccactgtggtggcattactgaagggagctggtgccattcctcttggcataaccaactgtagtgagttgtgtatgtggtatgaatccagtaacaagatctatggccgatcaaacaacccatatgatttacagcatattgtaggtggaagttctggtgagttggacattttagtatggcatgaatagctatgctaacaataataattatgaattgtattaataaacatgatacagtatagcatctatgacctataagaatggatgcaaaaacccaggatatttgtgtgttgatggagaagaaatgggagtcatgtaacagccttggtcaactctgatattttgaagatagatagaggagaagtagccagcaaagggaattgagaatgaactacaagtgatgtagataggaaacatcgtaaagtgtttagagactaggaaaaaaaagtgtatagacactagaattgacaaggcttttattaagcctgaatggatgcatatgtgggttagcaaaatatgatgtttaaacttgtgggtgctaaagctacatagacatttgagacttcttttaatatatgaccttggtcacatgaagtaggtgctcattaagtcagttttctttgcttgtaagatggccatatgaaagaaatcagacttgtaaggttactgtgatgattaaaaatttaagtgtgacttcaggtttctggtctagcatatatggggtttagaagtttttactccaattcacacaataagaacaaaagctgaacaaactaaaagttaatgacaattcttaaatttatcaatatgctgaggtaacgggaaaaccactcttcccaaractgaatgaaaagacaggcagatacaaagaagtgaaacttgctagaacaaaagcctaggagcagaaaatttcaggggaaccagcacagctttagagaaacctaagctataactgatgacttgctggaggttcattgtgaaaaagtttgagaatcaaaatgtatgtggtggttgggtggggggatcttaggggccccacacaatttcaaaagttttaccttcaggagtcctactgtgttcctgagtgaagattggagagaaatcttctcttgcttcttgcacagggagggaaaaagtagccattttgaaattctgcttccaaagcatactgttcttctaacaaggaatgtcctcagagaaactattttttcagaacctaacttagtaaggttttacaagaaactaatggacttgacctaggggaaatgaaatatccaactccagtcctctctaggtttcctgtcctactgaaggggtcaaagcagaataaaattgggaagcacatgttagggtcacagagcaggggcacatgctaactaaatgactgagacctaatcatatgactataaaatacttcctctccttgtctccacacaccttatcactacacaaatagggattttctataatgggagttctatataaaccagaagaacagtacatcataggtgttatttaagaagtctctagggaaactcaaagacaacagaggaggtggaaacaatggcactagttgaaaattttacacctgacacctatggctacagcagacagtaaacacagactaacccctagccagggaaacataaaacctcacattaaaggccaaatacccccagttcttttatctcagtacatcatgtttggctttcaacaaaacaattataaggcatactaaaagacaaaatcacagtttgaaaagacaaagcaaccatcaagatttgactccaatatggaagagatattgaaattatcagactgagaattgaaaccatttgtgattaatatagtaagggctataatggaaaaactggtcaacatgcaagtacagatctgtaatgtaagaaracagatgggaacttcaagaatcaaaagcaaatgctagaaataaaaaaaaaaaatataacagaaatgaagaacatctttgatgggctcatcaatatattgtatacaaaacaggaaaccttcggtgatgtggaagatctgtcaaaaagaacttccaaaactgaaatgcaaagaggaagaaaaagattgaaaaagacagaagagactatctaataactgttggattacaaatgcatataatacacatatgtaattggaacactaggaagagaagaaagattttaagaaacagcaataaatgtttgaaaaaaactacacctagcataatatttcatccttagaaggttaaggagaaagaagaaaatatttaaagaagaaggagaaacataccttatctgtagaagagcaaagacagaattatattggtattttcttcagaagccatgcaaacaataagagatgggagtccactttgggaggccaaggcagttgggtcacttgaagttaggagcttgagaccagactggccaacatgttgaatccccatctctactaaaaatacaaaaattagccaggcctggcagcaggtgcctgtaataccagctactcaggagtctggggcaagagaattgcttgaactcgagaggtggaggttgcagtgagccgagatcatgccactgcactccagcctaggtgacagagggagattccgtctcacacacacacacacacacacacacacacaaagatgggagtcaaatatttaaaccactgaaagaaccatcaacttaaatctctgtctagcagatctattcttcaaaagtgaaaaagaaataaagatgctctgagacaaagacatattgacagaatttgttaccagtagagcaacagagcaagaaatgttaaaagatgttcttcagagagaaaaaaagaatacaaaccaaaaacctgaattaatgtaaaaaaaaaaagaaaatgattagagaaagattgaacaaaggtaaaataatgtatttttaaattattgattgctgtaacatgtaattgttcaaaataataatgccaacaatgtgttgggtgattatagcttgtctatgagtgaaatgaatgacaacattgttatatgggatgggataaaggaattgggaatgttcctttataagataactacactacttgggaggtggcagagtatcatttgaaggagacttgagttagttctaaatgtatattgcaaactcaagggcaaatattaaagtaacaaaaaagtatgcattaagtggcaagagaggagaataaatggaaacatttaaaaccagagacttagcctcccacacaattatagtgggagaacttaacaccccactgaaaatatcagacagatcattgagacagaaaattaacaaagatattcaggacctgaacttagctctggatcaagtggacctaatagatatctacagaactctccacccccaaacaatagaaaacacattcttttcatcatcacatagcacttactctaaaatttatcacataatttgaagtaaaacattcctcattaaatgcaaaagaacttaaatcataacaaacagtctctcagattacagtgaagggatgggttgcccctccacacctgtgggcgtttctcgttaggtggaatgagagacttggaaaagaaagaaagagacacagagacaaagtatagagaaagaaaaataagaaaaatgggcccaggggaccggcgttcagcataaggaggacccgtattattattgatcattatccagcgtttcccggagagggggatgtggcaggacaataggataatagtggagagaaggtcaacaggtaaacacgtgaacaaatgtctctgcatcataaacaaggtaaagaaaaaagtgctgtgcttttgatgtgcatatacataaacatctcaacgccttaaagagcagtattgctgccagcatgtcccacctccagccctaaggcagttttcccctatctcagtagatggaatatacaactgggctttacaccaagacattccattgcccagggatgagcaggagacagatgccttcctcttatctcaactgcaaagaggcgttccttcctcttttactagtcctcctcagcacagaccgtttacgggtgttgggctgggggacagtcaggtctttcccttcccacgaggccatatttcagactatcacatggggagaaaccttggacaatacctggctttcctaggcagaggtacctgcggccttctgcagtgtattgtgtctctgggtacttgagattacagagtggtgatgactcatagcaaacatgctgccttcaagcatttgtttaacaaagcacatcctgcacagcccttaatccatttaaccctgagttgacacagcacatgtttcagggagcacaaggttgggggtagggttacagatcaacatcatctcaaggcagaagaatttttcttagtgtcaggcctccgagcccaagctaagccatcatatcccctgtgacctgcaggtacacatccagatggctggttcctaccttaactaatgacattccaccacaaaagaagggaaaatagcctgttcctgccttaactgatgacattgtcttgtgaaattccttctcctggctcgttctggctcaaaagctcccccactgagtaccttgagacccccattctgcccgccagagaagaacccctctttgactgtaattttcctttacctactcaaatcctataaaatggccccacccctatctcccttcattgactctcttttcagactcagcccacctgcacccaggtgaaataaacagctttattgctcacagaaagcctgtttggtggtctcttcacacggacgcgcatgaaacttagtacagaacaaaatggagtctcttatgtctacttctttctacgcagacacagtaacaatctgatctctctttcttttccccacattacagcacaatcaaattagaactcaagattaagaaagtcatcccacaccaaaccacacaactacggggaaatcaaacaacctgctccggaatgacttttgacttttgggtaaataatgaaattaacaaagaaatcaagaagttctttgaaactaatgagaacaaagacacaatatatcagaatctctgggccacagctaaagcactgtttagagggaaatttatagcactaaatccccacatcaaaaagctagaaaggtctaaaactgacaacctaacatcacaactaaaagaagtagagaagcaagagcaaacaaatcccaaagctaggagaagacaagaaataaccaagattagagcagaactgaaggagatagagacacaaaaaatccttcaaaaatcaacgaatccaggagctattcttttgaaaaaaaaaataaataaataaaatagagcactagctagactaataaagaagaaaagagagaattaaatagacaaaatcggaatgataaggggttattaccactgaccccacagaaatacaaacaaccatcatagattactatatacacctgtatggacaaaactagaaaatttagaagaaatggaaaaaaattcctggaggcatacactttcccaagaccgaaccaagaaataattgaatctctaaatagaacaataatgagttctaaaattgaggcagtaataaatagcctaccaatcgaaaaaaaaaaaaaaaagcccaggaccagatggatttacakctgaattctaccacaggtacaaagaggagctgataccatttctactgaaattattccaaaaaattgaaaaagagggatttttttctaactcattttatgaggccagcatcatcctgataagaaaacctggcagagaaaaaataaaaatagaaaactttaggccaagattcttgatgaacatcaatgcaaaaaccctcaataaaatactggcaaacagaatttagcagcacatcaaatagcttatacaccatgaacaaattggtttcatccctacgatgcaagtttggctgaacatatgcaaatcaataaatgtcatttgttgcacaaacagaactaaagataaaaaacatgattatttcaatagatgcagaaaaggccttcactaaaattcaacatccctttatgttaaaaacttttaataaactaggtattgaaggaacatacctcaaaataataagatctgtatttgacaaactcacagtcaatatcacaatgaatgggcaaaagctggaagcattctccttgaaaaccagcacaagacaaggatgccctctctcactgctctgatacaacatagtattggatgttctggccagacaattaggcaagaaaaagaaataaagcatattcaaataggaagagaggaagtcaaactacctttgcttgcagattacatgatcatatatctagaaaaccccatcatctcagcccaaaagcttcttaatctgataagcaacttcaacaaagtctcagtttcatgaacgtccgtgtgaagagaccaccaaacaggctttgtgtgagcaataaaagcttttaatcacctgggtgcaggcgggctgagtctgaaaagagagtcagcaaagggagataggtgtggggccattttataagatgtgggtaggtaaaggaaaattacagtcaaagggggtttgttctctggcgggcaggagtggaggtcgcaaggtgctcagtgtgggagatttttgtgccaggatgaaccaggaaaaggactttcacaaggtaatgtaatcacttaaggcaaggaccgaccattttcacttcttttgtggtggaatgtcatcagttaaggcaaggactggccatttacacttcttttgtggtggaatgtcatcagttaaggtggggcaggacattttcacttcttttgtgattcttcagttacttcaggccatctgggcatatacttgcaagtcacaggggatgcgatggcttggcttgggctcagaggcctgacactcaggatacaaactcaatgtgcaaaaattgccagcatttctattcaccaacaacaggcaagtagagacaaatcatgaatgaactccaaatcacaattgctacaaaagaatacgatacctaagaatacagctaacaaggaaagtgaagaacttcttcaaggaaagctacaaactactcaaagaaatcagataggacacaaacaaatggaaaaaaaaaatccatgctcatggataggaagaatcattatcgtgaaaatagccatactgcccaaagtaatttatagattcamtgctattcctattaaactaccattgacatttttcagagaattaggaaaaaaaaacctattttaaaattcacgtggagacaaaaaagagcccgagtagccaagacaatcctaagcaaaaagaacaaagctggtggcatcatggtacccaacttccaactatactacagggctacagtaaccaaaacagcatggtactggtaccaaaacaaacacatagaccaatggagtagaatagacaactcagaaataagactgcacaactacaaccatctgatcttctacaaacctaacaaaaacaagcaatggggaacggattctctatttaataattcrtgctgggagaactagctagacatatgcagaaagttgaaactggaccctttctttacaccttgtacaaaaattaactcaagatggattaaagacttaaacctaaaacacaaaactataaaaattttagaagaaagtctaggcagtaccattcaggacgtaggcatgggcaaacatttcatgatgaaaacaccaaaagcatttgcaacaaaagcaaaaattgaccaatggaatctagttaactaacaagcctctgcaaagcaaaataaactatcatcagagtgaacagacaacctacagaatgggagataatttttgcaatctatccatctgacaaaggtctaatatgcagtgtacaaggaacttaaacaaatttacaagaaaaaaacattaaaaagtaggcaaaggacatgaccagagactcctcaaaagaaaacattaatgcagccaacaaacattaaaaatagctcaacatcactgatcattagagaaacgcacatcaaaccacaatgagataccatctcacaccagtcagaatggcaattattaaaaagccaaggaacaacagatgctagctagcttgcagagaaaaaggaatgttttacacagttgttgggaatgtaaattagttcaacctttgtggaagacagtgtagcaattcctcaaaaatctaggagcagaaataccattttacccagcaatcccattactgggtgtgttagtcagggttctctagagggacagaactaataggatagatttatacatgaaggggagtttattaaagagtattggctcacaggataacaagttgaagtcccacaataggccgtctgcaagctgaggagcaaggaagccagtctgtgtcccaaaacctcaaaagtaggaaagctgacaatgcagcctttaatctgtggccaaaggcccaagagcccccggcaaaccacttgtgtgagtcygagcgtccaaaagctgaagaacttggggtccgatgtttgaggacaggaagcatgcagcatggaggaaagatgaatgctggaagacacagcaactctgctctttccaatttctatctgctttattctagccacgctgattagatggtgcctgttgtgactggggatgggcctgcctctcccagtccactgactcgaatattaatctcctttgcaacactctcacagacacacccaggaagaatactttgcattttttgattcaatcaagttgacgctcagtattaaccatcaaactgggtatatacccaaaggaatataaagcattttattataaagatacatgcacacatatgttcattgtagcactattcacaatagcaaagacatggaatcaacccaaatgcccatcaatgatagattgaataaataaaatgtggtacaaatacaacacggaatgctattcagccatgaaaaggaacaagatcatgtcctttgcagggacatggatggagctggaagccattattctcagtaaacgaatgcagggatagaaaagcaaacacagcatgttctcacttataagtgggatgggagctgaatgattakaacacatagacacatggtggggaacaacacacacttgggcctgttgggggatgttgggagaaaggagagcatcaagaagaatagctaatggctgctgggcttaatacctaggtgatgtgttgatctgtgctgccaaccaccatggcacgcatatacctgtgtagcaaacctgcacatcctgcacatgaaccccagaacttaaaagttgatggaaaaaaaaaaataagaactcttttctatatgagagaattaagaaaaagcagacacacaaacacagacccggggaagaaatatcctcagggaaaaccttatcagtaattactttaaaatgtaaatggcttaatattctcaagtaatatagatgaatagaataaaattatgatctaaatatatgctgtgaacaaaagactcactttggatctaaagacacaaaaaggttgaaagtgaaaagatggaaaaagatattccatgcaaatagtatattagattatttatttgcaagtattttgtgtttcttgtaggtggtgagggctgcacactggcagctgcctgctcagttattggtgtgggctctgatattggtggtagcattcgaatgcctgctttcttcaatggtatatttggacacaagccttctccaggtaatgttaatatgatcagaagggtggttctacttttataattcagagcaattcagaaattttgttctagcaggattatcttgyttatcagggtgattattatatatttctcaatgttcttaaataaaactagctactgtttattgagcaccaactctgggattggtgcacaaaattgtgcaaggctttcctataactaatgtctttcaatagttataatagttgtttttttttttttcagaaagttatccccaatttacaaatgacaaattcaaagctcagaaagattaaataaaccggctccaaattaaatagttaaacaagtaaatcatagtgctaggattcaaacctacttggattacaggaggctgttttctatccactgtactaaaatgacttatcagttaaatttgattttccctcatttaaagggtaaaataacacagtttcagaaacagtggaaagaaaaattctgtcacctagaaactccagttattggcatttactgttttttcaatgaattcaaggagtatttattttgtattatttatggtggtaagaatgtcaaagcagactccctgcattcaaggaacttaaaatcttctaggctttcaaaaagtgatttaaaggtaatataaggtagtctaataaatataattgtggtatagtaaagcagaatattttgaactttagattaatcataaaaatatgctaagaataaatcctcatttgatcatggtttttaggaatcagtactataacaatggtccgtatacaccatggaatgctatgtagccatgaaaaagaacaagatcatttcctttgcagggacatagatggaactggaggccattatccttagcaaactaacgcagraacagaaaaccaaatgtgacatattttcactcataagtgggagctaaatgttgagaacatgtgagcacatagaggggaacaacaaacactggggacctttcagagggcagagggtgggaggatggttaggatcaggaaaaataaataatgggtactagtcttaatacctggatgatgaaatagtctgtagaacaaacccccatgacacgtttacctatgtaacaaacctgcacatgtacccctaaacttaaaagttaaaaagaaagataaatcctagctcttcatgactttaaagaattacgcacaaaaagagtactgaaaattggcctgctaggagttgacctattttttttcccttccatattttattctacgttcagggggcacatatgcgggcttattacatgggtaaattgtgtgtccatgtggtttggtgtacaaatgatttcatcattcasgtagtgaacacagtccctgataggtagttttttgatccttgccctcctcccatcctccacctttaagtaggctctggtttctcttgttttcttctttctgtccatgtgtactcaaggtttagttccacatacaagtgagaagatgtggtagtttcttttctgttcctgtgttaattagcttaggataataatggcctctagctgcatccatactattgcaaaggaatattttattcctttttatggctgcatagtatttcatggtgtaaaggtactacatattctttattcagtccactgttgatgggaagctggattgattccatgtctctgctattctgaatactgctgtgataaacatatgagttcatttgtctttttggtagaacaaataattttccttggagtatatatctggtaatgggatcactgggttaaatggcagttctaagttatttgagatatctccaaactcctttccaaagggctgaactaatttacattcttaccaacagtatataagcattctcttttctctgcagcctcatcagtgtcagttayttttggattttttcaatgattgccattctgacttgtgtgagacagtatctcattgtggtctttatatgcatttctctgatgattagtgatgttgatcattttttataggtttcttggctgcttgtacatcttcttttgagaagtgtccattcatgtcattttctcactctttaattgattatttactttttgcttgttgatttctttaagtgccttatagattctggatattagacttatgttggatgcatggtttctgaatattttctcccattctgtagactgtatgtttactcttttgataatttctttcgctatgctgtagctctttagcttaatttggtcccacttgccaaattttctttgaaattgcttttggagacttagccataaattatttgctagtccagtgttgagaagggtatctcctaggctttcctctagcatttttataggttgggatcttacatttaaatatttaatttatatttagttaatttttgcatatggtgaaaggtagggatccagttatatttttctgcatatggctggccagttatcccggcgccatttattgaataggaagtcctgttacccttgcttttgtaaattttgtctaagatcagatcgttgtaggtttgcagctttatttctgggatctccattctgttccattggtctatatatctgtttttataccagcttcatgtggttttggttacattagtcgtacaatacagttttaagttgggtaaagtgatttatttgccttttgtttccttaggatccctttggctgttcagatgtattattggttccatatgagttttagaatagctttttttttttttaaattctgtgaaaaataacagtatttcgatagggataacattgaatatgtaaattactttggaaagtatggcaattttaatgatattgattcttccaatccatgataatggaatatttttctgtttgtttcatctcatattttttcagcagtattttgttgttctttttgtaaagatgtttcacctctttggttagtggtatttctagatattgtagttttggtgtggctattgtaaatgggattgcattttttatttggcttaccaagaatattattgaagtgtagaaatgctactgatttctgtacatgaattttgtgtcctgaaactttactaaagtcatttatcaattccaggagccttttgggagagtctttttgaatcatattgtcagcagagagagattgactttgtctttgtcctatttgaatgccctttatttctttctcatgcctaaatgctctggctagggcttccagtattatgttgaataggagtggtgagactggacacctttgtcttactgcaggtctcaaggggaattattctgtcttttgcccattcaatatgatgttggctgtgggtttgtcataattagctcttattattttgatgtatgctcttttgatgactattcttctaaggtttttatcatgaaggaatgtttgattttattgaagtmtctttctgaatctattgagatgattatatctttttttgttttaaattctgtgtatgtggtaaatcacttttttttatttgcttatgttgaattaacattgcatcccaggagtaaagcttactcaactgttgtgaattaacattttgatgtgctgctgaaataagtttgctagtattttgttgaaattttttctgtctgtattcatcagggatatagtcatgacttttgttgttgtgtctgtgccagattttggcatcaggatgcttgatttctagaatgagttaaagagcatcctctcctcaatttttttttttttttggaatagtttcagtagtattggtaccaggttttctcccttcccttcccttccctcctctcccctccccttcccttccctttctttttgcattcctggtagacttcagctgtgaatccatctggtcgatgtcttttgtgcattggtaggttttttttaattactgaattaatttcgaagcttgttatttgtcttttcaagatttctctttcttcctggttcaatcttcagaggttgtgtgttttcagaaatgtatccattttttctagattttctaatttgtgtccatagaggtgttcataaaaaccactgaggatcttttgtatttctgtaggatcagttgtaacttcacctttgtcatttctgattgcatttatttggactttttttttctttgttaatctagccagcagtctatcttgtttattccttcaaaaaagagactcttggttaaattgatcttttgtatgaacttttgcatgtcaatttcattggttctacccaattatagttacatattttctactgcaagctttgagtttggattgcaatttattttctagttcctttgggtgtgattagatcactgattttagatctttctaactttttgattcaggcttttaacatcttaaactttactcttaacagtgcattacctgaatcacaaagattttggtaagttattttttattttcattaacttataataatcttttgatatataccttaatttcatcgttcacccaaaagttattcaggaaaaagttatttaatttgcatgtatttgtgaatttttgaaatattttatttatattggtttctatactttttgcactctgatccaagagtgtgtttggtatgatttaaatttttttgaatttattgagacttgctgtatgaccaaacttgtggtcaatcttagaatacattccttgtgcagatgagagaaatatatattccatgattgttgggtggactattttgcagatgtctatcaggtgcaattagtcaaatgttaaggttatatccttcatttattggttagttttctgcctcaaagatctgtctaaggctgtcagtggggttttgaaatctcccactattattgtgtggctaagttttttcttaggtcaaaaagaacttgttttatgaatttgagtgctccaaattgggtgcatgtatatataagataattcagtcttcttgttgaattgaatcctctatcattatattatgcccttctttgtctttcctgattgttgttggtttaagatctgttttatcttataaaaagatagcaactcctgcttttcttgtttgctatttgcatggtaagtttttctccatcgcgttgctttgagcctttcagtgttgttacatgtgagagaaattccttgaagagagcagatggttgcctttttagtttggtgtttagaccatttacattcagggtcagtattaatggatgagattttgattctgtactcatgttgttagctagttgttttgtagacttcattgtgtaattgctttatattatctgtgggctatttgcttgaattgtttgtggtagcaggcatcattcttttgtttctatgtttggcactcccttaaggaccccttttaaggttggtctggtggtaacacacttcatctgggaaggactttattttttatttatgaagcttagtttgccaggacatgaaatccttagttggaatttcttttctttgaggatgctgacaatacacccccgtgtcttctgcctttaaaggtttctgctgagaggtgtgctgctatcctgatggagttctctttgaaagtgacatgaccttttcccttacttgcctttaaggattttacttttcccattgaccttggtgaatctgatggctatgttccttgtggatggtcatcttgtatagtacctagctggagttctctgtatttstttgatttgcctgtcacactctccaataagattaggaaaatttttatggactatattttcaaatatattttccaagttaattattctctctcctctctcaggcatgccactgatgcatagattttgttgctttacataatctcatatttcttggaggttttgtatattgttcttatttgtttttctttatttttgtctgactgagttgatttgaaaaactagtctttgagctctacgaatctttcctcagcttggtctattctgctgtcaatacttcctactgtattatgaactttttgtagtgaaatgtttaattccaggaggtctgtttggttctttctttaaatggctgtttcatctctcagttcttagatcattttaatggattccctggattccttggattgggtttcaactttctcctgaatctcgatgagttttctttccattcagataatgagttycatatctgtcaaaaaggctagtttgtttatttggaggtaaggggatgctaagtttttttttttttttttttttttttttttttttgctgttgttgttgttttaattttcataattcttgcacttattctttctcctctgagggggctggtgttcccttaactgtgttgaaagctgattatagtcagttggttttaattctgtgtgctttcaggagaccagggctctttataagatctttattagtgattggatttttgccttgggtttctcaggcactgtatactggcaaaaaattttttgatgttgttacttaggctgtaatctagtaaatggcatataatggtaatggctggtagataggcgcttactcaacaacgtgactcttctgcatttctgaatgttcatagtagttatctgtggtttgttggagagaaatgacctcattgggtctgattctaggccttggtggaacatcctctgatcactagtgcagtgcctacatttcctattttaggtgctccaggctgcagaccttccctgcactcaccattgaaggacataagtgtaagcccacaggtccagctttgcctttgcctcagagaatgcatggttcgggatcctgcagattgcacaaccccatccaccacttgaggcacctgagcactcttcctagggaactgagatttggcctaaacaccctgcaactaccacgtcaactggcttctacttggaagtgttagttgctggcccaaaaagcccatcacgaccactgccaacatgagcacataatgcttgggaaccagaaggacatcttacattgctattgctattgactacactatgttgactgcacaggggcttaagagcccactttcctacttagttcactgataacacaattgccattcaagaaagacacccaggggcccaagaattggcccacctggaaccaccaatgtgggtaccagtgtacaccaccccttggcacgaggatggatgctcttagctaccactgtgaccgctgaagcctgaagacaggcccaactggtgtcagtccctagcacagctttactaaagccttcactaacaagcatacccaaacacacagaaggaaaccgcagatagctctttacaaccaaaaatactatacagagatttaactgctgcatgcgtcttgagccaaagccaaagggctcaacacaaccaacattatagaaacaccttcaggaaaaagtctcccctaaggaaagtaaatttaaaaatagaagtgattgttacaccagatgcagagatgtcaacataaagacacagaaacataaaaaagcatggaaatatgacacccctaaaggaacacaataattcaccagcaagagattcaaacaacagaaaaaaaatctcaaaatgccatttaaagaatccaaaataaagacgctcagtgagatgcaagagaagtctgaataccaatacaaagaactcagaaaaacaaatcagtgtataaatgagaaatatatatatatattatatatacacatatatatattatatatataatgtatatgtgtataatatatacacatatatatattatatacatatatatgtataatatatacacatatatatgtatacatatatgtatatatacatatacatatatacatatatatgtgtatgtatgtatatatgtatgtatatctgtgtgtatatatgtatatacatatatacatatatacatatatacacagatatacatacatacatatatacatatatacacatatataatgttttatacacatatatattttaaatgttttatatatatctattttaatatatatgtatatatgtgtgtatatacacatatatacatatatatacatatatacacatagatacatatatatacatacatgcatatatacacatatatatacacatatatacatatatacacatatataatgttttatacacatatatattttaaatgttttatatatatatatctattttaaaacaggaattctagaactgaagtattaatttaaggaaatacaaaatacattcaaaagcttcaaaaatagactatacaaaatagaagaaaaacacttacaacttaaagaaaggtcttttgaaataattcttttggacaaaaataagagaacaaagaattaaaaaaaaccaaggcctccaagatctttgggacaacataaawcaactgaatatgaaagttattaatattcctaaatgtgaggatagatcaaagcttagaaaatgtaatttaatgaaataacagatgaaaacttcccaagtctaccaagaggtttagacatccaaacacaagaggctcagtgatccaaagaaatagaatacaaaaaatcttcatcacagcacattataatataactgtctaaagtcagtgtgaacaatgatttttaaaaacagcaagagaaagtcatctatttacctattaaagaaaaactatccaactaacaatgaccctctcagcagaaacttcaaaggccagaaaataaatggatgatatgttcaaagtgtagaaagaaaaacaaccctgctgacggtgaatactatattcagcaatacttgccttcataaatgaagtataaataaagtctttcccatacaaatgctgagggaatttgtcacgattagattggccctacaagaaatgctcaagaagtcctaaacatgaaagcaaaaggacattaaccattatgaaaacacatgaaagcaaaaggacatttaccattatgaaaacacacaaaaatagaactcactagaaaagcaatcacacaaaaatggaagagaaaggaatcaaatggcactactacagaattccaccaaaccacaatgacaaacaacgtgggaaaaaaaataacttatgaaacaagcagaaaacagttgacaatatggcaggaagaaaacctcaattgtcaataataattatgaacataaacatattaaaatctcaacttaaaaaatacagattgacaaaatggtaaaaaacgatctaaccaaattcttcttacaagaaagttactttattttaaaagaactattaactgaaagaaaaggggtagaaaaaatggtccttccaaatgaacatcaaaattgggcaggagtagctacatttttataagatcaaacagacattaagtcaaaaacaattaaaaaggtgattatataatgataaagaaatcaattcagcaagagaatgtaacaattctaattatgtatttacccaacattggagcatccaaattgataaatatcactagaccaaaagaggagatagattgcaatacaataataattagggatttaattctccactcacaatattaggcagattgtcaagacaaaaattcaacaaagaacatttgttgtaactaggctataaatctaaatggatgtaatagatatttagagaacattcttcctgacaactgaagaatatacattcttttcatcaacacatcgaacattctccaatatgaaccacaggataggccacaagaaaaagcttcaacacaatttttaaaaattgaaattatatcaagtatcttttcagaccacagtggaacactactagaaattaataccaacaggaactttagaaagtatacaaatatatggaaagaaaacaacatgtttgtgaatgaccattgggtcaataaagaatttaagatggaaagcaaaatatatttgaaacaaaaatggaaatgcaatgtagtaaaacttgttggttacagcaaaaggagtgttaagagagaagtatatggtaataaaggcttacgtccaaaaaaagtacaaagattacaaagtaacaatttaatgatgcatattaagcaactagaaaagcctgaactaatcaagattacatttagcagaagaaaagaaatagcaaatattaaaacagagctaaatgaagttgaggctaaaaacataatacaaagaatcaatgaaatttgaagttggacagataaagaaaattgatcaactgtgagctaagctaacaaaaaaggaagaagacccaaataaacactgaaatgacaaaggaaacattgaaatttataccacagatataaaaaaagattattggagactattatgaaaactgtatgcttagaatctagaaaacctatcagaaacagatacatttctggaaacataaaatctattgagattgattcaggaagaaatagaaaatctgagcagacaacgaatgagtaatgagcctgaggctgctatagagtctcaaaacaaaaacaagccaagaatggattattcacagctgaattctaccaaataaataaagaactataccaatcatactgatattattccaaaaacttgaaaaggagtgaattaattccaacttcatcaaggccaggatcaccctgataccaaaacaaaataaggaagcaaatatatgtgtgtgtgtatatatatatatatacatatatatatgtgtatatatatatatatacacatatatatatgtgtatatatatgcacatatatatatatgtgtatatatatgcacatatatatatatgtgtatatatatgcacatatatatacacatatatatatatgccaatatttttaatatagctagacacaaatatcttcaacaaaatactagcaaagttgaatctaacaacatgtcaaatagaccacatactatgattaagtgggtgttataccagggatgtaaaaatggttcgacataggcaaataagtaaatgtgatatatcacatcaacagaatcaagaacaaaaaccttgttatcatttcaattgtcaaagaaaaagcattcgataaaacttatcatgccttcatggtaaaaaaatcaaaaaactagccacagaagcaacatacctaaaaataataaaggccacatatgacaacccaccaggtaacatcatactaactggggaaatgctgaaagcacttcctctaacaactggaacaaagcgagaatacccatgtttgctacttttcaatgtagtactggaagtgataacttgaacaaccaggcaacagcaataaataaaagacatccaattagaaaaagacgaagttaaataatctctgtttgccaaagatataatcttagatatagaaaaaccctaagaacttcaccaaaaatatttaaatttgataaatgaattcaggaaaggttcaagatacaagaatcagcacacaaaatcagtataatttatatgtgctaattatgatctgagaaagcatgaaggcaatctcatttatgatagttacaaaaacaaacaaaatacctgcttataaatttagccaaggaggagaaagattactacaaagaaaactacaaaacacagataaaagcaattgaagatttcaaaaacaaatggaagaacattctatgctcatacgtcagaagaattaatatcattaaaatgaccatattacacaaagaaatctacagattcagtgcaattcctatcaaaataccaacatcattttcacagtattataaaaaattaaaatttatatggaaccaaaaaagaaccctaataactaaagtgttcctgagcaaaaataaaaaagctagaatagtgcattacctcacttcggtaatattatgaggcgacagtaagcaaaacaacatggttctggtaaaaaaacagatgcataggtcaatggtacagaatagagaacccagaaataaagccacataaatacagccaagtgatctttgacaaaggcagcaataatatacattgtggaagtgaatcacttttcaataaatggtgctgggaaaattggatagtcatatataaaagaatgaaactagactactttattttgtcatatacaaaaatcaactcaaaattaattaaaaacctaaacagaagaccccaaattattaaaaaaaaaaaaaaagaaaaaaaagaaaaccaaggggaaattattttggacatctgtctaggcaaatactttatgactaagaccacaaaagcacagtcaatagaaacaaaaatggacaaatgtgacttaattaaatttaaaaccttttgcctagcaaagatgtaatcaacagagtgatgaaacaacctgttgaatggaagaaagtatttgcaaattattcattcaactgaagacttatattcagaatatataacaagctcaactcaacaatgataaaacatttcattcacaactgggcaaaggacataaacagacatttttcaaataaaagatatacaaatggccaatatgtatatgaaaaacgctcagtatcactagctatcagagaaatgcaagtcaaaaccaatgtgagattatatcttactccagtcagaatgggcattattacaaatacagaaagtaacagatgttggcgaggatttggagamaaggaaatcttacacattgtgccaatataaacaagtgtagtctgtgaaaaacagtatggaggtttttcaaaggggtaataatagaactactatttcatctagcaatctctctactggatagctacccaaagggaaakcaattatattaaaagctacctgcacttgtatgtttatacagcattattcacaatagcagagatatggaatcaacctaagtgttcatcaacatatgattggataaataaattgtggtatatatacacaatggaatactattctgccatatgaaatcatgtcttttgcagcaacatggatggaactgacatcattatatttagcaaaacatgcccgttacagaaagataagtattacgtgttctccccaataagtgggtgctaaaaacgttttttacatggatgcagagagtagaatgatagataatggacactcagaagggtgaggctgagagagtggaacacgattagaaatttgttaatgggtacaatgcacattattcaggtgatggataccctgcaagccctgatttgactgttatgtaacctgtgcatataccaaaactgcacatacatctcataaatttgtacaaaactaaaacccactgaattacttcagtggcaaatctgtcaccaagtttgtctgtgttgtcatctaagtaaacctttgttaagtatacataaaaatcttgtactttatgaatttaactatgtaaaaagaaaattgagataaaaagactaagggaacatatgaaaatattaattatgagtattttttgctaatgagattctaggtaaatttaatttttattcatttcagtattttccaaattttccataatatatgtatgcttttttaaaaaattagatgctaatttttaaaatattaatatgtctagtttgatatgtcttgtgttcacattttaaaacatatacacagcaaaaggactgaacagagtgtaccaaaatgtttatctggctagcactgccaggaatttgcgttcattttcttcttacttttttatcaaatattctctactaagtaggtattacatttatacaggaataaacatttttttgaattcgaattgtaactatgcctgttactaaatatgcacttttgttattttaaataacctccagagtctcagtttccccayctttgaaaatgagataatacttacctcttaggttagttctgaatacaaaaacatgtgttggttaaacatgtgccaaaattgtttgtttctaaaatttaaaattggcttctttgtctttttttttagtaagataacagataaaaatgaaattagtctatttttctacttgccagcagaatatctgtcttattttagggaacaatgtgaaatttaccatttatattaacaattaggtgtcaacccatgagaataaaacacatttctaagggaagaaaaaataatccatggacatgaaatgccattccatgtatttatgctttatttcagcaatggtttgtagttttcaatgtacaaatatttttcctctgttgttaaatttgtttctattttactccttttcatgccattgtgaatgggattgctttcttaatttcattttcagattgttcattattagttcattgaagtgtaactgatttatttttttttaataactattaacttcttcgaattcatttttaaccattagcagtttctctttatggactctttagggttttctacatacacgatcatgcaatctgcagaaataacttcatgtgttcctttcaaattttgttgtcttttatttatttttgtcacttaattattctgactagaactttcagttttatattggatagatggggcaagaatagtcattccttctttgttcttcattttagatgaaaaattttcagtctttcaacattgagcatgttagctttgaacttttcatatatagcctttattatgttgaggcaattattgtctattctttatttgttggcttttttgtcatgaaggagggttgaattgtttcatatgattttctgcatcaattgagatagtcatctgggttttctcttaattttattaatgtggattaatacattgattttcatatttaggacaattgtttcattccagcaatacattttacatggccactcttgtaatgtgttcttggattctattttactagtagtttgttgaatatatttgcatccatgtttatcagggatattggtctatagttttcttgtagtaacagtatatggtttggtatcagggtaacrctggctttgtaaaatgagtttggaaatattatattcaatttttggatgaatttgaagatgattagtattatttaaaaaaaaagttagatagaattcttctgtgaaggtatctgttcctgggatttcctgtgctgtgaagttttaaattactgattcaatttctttactagctataggttctttcagattttttctctcttcatgattcactcttagtatgttgtgtgtttttaataatttatagattttctctaggttaccaaatttattgatctatattttttaatgtattgctttataatactttttatttctgtggcatcatttataatgtccgctcttttatttctgtttttagttacttgaggtttctcttttttcttagtcaacctagctacaagcttgtcaattttgttgatatcttactaaacccagttcttaattttgttgttttttctgttgattttttaacttactaaattctattttatttatcactgctttaattttaatttttattatttatttattttaattattatacgttaagttctgggatacatgtggagaatgtgcaggtttgttacataggtatatacgtgcaatggtgatttgctgcacctatccacccgctagctacattaggtattttttctactgctatccctcccctagccctccaccctctgacaagccctgatatgcgatgttcctctcactgtgtccatgtgttctcattgttcaactcccacttatgagtgaaaacatgtgatgtttggttttctgctcctgtgtttgtttgctgagaatgatggtttccagatttcctatttaataaatggtgctggtaaaaccggctagccatatgcagaaaactgaaactggaccccttccttacaccttatacaaaaattaactcaggatggattaaagacttaaatgtaagacctaaaaccatgaaaaccctagaagaaaacctaggcaataccattcaggacataggcatgggtaaagacttcatgactaacacaccaaaaacaatggcaacaaaagcctaaattgacaaatgggatctaaataacctaaagagcttctgcacagcaaaagaaactatcatcagagtgaacaggcagcctatagaatgggagaacatttttgcaatctatccatctgacaaagggctaatatccagaatctacaagaaacttaaacaaaatttacaagaaaaaaacaaacatcctcatcaaaaagtgggcaaaggatatgaatagagacttctcaaaaggagacatttatgcagacaacaaatgtatgaaaaaaagctcatcatcactggtcattagagaaatgcacatcaaaaccacgataagataccatctcatgccagttagagtggcgataattaaaaagtcaggaaacaacagatgctggagaggatgtggagaaataggaatgcttttacactgttggttagagwgtaaattagttcaaccattgtgaagacagtgtggtgattgctcaagggtatagaaccagaaataccatttgacccagcaatccttttactgggtatacmcccaaaggattataaatcattctactataaagacacatgttcatgtatgtttattgaagcactgttcacaatagcaaagacttggaaccagcccaaatgcccatcaatgatagactggttaaagaaaatgtggcaaatatacaccatggaatactatgcagccataaaaaaaggatacgtttatgtcttttgcagggacatggatgaatctgctctactttttattatttctttccttcagataaggttggctttatagtgttcttctttgcctagtcccttgaggtgraaagttaggtagttagtttgagatcttttttttttttaaattttatttaaaaaattgtattgtattttggtaagaacatttaacatgacayctaccctcttaactgatttttaagtttccaaacagtagtcttcatttgggcacaatactttacagcagatctctagtatttattcatcttgcataaccaaaactttatatcacatgaatagcaattcyccatttctccctttctccatctcctgacaatcatcatttcactstctgcctctatgagtttgacaaatttagataactcatataagtggaatcacacagtatttgtccttctgttttatttagcataatgtcctcaagatgcatttatagtgctgcattttgcaaggtttccttgtttatgaaggctcaacaatttccattatatatgtatgtgtgtgtgtgtatatatakagagagagagtttctcaacctgttcatctgttgatggacatttaggttattcccacctcttggttattgtaagtagtgctgcattgatattcagaatgctaaatctctttgaaattctagaattcaagatctgagtatttaggtggataaatatctagaagtgagattgctggatcatgtgaatctcctatttttacatttttgggggatcttcataatgtttttaatggaggctgaacctttttgcattcccagcaacagtacaaaaatttctgattcctctacatccttgtcagcacttgtgagttattttttatttttgtgggtacatagtaggtgtatatatttatggggtacatgagatattttgatacaggcataaaatgcatagtaatcatatcagggtgaatgggattttcatcacctrtagcatttatcctcttcttgtgttacaaacaatccaattatactctttcggttatgtttaaatgtacaatatattactgttgactgactgtagtcacactgttgtgctatcatacactagatcttatttattctatctaactatgtatttgtacccattaacaatcctccctcccctcatccttcactacccttaccagcctctggtaaccatgattttactcctaagagatcttccttcttctttaatgtaaatgcttactgctacataccaacctgtttatatagcttttgctgcatcccatatgtttaggtatgttgtaatttaatttgtcttaaggtattttctaattttcattctgatttcttctttcacttgttggttgtttgagtatattgttaaatttccagtcttcatggattttctagtttcccttccgctattgatttctagttttattccaatagattggaaatcatgttttgtacattatttaggcctggccactgcacctgtcccaaataatatatattttagctgacaacaaattaacttcaaccacatatgaaaactttattcttgtacatatctgcccctctttatgttattgatgtcaaaattatattgtgcatctggtatcatagattcatagttattttcatgtttttgtcctttaatctccataccagaattagaagtgatttataaaccaatattatagtatcacaggatttaatatctgtctgcgtatttacctctrccagagatctttgttatttatggttttatgttgctaacaagtgtcttttgatttcaacttgaaggactccttttggcaattcttgatggcaggtgtaaaggggatgaaaaacctcagtttatgtttatcttggaaggtcttaatttttccttcagttttgaagaacagttttgctgaacatagtgtttttatttttcagggtgtttttttttttttctcagccctttgaatatatcattccagtcctttctgtactgtaaggtttctgctgggaaatatggtgatagtcttatggaaacttctttctgcacagtgwgtagctattctcctgctacctataagattctctctttatctgtgatttttgactgcttgattataatttgtcttggtatgagtctgcttgggtttatcttagagtttcattttttagcttttcccatttttrtgtaactttcctcaaaattgagaagtttttggccttctttcttcaaataattcctcttcccttttacttttttatgggtatttcatatgcatacatttgtccggttgatggtgtcacatgagtttcttagactctcttcactttccttcatttgtttcttttttgctcatctgagatgaaaattttaaatgacctattttaaggtttgctaattatttgttctgcttgatctagtctgcttttgtacccctctaccaaattttgcaattccattattctattcttcagcctcagaacttagttttttaaaataggttctatctctttattgatattctcattttgtctgttttctcttttagttattgagcatttttaagatggttattttgaattctttatcagataattcataaaccctttttaaaaattgttttcttgtttttaaattttcttaattttactttaagttctaggatacaagtgcagaatgtgtaggtttgttacataggtataggtgtgccatggtggtttgctgcacctatcaacccgtcatctaggttttgagacccacattcattagctatgtgccctagtgctcttcctcccctcacccccacccaccgacaggccccggtgtgtgttgttcccctccctgtgtccatgtgttcttattgttcaactgccacttatgagtaagaacatgcagtgtttggtcttccatccctgtgttagtttgctgagggtgatggcttccagcttcatccacgttcctgcaaaggacatgatctcattcctttttatggttgcatagtattccatggtgtatatgtaccacattttctttatccagtctctccctcccttctccataawtttttggataatttgagtagaattataattagttctttcttaaatatttgatagaattcagcagtgaaaccatcaggttactgcttctatctcattactcataattagtttgctcagattttttatttttccatggctcaccatcttargttatatatgtaaatacttttttttagtttttcaaaattactggcatatagttattcataataacttctttctttctttctattaatttaaggtttggcatgttgttgctcttctagttctcaaaggtgcagcatgaggttgtttataaactctttctacttttttgatatatgcatttatttctataaactttcctcttagtacaactactaatgtatcccatgggttttgatattttgtatttccattttatttttctgtcaagaaattaagattttttcctaaatttctttatttacttattgtttgctccacagcatgctatttaattttcatgtatttgtttagtctccaaaattcctcttgttattgatttccagtattatttaattgaggtcaaagaagatatgtgatattatatatatatttttttaaattgtaagactttctttgtagcccaatatgtgttctctcttggagaatgtccatgaaatgatgagaaggttgtgtattttgcagtcattggataaaatgcatccttttctctcagattgaacaattccctttagtgtttcttatatgacagttctagtggttatgaaatccctcatcttgtttgtctggaaaactcattatatttttttcatgtttgaaggaaactctggtaggcacaatagtctaagttcaaagttttttttccttcattattttgaagatagcatcccactctcctcttttctgtaagatttctgctgagaagtttgctttcagactatcagagctcctcataagttatttgctccatcttaccgattttatggtcctttctttgttcttgaccctagagtttgatttttttttcaaattttattttaagaacaggggataaagaaaatgtggcacatatacatcatggaatactatgcagccacaaaaaaagatgagttcatgtcctttgcagggacatggatgaagctgcaaaccatcattctcagcaaaataacagaagaacagaaaaccaaacaccacatgttctcactcataagtgggagttgagcaatgagaacacacggacacagggagaggaacatcacacactggggcctgtcggtgggtgggaggctaggggacagatagcattaggagaaatacctaatgtagatgacgggttgatgggtgcagcaaaccaccatggcacgtgtatacctatgtaacaaacctgcatgttctgcacatgtatcccagaactggatattaggcctttgtcagatacatagtttgcaaatattttctctcattttagaagttttctgtttactctgttgatggtttcttttgctgtgcaaaagctctttcacttaattatgtcctacttgtcaaattttgtttttgttgcaactgcttttgggtacttagatataaattttttccaaaggatgatgtccagatggtgttttctagattttcttctatgatgtttataagtttagtcttacatatgtctaatcaatcttgagttaagttttgaatatggtgaaatgtattttgcacatgactagccagttatctaaacaccatttattgataggtacttcattccccattgcttgytattgtcaactttgtggaagaccaggttgttatagatttgaagctttatttctgggttctctatcctgttccattggtctaggtgtctggttttataacaatatgatgttgcttggttactgcagccttgtagtataatttgaagttgaataatgtgatgcctccagctttgttctctttacttaaaattgctttggctattcgggcttttcttggttccatatgaattttagaatagattattctaattctgcaataactcacattgagagtttgatggggatagcaaggaatctgtaaatggctttgggaagtatggccattttaacaatattaattcttcaaattcataggcatagaatgttttactttttttgtcatctctgatttattttagcagagttttataattctcaaactagaaaactttcacctccctggttagctatattcctaagtattttattatctttgtggctatcataaatatattacattcttcatttggctctcagcatgaacattattggtgtataaaagtactactgatttttgtgcattgattttgtatcctgaaactctaagtagtttatcaattctaggagtcttttggcagagtgtttaggactttctatgtataagactatataatctgtaaagagaaataaaatgacttcctttcttttatttggatgcctttttttcttactcttgcctgattgctctggctaggacttcccagcactatgttgaataggagtgatgagggtgggcacccttgtctttttccacttctcaaggggaacacttccagctttagtcaatttaggataacattggctgttagtttttcaatgatggttcttattattttgaggtatgttctatggtgcctaatttttagaggatttttaacattggaggtatgatgaattttatcaaaagccttttctgcattcattgagatagtcatatattttttaaaggaaatctgtttatgtggttaatcacattcagtgatttgcatatgttgagcaatctctgcaccccaggaataagacattaattaccttctttatatgcttcaggatttcatttgctagtatgttgttgaggatttttgcatctatgttcatcatagatgtcggcctgtagggtttttttttttttttttttttttgtattggtgggcttaggtgtcagaatgattcatgcttcacagaatgagttagggaagactccctccttgactttttggaataatttaagtagtatgggtatcagattttctttgtacatctggcagaatttggctatgaatccgtttggtgcagggcttttttcttggtagtttttaaattactgatttaattttggaatgcattattggtcttttcagggtttcagtttctttctggttcaatcttgggaggttgtgagtttccaggaatgtattcatttcttctgtgttttctaggttgtgtgcagagaggtgtttgtaatagtctctacagatttttttgtgtttctgtgtggtcacatgcaacataatcttcatcacttctgcttgtgcttatttggatcttctccttttttttttttttttttgctaatagatcccctagtgttttggtcttgtcaattcttccaatgattcaacttttgrttttgttgatcttttgtatggattttgctatctagattttgctcagctcttaattttagttatttctttttaaatagtaactttagagtctctcttgcttgtctagttccaccaggtgtaatgttagggtattaatttgagatttttctaatttcttgatgtagttgctcagcactctccacttccctcttaacaggttttccctgtgtcccaagatgctggtatgtattgactctgatttcattaatttcaaaaagtttttttggttactgctttactttcaatcttaaccaaaaagtcattcaggagcatgttgcttaatttccatgtaattatgtggttttgagggattgtcttggtattgatttctatttttattgcactgtggtctatgagtgtagttgttattatatattttttaaaattagtttggatgtgttttatggtggagcatatggttgagcttagaatatatactatatacagatgagaaaaactgttagttggagtattctgtagatagctattaggtccaattgatcaagtataaagatttattccagaataccttggtttgttttttgctttgattatctgtgtaacttgtcaatggcatgttgatgtcttccacttttactgtgtggttgtttctgcatgtttttgtggctgcaggtactggtctttcatttccatatttagcactcacttaaggaccccttgaaaggctggtctgacgttaacaaattttgtagcatttgcttgtctgaaaaagattttatttctctttcacttatgaagttagtttggtagaatatgacattcatggttggaatttcttttgtatagggatgctgattataggyctccactctcttctggtttctaagatttctgctgaaagttctgctattagcctgatggggttccatttgtaggtgacatgctccttctctctagctgccattaacatattttctttcacattgaccttgaagaatctgatgactctgtgcttttggcatggttgtcttgtgtagtatcttgcaagggttctctgcgtttcctatatttgcatgtcaatctctctagcaacattggggatgtttttatggacaatatactccaatatttcttccacattgcttgctctctctgtctctttcaggaatgccattcagtctgaggttctgtctttttatagaatcctgcatttctcagagcttttgttcattttttctctattcttcaccattgtcgtcctatgttgaatcaaaggagaagtttctgagtgctgatactttttcctcagcttggtctgttacgttattaatgcttccaattgcactctgaatttcctgcagtgaatttttcattttcagatcagtttgttttttcttaaaatggcagctatctttcaactcttgaactattttattgtgtcccttggatgtttttcaagtttctcttgtatgttgatgagcttccttgctgtccagattctaatttctatgtgtgtaatttcagccattacagtctgcttaagaaccattggtgagtttgtttggaggtaagaagacactctaacttctaatgttgccagagttcttgcactatttctttctttctttctttcttttttccatctgtgtgggctgatgttcctttagtttttggagttgctgccttttggatgaggcttttgcttttttctttctttgatgttcttgagggtttgactgttataagttaggtttagttgattggcatcattttcagatgctttcaggggctaagactcagctgagcactcctgggctacatgctctatccctggtgaactgggacctggcccacagctttgttcttttgccccttgggggttaaatatctgttgccctggaggggccaatgtgttcccagcccattggtgacaacactaacagacgctgctagcaaaggtactccagtgggcttgtggtcatcccccacatgggtgcacgccagtggggcagcaggggtcccaaagcttgctcatgcctgcagggtggtgtgttttccatacgcatgtgcatgctggcagggtgatgaggggagactgtgggcaagcatacacccacaagggaaggctgtgggtggtcatgtgctgctggaagtctgtctgcaaaaacactcaaacagttaagcagggcttgccactgagggatcgatggcagtggatgctggtaaacagtggaggctgcactgcaagtggctgtagctaggcaggaccctggcagaggttagcagataagggggagctcagatcagactggccctgtcccacaggcaacacagccatgttcttttcggttccaacaaaggctagagctgcctggtggaatatggcagtctttggggaattggcagccatggctatgctccactgcagtcatttctacacaaaacctctggactccatacaggctggagttctgtctctgccaactctccaggcagttctccttgctagctcaggtgtacgtggtggttgtgtgtcaaatgtcttttcctatatttatctctgtattgtataaactcatacgaaataaccttgcattgctttttaaacattgaaatatatcatgcacagcatatataagtgataacgtattcagataagatgttgattattataaaggaaagcacaaaatgtcagcatctaaggttaacttaggatctgtcagagggtccatgaagtcgaaattattttataataatgctaagatataattggcctttttcattatgttgacatttgtagtcatgtttcaaaagcaatgttatccaaagtggctgcaccttagcatgaacaaggcaatgacactaaattgcactgctagtcattgtattctttactgctacacactgttagtaaaaatataaataaaaacaaaagttacaaaaaatgtaaaaaaggattgatatcagcaagaccatttagaagctcttcatacttttccctctcataaaacaagggcaaaaacaatgaataaacaactacattttaactatattatctgaaaaagaatgctagagcacagcaaaggagtagcagagactctgtggaacatgcaggctcaggatggcttcatagacaaggaagcaaagtattctgctgctgttactttatctcctcaaatgggattcactcagaactaagggggacttccctctgcaccagaaagtaagaaggaggtttctaacagcccctcttaagatcatggatgtctgcagtccttcctgctgaagaatcctgcagttctcacagatgctgagccaagtttggaaagctgccaggatttcacacagctgcattgttaaagaaagagcccacatttgcccccgttcttatttgacctaagctgctgctgcacagtgctatcttataactggagccactgctatattgtgtcttgctcatgagggcaataaccacktcatgcctccatccctgaggttttgccatcattacaccatgctcatacctagtagtacaccattactcagccaaactattatgggtcactcccctttggaacaagctgcctaggaggtcttccatctaccccattccagtgtctaccataccccaaccctggttactccaagcctggctccagcaaaacagctgcaaatctagcagccaaatacacaaggcacactgaacccacccccacccccaaacccagagaatagttagtgctgtgcacagcacagaagctgagtacaaagagctaggcccctgcatgcaccctcagtggacaaactaggctggtgctttgcctatgtgggagcagtgcacaagcttgtgggcaagctcagcactctcttgatgtgagaaccagcctggtgtcctgccccaaggggaacagcagacaagcagaggaccagctgtatgctctcttggcacacaaaagagcttggtggcataccccatggaacaacacacatatgaatgcataaatcgtgaactccctctgcatgtggagcagcttatgtcccacccacagtggagcagcaccagagacactgatgctcacaaaggcattgctggtgttgactacagctgaaggaactgcatagagactatgctattgcactcactggaatcaaagccagcatgctctacccartcaagccctaggaaacatcagcaggtaaaagtatctccacatgaaagacacttgataatattggaaaagataaccattccaccttatgcatgggtattaatatagggacacaagacacatgaaaagtcaaggaaatatgacattaccaatgaaacacaataattttgtggtaactgaccccccaaaatggaaatttctaattttttttaaaaagtaattcaaaataatgactcaagaaaactcagaaatatacaagagtacacagacacacactgcaacaaaatcagaaaaacaattcatagtatgaatgagaaattgatcaaagagatacatataatggaaaagaaacaaacataaattgtggagctgaagaattcaaccaacgaaataaataagactgagagctttagcagtatactagatccagcagaagaaagaatttttaaacttgaggaatgtgttttgaaacagtccagtcaaaaggaataaaaataaaataatgtaaaagagcaaataatgtaaaagagcaaatgaaataggtggtacatcattaatcaaacaaacttctgcattctagagatttcagtagaagagatggagaaaagcacaggaagcttatttaacaaaatagtagctgaaaatttcccaaattttggaagagatgtggatatccagatccatgaagctcaaaggactccagattcaacccaaagaggtcatctctgaggcctgttataatcacactgttaagacctaaagaattataaaagaaacatcagaaaattgtcaagtcacatataaaaggatctccatctgactgacagcagatttatcagctgaaaccttgcaggcctaaggagaatgggatrgtatatcaaagtgctggggaataaattgaggtaaaaatgccatacccaacaaaactattcttccaaaatgaaagagaaataaagtctttacctgacaaacaaaagttgaggaaactcaccatcaattatctttacattaaatgcttaagggagtgattcagctggaagtaaacatatagttactaagaggaaatcatatgaaactataactaataaaggtaaatttgttgtgaaattcagaacactccattattataaagtaatataatttttcaaatctctatgaaggttaaaatcacaatggtaaataatacctatagctacaacaagttgtaagtggacacaaaatattaaaacatgcaaatggagatacaaagttatgaattttaagaaatctagaatgtatgtgaccaaacttattatcaacttaaaattatttattgtaactgtaagcttttcatgtaagccctatagtagccactaacagcaaattacagcacataaacatataagaaaggggaaggaatacaaagcttattactatggaaaacccccaaatgacaaacgtaaaaaaatgagaggtgaagaaaggaacaaaggatacaaaatatttaacaaaatggccgaagctagtccttagtaaccaataataaccttaaatgtaaatgaatcaaattctacaattgaaacatataaagtggatgaatagataaaaaaatataacccagataagaaaaacataacccagctgtatgctgcccatgagagacgcatattacctgtttttccagttccagttgttactggaaaaagagactaagaagatcattatataatgacaaaagttgattcagcaaaaggatataacaattgttaatatataggcacccaacactggagcacacaaatatataaggcaaatattagatataaatggagaggtagcctgccatataataacagttggggacttcattcactttcagcaatgaaatgattatctaggcacaaaattaatgaaaactcagatataaactatactctagaccaggggtccccaacccccaggccatggaccagtaccagtccatcgcctgttagaaactggctgcacagcagaaggtgagtagtaggtgagtaagcattaccacataagttttgccttctgttagatcagcagcagcattagattctcataggagcatgaacccttttgtgaactgagtatgcaggggatctaggttgtgtgcttcttatgagactctaatgcctgatgatctaaggtggaacagcttcatctcaaaaccatctcacctcacagtgcatgtaaaaattgtctcccatgaaaccacttcctggtgccaaaaagtttggggatcactgctctagaccaaatggtactaatagacatttacagaacattccacccaacagctgcagaatacacattcttgtcaacagcatgtggaagttactccaggatacatcatatgtttggccacaaataagtatcaaaaatttgttggttttttattttactttattttcaacttttattttagattgagggagtacatatgcaggtttcttgcaaaggtctactgcatgtttgtcatataattgaacctgtcacccagctagtgagcatagctcccaataggtacctttttgacccttgcccccttcaaactctccccaagcttatagtctcctgtgtctatttttctaaactctatgtccatgtgtacacaatgtttagctcccacttgtaagtgagaacatgcggtatttggttttctgtctgtgttagtttgcttaggatattggcctccagctccatccatgcttctgcaaatgaattcattcttttctatgggctgcatagtactctgtgataccacattttctttatccaatccaccattgatgggcacctagtttgattccatgtctttcctattatgaatagtgctgctgtagacgtgcaggtgcatgtgtcttttaggtagaacaatatttggctttcaatatatacccagtgatgggatgattgggttggatcacagttctattttttkgggggggggttactttcaacttttacttcagaaacaggggatacatgtgcaaggtttctaaaaaggtatattacatgatgctgaggtttgaggtatgattgaacctgttacccaggtagtgagcatagtatctgataggttttcaccattaacactttcccttttatcctcaccttgtagcccccagtgtctactgttcctatcattatgtcaatgtttacccaatgtttaatttacacttataagtaagaagatgcggtctttggttttttaatttctgcattaatccacttagaataatggcctcaggctgcattaatgttgctgcaaaggtcatgattttcttctttttttggctgcataatattccattgtgtatatgtatcactttttttatacaatccacagttgatggatatctattttgaatctatgtcttttttattgtgaatagtgctgtgatgaacatacagatccatgtatcttcttggtagaatgatttatattccattgggtatatacccagtaatagtattgataggtggaatagtagttctattttttagttatttgagtaatcaccaaactgccttccaaagaactgaaccaactgacattcccaccaaatatgtataagcattctcttttctctgcagtcctgccagcatctgtaatttttttaactttttaataatagccattctgactggtgtgagatggtatttcttggtggttttaatttttgtttctccaataattacagtgatgatgagcattgtttttgtgtgttagttggatacttctatatcttcttctgagaagcatctgttcatgtgtcttgttcactttttcatggggttatttgtttattgcttgttttttccaagttatccaattgaatatctttatttttatattccaggtcatttgaaaaattcttttattagtggtgacatttcttgtttaatgattacttctcttcctaaacaaaagtagtagtagaatttttaactaattaattagttttattgtgataaaatatactcgccataaaacttactgtgttagccacttttaatttttttaattattttttattacaataggtttttggggaacmggtggtgtttggttacataaataagttttttagtggtgatttctgagattttggtgcacccatcacccgagcagtatacactgtacccagtatatagatttttatccctcaccctcctctcaccctttccctygagtcccragagtccattatatcattcttatgcctttacatcctcatagyttagcttccacgtatgagtgaaaacctacaatgtttggtttttcattcctgagttacttcacttagaataatggtctctaattccatccaggttgctgcaaatgccaatatttcattcctctttatggctgagtagtagtattccaaggtatatcatggtatatcatattttctttacctattcattgactgatggggatttgggctggttccatatttttgcaattgcaaactgtgctgctataaacgtgtgtgcaagtatctctttcttataataacttcttttcatctgggtagttaccaaggagtggggttgctggatcaaatggtaaatctacttttaggtctttaaggaatctctacactgttttccatagtggctgtactagtttacactcccatcagcaatgtagaagtgtttctttttcaatgcatccatgccaacatcttttttttttttatttgattatggccattcttgcaggagtaaggtggtattgtattgtggttttgatttgcatttccctgattattagtgaaattgagcatttttttcatatgtttgttggccatttgtatatctgcttttgagaattgtctattcatgtccttaccccatttttgatggcattgttttcttctcgctaatttgtttgagttctttctagattttggatattagtcctttggcagatgtatagactgtggagattttctcctgctctgtgggttgtctgtttactctgctgtttcttttgccatgcaaaagctctttagtttaattaagtctcacctctttatctttgtttttattgcatttgcttttgggttattggttatgaaatcattgcttcagccaatgtctaaaagggtctttcgatattattttctagaattttcatagtttcaggtcttagatttaggtatctgatccatcttgagttgatttttgtgtaaggtgagagatgaggatccagtttcattatcctagatgtggttagccaattatmccagctttatttgttgaatagggtgtccttttcccactttaggtttttgtttgctttgtcaaagatctgttggctgtaaatatttggatttgtgggttctctattctgttccgttggtatatgtgcccatttttacagcagtatcatgttgttttggtgactatggccttatagtatagtttgaaattaggtaatgtgttgcctccaggtttatgctttttgcttagctttgctttggctatgcagatactttttgggtcccatatgaattttgggaatttttctagttctgtgaagaatgatcatggtattttaatggggattgcattgtatttgtaggttgcttttggcagtatggtattttcacaatattgattctatccatctatcaggatgggacgtgtttccatttgtttgtttcatctatgatttctttcagcagtattttgtagttttccttgtagagatctttcacctcccgggttaggtatattcctaagtattttatttattttgcagctattgtaaaaggggttgagttcttgatttgattctcagcttggtcgctattgtatagcagagctgctgatttgtgtacattaatttcgtatcctgaaactttgctgaactcatttgtcagttctaggagctttttgcaggagtttttagggttttctaggtatacaatcatatcttcagcaaacagtgacaatttgacttcctctttaccgatttggatgccctttatttccaccttttgtctgattgccgttgctaggacttccagtactgtgttgaatagaggtggtgagagtgggcatccttgtcttgttccagttttcagagggaatgctttctacttttccccgttcagtattatgttggctgtgggtttcccatagatggcatttattacactgaggtatgtcccttgtatgccgattttgctgagggttttaatcatgaatggatgctgaattttgtcagatgcttttctgcgtctatcaagaagatcatgcgatttttgtttttaattctgtttatgtggtgtattccatttaatgacacaagtcattaacctgtttctattaaatgatccctgcatcctggtatgaaactcacttgatcatggtagattatgtttttgatatgatgttggattcagttatctagtatttatttgtggatttttgcatccatgtccatcagggatattggtctgtagttgtttttttgttgatgttatgtcctttctggttttagtattaggtgatactggcttcacagaatgatttagagaggattccttctttctctatcttgtggaatagcatcaataggattggtaccaattctttgaatgtctggtagaattcagctgtgaatccatctggtactgcacttttttttttttttttttgtaaattttttattactatttcaatctctctccttgttattggtctgtttagaatttctaattcttcctcatttaagctgggagagttgtatatttccaggaacttttccatctcctctatgttttctagtttatgctagtaaaggtgttcatactagccttgtgtgatcttttgtctttctctggtttggttgtaatgtctcctgtttcatttctaattgagcttcttttctctctccttttcttggttaatcttgcaacttgttgtaatatcatagacaatggtttggaagaattattatctttttatatatctattggccatttggatttctgtttgcagaaagccttgataaaatatttggcccttttttaattgggtagtttgttttatcattggttaatgctttgattgtcctatttaagaaatatttgcccatccaaagccataaagatattctattattttttaaagatgctttattcattttcctttgacacttaggtttttaatccattagaaacaggtttttgtgtattgtatgaattaagattgaaagttactatttttctatatatatattgagttatgtcaaaagtttttgtggtaaagattatactttccccactgcattgcagtgccatctttgttttaaatcaggtaacagcaacaagagcaagtgggctggatattattctgtttcattatcttaatccttgtgtctatatctactataactgtagtataactacaggctgtactatatctatacaatctgtaatagtatccctttttcattcatgatactgatcatttttgtttttttctccctttttcttgataagtcttgttacgtgttcatcgatattattaatcttctccacaaataatcttttaaatatgtgcagaacatgcaggtttgttacataggtgtatacgtgccatggtggtttgttgcacccatcaaccagtcacctaccttaggtatttctcctaatgctatccctcccctagcccttcaccctctgacaggcccccagtgtgtgatattccactccctgtgcccatatgttctcattgttcaactcccacttatgagtgagaacatgtggtgtttggttttctcttcttgtgatagctcgctgagaatgatggtcacattttctttatccagtctgtcattgatgggcatttgggtcagttctaagtctttgctattgtgaatagtgctgcagttaacatacatgtgcatgtgtctttatagtagaatgcgttataattctttgggtataaaaccagtaatgggattgctgggtcaaatggtatttctggttctagatcgttgaggaatcaccacactgtcttctgcaatggttgaactaatttacactccaaccaacaatgtaaaaagcgtttttatttctccacattctctccagcatctattgtatcctgactttttaatgatcgccattctaactggtgtgagatggtatctcattgtggttttgatttgcatttctctaatgaccagtgatgatgagcttttttttgcatatgtttgttggctgcataaatgtcttcttttgaaaagtgcctgttcatatccttcacccactttttgatgtttttgttttcttgtaaatttgtttaagtttcttgtagattctggatattagatctttgtcagatggatagattgcaaaaatgttctcctattctgtaggttgcctgctcaatctgatgatagtttcttttgctgtgcagaagctctttaattagatcccatttgtcaattttagcttctgttgccattgcttttggtgttttagtcatgaagtctttgcccatgcctatgtcctgaatggtattgcccaggttttcttccaggatttttatggttttaggtcttacatttaagtctttaatccatgttgagttaatttttgtataaggtgtaggaagtgatccagtttcagttttccacatatggctagccagttttcccagcaccatttattaaatagggaatcctttttccatttcttgtttttgtcaggtttgtcaaagactagattgtagtagatgtgtggcattatatctgagggatctgttctgttcctttggtctatatctctgtcttggtaccagtaccatgctgttttggttactgtagccttgtaatattgtttgaagccaggtagcatgatgtctccacctttgttctttttgctttggattgtcttggctaaatgggctcattttgttccacatgaaatttaaagtagttttttctaattctgtgaagaaagtcaatggtagcttgatacggatagtattgaatctataaattactttgggtagtatggccatttttacagtattgattcttgctatccatgagcatgaaatgtttttccacttgtttgtgtcctctcttatttccttgagcagtggtttgtacttctycttgaagaggtccttcacatcccgtgtaagttgtattcgtagatattttattttctttttagcaattgtgaatgagcgctcactcatgatttggatatctattattggtatattggaatgcttgtgatttttgcacattgattttgtatcctgagactttgctaaagttgcttatcaggttaagaaagttttgggctgagagattgtaggtgatcaagaaaggccttatagtttcacttaagtcttgaaatctggttatccatctggcatattaattgtgaaatgtattataagcagaggaaatggcataaacaaagttataaatgagcatcaaaatagcctgttctttgcggaaaattgcaaacaatttgttatggcttctgtttaggtatcaggttgcagagagctttgtatacaagctaaaggaattttgactttatcctctatgccagtagatttttaaatctgtattctaactagtccttttccatataggctctgcagacccttagaaccatccccagaaagagagaatagcctaataagtagggaccctgtttccatcagagtagctctggttttgcttgttttatattgaagttcttcgttggactctattaggaaaaaaaattcactgcttttaagagagctagtaaaattgtgaaactactgcaatgagatataagaagacctgaaaagttttaaccaggagaaaaagtatttaagatagattaaacaccataatgaaatacaacatgcagggatcatgtcttattttgggcggctaacctgactgtctatcctttcaggtgtggttcccaacaaaggtcagtttcccttggctgtgggagcccaggagttgtttctgtgcactggtcctatgtgccgytatgctgaagacctggcccccatgttgaaggtcatggcaggacctgggatcaaaaggtatgttcatttatttttatttccttggactcttatcctgacattcattctctctttgtttattagtgtcatagaggtagactttcagtcctcaagcaaataatttttacaggtttttatgagagagcctttatatacttatataagtggataccatgcttcacaaattggaaagatgccatgtaaaagtattttactgagaaaatacaaagagaggccttatttttgggaaggaaacagtgaatctttttgtttttcatttgtgaatttgtgcataaggactacgttcactttaagttcagcctttctgattcttctgacatctgtcaccatatacatactttccaatctcacctaggcatcaacgctgcttggaaattggttccctagacagctcttttttaatatattttctgtagcagtcatttcaaattatttccatttccagcgaaactctgatcttctcctttcctttaccctcaagtaaataatcccacattttatctcataaaaaaatgcaatctatatgtaacttacttcagtttcttaccatcacatttttctaggtctccagctttcattctttctcctcttagagtggagaaaatatctttccattttgctttagcatataagtagtttcagttatgctcttgatcttatgttctcttattctctcagatctttgttccattacttatctcatcttagtatgactttaacctctctctctctgtctctctcgctctctctctctctcacacacacacacacacacacacgtgtgcgcacccttctcattattattaagcatcctaagtgtctctcatcttaaaaagagacaacatttttttagccccttattccccttaagccactactctatgccgctttttgccccattgccagatcctttgtgtgaattatttatactcattaactctaaattctcacattgccatctcataaatgaattcactacaaagtggtttttaccaccaaaattattcttgccaargtccctgaatttttttttttttttgcatttttgctaaaaataatgactgcttctcaatacttaccattcattacctcattataactggtggcaatattgatattactccatcattattgaaacaaactctgcccttggctcttgtgattcaatcatttttaaaattatttttaatttttgtgggtacctaacaggtgtatatatttttgggctacatgagatattttgaagcagtcatgtaatgcataataatcgcttcatggaaaatggggtaggtatccatccccttaagcatttatcctttatgttatggacaatccacccttttgatattgctccttttcctttcatctgccttactggctcttcttcctttgttcatctcttatatattggtattctagaaggacctggtttacttatctctattctttctacttaccctctcagaatgactccatctacccttgccacttcaaccattttccatacacagatgatgccaaaatctgcctcttcagctcacttttttcacttaagctagaggactgtctatttactactacaggaagactggscatttcagataactgagactcaatatatctaaaactgatattatttttctttcaagctccagaaacctgatccactactttgattcttacccaatcccagtgactggatgaccaaaatcaacccagttgctaaagcctcatttccgatttttctcagtcattacatctaagcaatgctgagtcatattgaaattacctactaatgatttcttacatctttacatatctctcccttaccatggttacagttctagttcaggctataatcatttctagcatgaactaccaccaaaacattttgacttgtcaccacgtctacaattttgatgcatttcaaaccattctctcccttgcagctcaagtacattttttaaatgcaaatctaaattctaaaggtataatactgtttctggcacacagtgctcagggaaaaaaatacttcattagagctgaagctcagatgtcaggattgaactattaaggatatctaaataatttgttgatgtcagtttctttttaatcctacacaggttaaaactagacacaaaggtacatttaaaagacttaaaattttactggatggaacatgatggaggctcatttttaatgtccaaagtggaccaagatctcattatgactcagaaaaaggtaattttaaataaaatttgtttaggaattatttttagtcaaagagatatccttctgagccctttacttcacttactgccaaatatttctgtgtcagcatacggaattaaggttttcagaacagttatactaaggaattttggatgtaatttttcatggttattttagatattttattttttagtaatgaaatgagtactttgaaaataaagtatgataaatcaaataaataaattgctcagaggtaactgtcattaataatttggtatgtatctatccagtgattctcctatgctaatgtgtagatgtaaattttaggtaatagagacaacattatatatgcaatcattttagcctgagctttattttaaaatacttttataatcagatgaaataatagcacaaatttgtctttttaaaagcaagagttcatttgggaaagaagaataataaggggaacagacctaccaaattttaaaagtaatttttaaactactattcaatktaataataatacagcttattacgtggaagcaatggaagacaaagaaggcccttacataatggtaaagggatcaattcaacaagaagagctaactaccctaaatatatatgcacccaatacaggagcacccagattcataaagcaagtccttagagacctacaaagagacagactcccacacaataataatgggagactttaacacgccactgtcaacattagacagatcaatgagacagaaaattagcaaggatatccaggaattgaattcagctctgcaccaagcagacctaatagacatctacagaactctccaccccaaatcaacagaatgtacattcttctcagcaccaaaccacacctattccaaaattgaccacatagttggatgtaaagcactcctcagcaaacgtaaaagaacagaaattataacaaactgtctctcagaccatagtgcaaacaaactagaactcaggattaagaaactcgctcaaaaccgcttaactacatggaaactgaacaacctgctcctgaatcactactgggtacataacgaaatgaaggcagaaaaaaagatgttctttgaaaccaacgagaacaaagacacaacataccagaatctctgggacacatttaaagcaatgtgtagagggaaatttttagcactaaatgcccacaagagaaagcaggaatgatctaaaattggcactctaacatcacaattaaaagaactagagaagcaagagcaaacacattcaaaagctagcagaaggcaagaaataactaagatcagagaagaactgaaggagatagagacataaaaaacccttcataaaatcaatgaatccagatgctggttttttgamaagatcaacaaaattgagagaccgctggcaagactaataaagaaggaaagagagaagaatcaaatagacgcaataaaaaattatgaaggggatatcaccaccaatcccacagaagtacaaactaccatcacagaatactataaacatctctatgcaaataaactagaaaatctagaagaaatggataaattcctggacacatacaccctcccaagactaaaccaggaagaagttgaatctctgaatagaccaataacaggctctgaaactgaggccataattaatagcctagcaaccaaaaaaagtccaggagcagacagattcacagccaaattctaccagaggtacaaggaggagctggtaccattccttctgaaactattccaatcaatagaaaaagagggaatcctccctaactcattttatgaggccagcatcatcctgataccaaagcctggcagagacacaaccaagaaagagaattttaggccaataaccctgatgaacatcgatgcaaaaatcctaaataaaatactgccaaaccgaatcaagcaacacatmaaaaagcttatccaccatgatcaagtgggcttcatccctgggatgcaaggctggttyaacatacgcaaatcaataaacgtaatccagcatataaacagaaccaaagacaaaaaccacatgattatctcaatagatgcagaaaaggcctttgacaaaatttaacaacacttcaagctaaaagctctcaataaattaggtattgatgggacgtagctcaaaataataagagctatctatgacaaacccacagccaatatcatactgaatggcaaaaactggaagcattccctttgaaaactggcacaagacagcgatgctgtctctcaccactcctatgcaacatagtgttggaagttctggtcagggaaatcaggcagcagaaggaaataaagggttttcaactagaaaagaggaagtcaaattgtccctgtttgctgatgacatgattgtatatctagaaaactccatcttctcagcccaaaatctccttaagctgagaagcaacttcagcaaagactcaggatacaaaatcaatgtgcaaaaatcacaagcattcttatacaccagtaacagaaacagagaaccaaatcatgagtgaactcccattcacaattgcttcaaagagaataaaatacctgggaatccaacttgcaagggatgtgaaggacctcttcaaggagaactacaaattactgctcaatgaaataaaagaggatacaaacaactggaagaacattccatgctcatggataggaaaaatcaatatcatgaaaatggtcatactgcccaaggtaatttatagattcaatgccatccctatcaagctaccaatgactttcttcacagaattggaaaaagctactttgaagttcatatggaaccaaaaaagagcccacattgccaagtcaatcctaaaccaaaagaacaaagctggaggcatcatgctacctgacttcaaactatactggaagactacagtaaccaaaacagcatggtactggtaccaaaacagagatatagcccaatggaacagaacagagccctcagaaataatgccacacatctacagctatctgatctttgacaagcctgacaaaaacaagaaatggggaaacaattccctatttaacaaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcaataccattcaggacataggcatgggcaagaacttcatgtctaaaacaccaaaagcaatggcaacaaaagycaaaattgacaaatgggatctaattaaactmaagagcttctgcacagcaaaagaaactaccatcagagtgaacaggcaacctacagaatgggagaaaatttttgcaatctactcatctgacaaagagctaacatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatactcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgagactgtaaactagttcaaccattgtggaagttagtgtggggattcctcagggatctagaactagaaataccatttgacccagccatcccattagtgggtatatacccataaagacacatgctattcacaatagcaaagacttggaaccaacccaaatgtccaacaatgatagactggattaagaaaatgtggcacatatacaccatggaatactatgcagccagaaaaaatgatgagttcatgtcatttgtagggacatggatgaagctggaaaccattattctcagcaaactatcacaaggacagaaaaccaaataccgcatgttttcactcataggtgggaattgtacaatgagaatacttggacacaggaaggggaacatcacacaccagggcctgttgtggggtkgggggagtggggaaggatagcattaggagatatacctaatgtgaatgatgagttaatgggtgcagcacaccaacatggcacatgtatacatatgtaacaaacctgcatgttgtgcacatgtaccctaagacttaaagtataataaaaaaaaaaaaaaaagacatgtaaaactagaagaaacttgattgtggtaaaagatggcttttatattctatctttgttttctgccaccatgaaaaaatgcctgtgactcaataacttataaagaataaaaatttatttctcacacacctgaagacaggaaagtccaagatcaaggttctggcaggttcagtgtctggtgagggccatcttactgccttctccagaggggagaaacatggcagaagggtggaagagacagctgctaaggctgcataaagcctttgtaaaaatggctgtaatggcattaactagggcagccctcatggcctaatcacttctttagggcccccctcttaataataatgcattagcaacacctgaattttggaggcgatctattcaaaccataggtcaggacatccaggccatcctggctaacacggtgaaatcccgtctctactaaacaaaatacaaaaaattagccgggcgcggtggcgggcgcctgtagtcccagctactcgggaggctgaggcaggagaatggcgtcaacccgggaggcggagcttgcagtgagtgaagatcgcaccactgcactccagcctgggcgacagagtgagactccgttaaaaaaaaaaaaaaatagcataagtggatacattactgtgttactagatttgaaagtcatgttataaaattatacgttatttttaaatctatagggaaaatgtaattcatataaaaactcagtggatttttaaatttctttttgtaatgcttaatgaggataaaagaaaagtgagatcttcataagttataagcccagaaacagaatttcttcctatattaatttttacgtgtattaagatagcttcacatatctgaattaataatatctaaatgaaagaaatcatagaaaatactgccaataaaaatgatagaggattattaacaggctataacctattataagagaaataccaccagggacataggtaaaggagaaaggtaaattataaaagaagttatataagtgaacaataaaaacacaagaaatgttaagacttataagtaattaaaggaaaaactatagaaaaattaaggtactataccttcgttgcttgggttgataaaccatagaatgctagtggcaaagcaaattggtactttcctggcgagctggaggataaatgcaaaattatgaagccaggagcaggaggaaaaaagtaagtgaatggaagtaaattacttacattgaacttttagtccaatgtaatttgctctcacagtagaattacctcccttcctgttctgtagctttagcaaaaattctaataacttaatgtacagactcttcattaccaaattctctagccaatttaatattctgaccccaaacccttccctttacggtattaaaaccatatttttgctggcctgaaattcatgtgtatgaaaagccaattttcctaaatgggttttttcactgttgatactaatcaagagtctcactgttattgaaactttctctgcagtgtcagaagtgacagtgttgcagacctcatcacctgttggcatcaggtagcagggagagctatcacagaatagtttagtttgaaataatagtttaaaatagtcacatgctaaaaaagagacagattgaaatacatgtgaattcatttaggagtttcatttcatattggataagtttagaacaggctctagtgaagattggtgtatggaatacaaggatctatactactgttgtatgctttacaagttggttccataagagaaattttataacctaaatatttttccagaaagcattttataaaattcagatgtctgtttctgattaaaaattattttttgccatactatgttctttttatattatatgcatgaaatccagggcaatctctttaaaatataaagttagataagcatgctaaccatcaccattattatttatagaaagtatgccaaggataaattagaaataagaggtatgactatgaaaaaagacaaatcaataattatttatagattaagatatgagtatattcttgtaaaactcaaggagtgctattttaaaactcttagaataaatgagttcaacctaaaataggatgtacgatgaaaatgagaaaaaccatagctaacatatcagcaataaccagataaaaagtagaatgaggaaaacagagaagacaaacagaaaatcctacaaaatgcctacagactctaaaaataaggttgtagaacctaccagagaaaaattacagaactttactaagagtcctaaaatgagttttgaataaaaaaagaaacttagttttatagcttgagttgttggtggatagatcccatagcctatataatccctgtcactgggattacaaatatcattccattttataaagttcctaggcacactccaaaattccatcacagtgataaatgcatttctgaaacaccaacaggcctgctgttctataatctgtcattgcataaattaatttatgtatctttgtttctgtatattttctgaaaaggaggaagtggaggaacatgagaatgagtgatgtgtgtatctgaggagggaggaggtaaatagagaaagacattattacatcattggaggtggggtaaggatgtgtgccacctccaccattcccaagctattgtcagaaaaataccatgttttaggacaggatggctatattttatagcaattaaaatcaaattagcaacttttattatggaagttgagaaaatgatgttaaggttctcctgtcagaataaatagccaagaagaaatgaaaacttttgactcaggagaataaaaatattaaggatttagtattccagaattttaatatggcataatacatttaaatatttctctaaagttaataactttatatagcaatttgaactttatccactttcaggttcaatataaagagggagcttttttgattttgtagcagaaactcaatagttgctaactgatgttggtctgtaattctttctaagtcagaataaaaggaaaggagttaggacatcaaactttgtgggggatattttataatccaggtctttttatcatttctatatttcctagcaacaccttacttttacctattttgtagaaaaatatgccaaggccttgtgtgctgttggatttttttattagcagattttatttttagaacagttatatatttaccaaaagattgagcagatagtacagtgtccatgggtagcccctctttctttcactagtagggtacatgtttcatgactgatgaaacaatattgatatattattaactaaactccatagtttacattagtgtttatattgtacagttttacagcatttgacaaatgcataatgccatgtaactatcattacaatatcatacagaatagtagtttttaccactcaaaaaacttctgtgcatcacttatttattcatacattctctccactcctactggaaaccacagattttttactgtctttatacttttgcctttcccctaatatcatatatttagaatctaaattatgtaaccgttttatacttgcttctttcacattgaaatacgcatttaagttccctccatgtcttttcgtggcttggtaactctttttatctctgaataatatttcattttaaggatgtgccaccattttttacctatttacctagtaaaggacatcttggttgtttcaaaatattgttatctttgaacaaaagctgttataatcatttatgtgcaccttttccatagacatgttttctattcaattaggtagtaccaaggaacacaatatactttgctttgttagaaatcttgagattgtcttccaaagtgggtttgttatggtactcnnnnnnnnnnnnnnnnnnnnnnnnnnnnnnnnnnnnnnnnnnntggagtaccctaattttagtacccttacacacacacatacacacgcacacacacacacacctacacacacacacacatatatatatatacatatataatatataatgactaatacaaatgaaagtttgtaccctctgaccaatatagctttatttcatccccttaccccaccccaattcctggcaactacgattctactctctacttctaggaatttgacttttttagattacataaataaatgatattataaaacatttgtttttctgtgtctggtttatttcacttaacataatgcccttcaggtccatctatattgttgaaaattgcaaaattttctatacttttaaggctgaataatattccagtgcatgtatatacagcattttctttatccatccatcaacacacacttaggatgttttaatatcttagcaattatatataatactgcagagaacatgggattgcagttacttcttagagatcctgatttgaattacttcaaatatattactagacgtagcattgctggatcatatggtagttctatttttaatgttttgaatggctgtacaaatttacatttctaccacagtgtacaaggtttcccttttctccctgtcctcaccaacacttacctttaaaaaaaaataatagctatgctattgggtgggaggtgacatctcatcttggctttggtgtgcattcacctgatgattagtgttgttgatttttttttttcatatacctaggggccagttgcatgtctcctttgaagaaatgtctattcaggttgtttgccaatttttcarttaagttatttgtttctgataagttctatgaattccttgtatattttgaatattaatcctatatcaaatatatgttttacaaatgttttatcccattcagtaggttgcctttgtattttatattgttttctttgtgtgaaaatactttttagtttgctctaaaccaatttgtctatttttgctttattagcctgtgctttcggagatacatgcaaaaaacaattgccaagaccaatgtcacggagctttttctctctattttcctctaggaatttcacagtcaagtcttatatttattgtactttattttttattattttagattgaaagggtacttgtgcatgttgttaaatggatatattgtgtaatggtgaagtttgggcttctagtgtaccagtcatgcaaacagtgaacattttatcccacaggtaatttttcagccctcatctacctcccacccttccatatttttgagttgccagtgtcaattatttctgcctacttgtccaagtgtatccattgtttagtttccacttataagtgagaaacagactttctgtttctgagttgtttaacttaggataatggcctcaagctaaatccacgtggttgcaaagggcatgctttcattttttatggccgtatagtattctgtggtgtttatatatcacatttctttatccagtcaaccattgataaaaacttaggtttattccatgactgctattgtaaatagtgttgcaataaacacaacacacaagtttaggtgtctttttgatataataatttttttcttttggttagatagtcaggagtggaaatgcagtgctgaatggtagctttattttggttctttgagaaacctccatactgttttccacagaaattttactactttacaatatgccaacagtgtataagcattcctttttttctgcattctcgccaacaactgttattttttaccttaaaaaatagccattctgactggtgtaagatggtatctcattgtggttttaatttacatttctctgatgactagtgatgttgagcaccttttcataatttttttttgtagctaattgcatgtcttattttaagaaatgtctattcatgttttttgctcactttttaatggggttttttttgttgatttgttttggtttcttgtagactgtggatattagaccattttcagaggcataatttgcaaatattttcttctcttctgtagtttgtctttttgctctgttgattatttcctttgctgtacagaagctaaaatagtttatgttccatttgtgtacttttgttttcgttgcatttgcttttgaggtcttagtcataaattatttccctcaatgtcagaagttttttctatttttttttcttaggatttttcttgtttgaggtcttacatttaagtcataaatgaaacttgagttcatttttgtatatggtgagagagaggggtccagtttcattattctgaatatggctagccaattttgccagaactctttattgctattcagtaaagcaatatttcatatcctttcttcactgtttatttttgtcaactttgtcaaagttcagttttttataggtatgtggctttatttcttgrttctctatttggttccattctatgtctccatttttttaccattaccatacagtctttgttactatagttttttagtatattttgaagtcagataatgtggggcctcttttttctttttatgaaaaatttatttggctcttcaggctctttttttgttttatatgtattctaggattttttttctaattctgtgaaaaattatctttgtaatgataggagttatgtttagtctgtagattgctcttggcagtatggtcgttttaactagtgatacttccagtccatgagcataagatctttttctrtttctggcatctatgatttattatatcagtgttttgtatttctccttatagtgatctttaacctccttggttaaacatatttctagtattttatttttgtaaatggctagtgtaaatgggatggaattttttatttgtttcttaggtttaatgctattggtgtatcgaaatgctactgactttatttacattgatttggtatcctgaaactttaccaaaattgtttatcaaatataggaattttatgtaaagtctaggttttctaggtatgtcatcagcaagcagagataacatgactacttctttttaaatttggatccctttcctctggctagaactgccagtactatgttgaataggagtggtgagastggagatccttgtcttttttcagttcttgttttttttgtttgtttgttttttgtttttggcaaaactatttccttttattctgtggaacgtcactaacgtaaatagacatgtgcatgatttatgttaatttatacacgatgagaattaaggctgaaaatgacatccgggaaaactcctactattagtttcagatcttctgggcaggggctgactcttggctgccttatacttcctaactcccagtgggcctgaatagacactggccagattttcaaagtagcttcttgaagatggatgatgatctgtttagaatgatccattcacctgttctgtttcagggtccaaatcagtatcataaaaacagggctgggtggggagtccattgtgctcatcgttcctactaaagggtacagaaaaccagccccgatgytggcatggatgttgcgaatgggcagaatgaatcctgtagggacaccttttcgctctgggttgtgagacaaggacaagtgtgttttggccatgcagatggggagattcccaaagccctgctttgtgtagacttcagctttgtgttgagctttgaggagtaattcaatgttgtctgctccatagatcttctgtgcaatgatcctgattttatcctcaactgggagcttgaggtcataaaggagttggaagctgctgggtgcttgtcctgctctctggacagcctgagccagggctaaggtacccttgcccccttctgccagtgagtgcacttcacggcatcaaaagccctctgttctctggaaaggcagccgatgaggtccagctcagtctctgtatctrtcttgaatgcattcacggccactactactggaattccaaacattctggcattttcagtttgtttcttcaagttactgaagmctttttcaaccagctccaggttctcctctatgtaagccttgggaagaggcattccagcagtgaccatagggccacccctgtgcatctttagagygctgacagtggcaacaagcaccaccacgtgagggtggagaccggaatactgggatttgatgttaagaaacttttctattccaatgtctgctccaaatcccgcctccgtcactacaaacccttctgggccaacaagctagagtgtgatccggtctgcaatgatagaggaattgccgtgtgcgatgwtggcaaatgggcctgcatggacaaacactggagtgccctccaatctctgcatgagattgggcttgattgtgtccttcataagcactatcaatgcaccactcacccccagatcttcagcactgacggggtctcctttcttactggatgccaccaccattttgcccagtctctctctcctgtcttctagagaagtggtgagagccaggacagccataatttcactggccacagagatatcaaagtggaccgtctgtgtgtgacttttcttcgttggagcctgtccaatcgtgatcttcctcaggaatctatcattggtattcaacactctttgccaagctatggtttctggatcaatgtccaatcttgcaaatctgtttatctcttcatctgtcagtgtggtagagtcagtcttgtcaatgcctagtctgtttaacctttgtatgtggatatcagagaactttctcactccatttactgatggcaccaaatgagtaaaggtagccttgtctgtctgggtcagttcatgaaatatctgagcatcaatagccgcagcaacaaggttattagatacagtgatggcatggatgtcacctgtgaggtgaagattaaactcttccataggaatgacctgggagtagccgcctcctgcaacaccaccttttattccaaaggtggggccctgagaaggctgtcgcacacacataaaaaagttctggtaaagatgggcaagaagggcttgcaccagcccgattgtagtcgtgcttttcccttctcccaggggtgttggagttattccagtcaccacctgatatttcccaacaggctggtgcttcaggcgttctagtgctgacagcagaactttggcctttgtttcaccatataattctacctcttcagacagcagaccaattactcaagccagcttaccaatgggcttcggtttacaagatcgtgatatatcaatgtcacttggaacaggtgtcttgaggttaaggttgttatactgaatcatccactttcctggcttaaatttctccaggaaaygcttggcactctctacagtgctctgcatgagcattgcaaccgtcatgagccctaagccaccaggaacgggcctcgtcgtatgccacatcacccacaacttttctcccatttgttttttttatcatctgggacataattgattccacagttgatgactattgctaggtttgatccattcccctttaaccatttcaggccraccagttgcaaccaccaggatgtcgcctttatttacctcctcatccagattggcagtcttggagtggcaggtggtcactgtggcattgttccacagaagcaagtcacrcatcagggccctgactattttactgcacccaaccaccacagcatgccttctggcaatctgcacccctgtctctttcatgagttccaagcatcctttaggcatacaaggaatgaaacagtcatttaggtcacctctagcaagtttcccagcactgatgctagtcaatccatccacatccttttcaggtgcaatagcattgatcactccttcagtgtattgtctgagtctagagatagctgcactacgaaccygtgtacagtagagtcttcattcaaagatatgatgtacttgatcacctcagattctgtggttgttcttggtaacttaatgtcagtggctttcatcccaatctcttcagcagccttcagcttcacattatataaagattggaatcatctctgttgccaacctgtaatattgccaggcctggtgtgaaaccaggtacttgtccttcaactgagtgacttgattcttcagtctcgcccttatttgtgcggagatctccttcctgttcaggatttctgctggtgccatggcctttattagtctgctgcccacgatggacaccaccaatatcctgttcagttcttaggaggaatgctttaaccttatcctcattcagtatgatgttggctatgggtttgtcatagatggcttttattaatttgaggtatgtatattaaatgcctagttggttgtgaagaaatgttggattttatcaagtcgtttttcttcatcaattgagatgatcatgtagtgtttgttttttattctgtttatgtggttaattacattattgatttgcatatgttgaaccatccttgaatctctggtatcaaacccacatggcttgatgtactgtttgtttaaatttgctaatattttattgtggatttatgcatcagtatgcaccaggtatgttagcttgtaaggtttttttattctttccttgcataatatttgtatcaggtgatactgctttcatagaatgagttagagaggaattgttcttccttgattttttggcataatttaagtaagattgggacaagttttttgtatgtctggtaaaatccagctgtgaatcaatctggtcctgggccatttttgttggatattttgtattacagattcaaattcattacttgttattggtctgtttaggatttccatttctttctggttcaatcttgggaggttgtatgtgtccaggaagtatccatgttttctaggttttctagtttgtgttcataatagtctctgatgatcttttctgtttctgtgatattggttgtaatgtcaacactatcatttctgattgtgtttatttgagtcagctgtcttctcaattaatctagttggtggtctatcaattttgtctatcctttcaaagaacaaacttttcattttaatgattgtataattattttaatcttaatttcatttagtgctgctttggtgttagttatttcttttattctgctagctttaggtttagtgttttttttttttttttcttgtttttctacttccttgaagtggagcattaggttgttagttggggatttttctctcttttggatgaaggcatttaatgccatgatttttcctcttaatactgctattgttgcatcccaggagttttggtatgttgtgtccccatttttgtgtttcaaaaatattattttatttctgccttaatttcattgtttacccaaaagtcatgcaggagcaagttatttagttcccatgtatttgtgttgttttgagagttcctcttcatatcgatttctacatttatcccactgtggtccaattagatacttgatataattattattttttcaagtgtattgagccttgctatatggccaagcatgtagttaatttgggagaatgttctatatgcagataagaaaatgtatattctgtcatttacataacattgtcaaatgttgtgtaaatatctatgcggttcatttggtctgggtccaatttaagtccagagtttattgatttcctgccttcgtgatctgtctagtattgtcagtgagttatttacgtttcccactatttttgtattgctttctattttcttaggtctagtcatatttgttttatgaatttggtcttccagtgttgggtgcatatatatttaggatagttatatttctcattatataatgcccttctttgttttttgtttacttttgtttaaagagtagctcagttttctgttccatttgcgtgatacatcttcttcccccttttgctttttgtctgtaaccattaggtgggtgtcttaggcagcagttagttgggtcttgctttttcatccaatatgccagcctatatcttttaagtgcagtatttaggccatttacattcaatgttagtactgatacatgaggttctgtttctgtcacactgatgttagctatatgctttgtagtctcaatcatgtaattgccagataagatctgtgagttttgctcatgtgcacatgtgacatgtgcttttatgatgtcagtgtcatttttttgtttccatatttagtacttctatgagcatttcttgtagggctggttcaatgatgaattcccttagcatttgcttatctgggaagtactttacgttttttcatttataaagcttaattggcaggatataaaattctttactggcattttttttttcttcacagaggctaaaaacaggctctcaatctctactggcttggtaggtttccgctgagaagtccactgtttgactagtgggatttccatcataggtaatttgatgattctctgtagctgctttttttttctttttttatttattattatactttaagttcgagggtacatgtgcacaatgtgcaggtttgttacatatgtacacatgtgccttgttggggtgctgcacccattaactcgtcatttacattaggtatatctcctaatgctatccctcccccttccccccaccccacaacaggccccgatgtgtgatgttccccttcctgtgtccatgtgttctcattgttcaattcccacctatgagtgagaacatgcggtgtttggttttctctttgcaatagtttgctgagaataatggtttccagctttatccatgtccctrcaaaggacatgaactcatcttttttatggctgcatagtattccatggtgtatatgtgccatatgttcttaatccagtctatcaaaaggatctagaactagaaataccatttgacccagccgtcccattactgggtatatacccaaaggattataaatcgtgctgctataaagacacatgcacacgtatgtttattgcagcactattcacaatagcaaagacttggaaccaacccaaatgcccatcaatggagctgcttttaagatttgttttttcacattgaacttggataatcaaataattataagccttgatgatattaatcttctgtaatatctcacaggtgttctcagaatttctggtatcgggatatctacaactctaacaaaatcaggaaatgtttcctgaattattccgtcaaatatgttttccaaatttcttactttttcttctccctcaggaatggccatgcattgcggatctggttgctttacacaatcttatatttcttgaagatgttgttcatttaactttttttttttttgcagttgcaagatttaatagactgaaacagagctcccataaaatgggaggtgacccaaagggggttgtcgctgccggctcaaatgtctaggttttatatcccgatcattgtccctccctctgtgctctcaggtgatagatgattggctatttctttacctcctgttttaacctaattagcattttagtgagctctctttactagctgactggtcgggtgtgagctaagttgcaagccctgtgtttaaaggtgggtgcggtcaccttcccagctaggcttaggaattcttattcggcctaggaaatccagctagtcctgtctctcagtcacaccctctcaacaggaaaacccaagtgctgttggggaggttggctgatgatcgctctaattgcttcctgctgaattggggcatagtaggcatcatgccattgagattttctttggaggggtgcctttgatgttatcaacatccgagcatggactagcaggccggtccaggaatccacggtagatcttagtcatggactgcaactggggctccatttgaagaatgatttgtagttttacagcttcgattctggaagagacaaacttaacaaggaggttaaagatacagggattgaaatgtgtgtcctggcagtgcaggggatttgtatggcctgcagtgcaggggattatttctttggcacacttcacaggccctgactatctgcttgatagttttgaaaaggcctggtccagtaaataataatttggccatctgatgggtgctatcaatgcctaagtgaaaggtttggtgaagggtttaaataatttccatgggttagctgcagacaaaagtattttcccttcttcagtggctagccatcctgaggggaggaaactatgtccttgtgaggttccccattctctttctcttgctgagtactggggcttggttttctggaggggattaccccatactaggggtccttctataagcatttcttatggagggtcctgccttgtggctcttttggcttcaatatccacttggcggttcccttctatttcccttttctttcctttctgatgaccccagtagtgtaagattgccacctctttagatttctgtgcagccaataataatctcctaatggcttcctgatgtttgataggtgttccttcagaagttaagaattccctttctctccatattgctgcatgggcatggaggactaggtaagcatatttagagtctgtatatatatttacccttttcctttctcctaattctagcgcctgagtgagggctattatttctgccagctgagcactagttcctggagtgaggggattactttcaagtattccattatcactgaccactgcataatacrctttttaaagtcctttttctacaaagaaacttccatcagtatacaatttgaggtcggaatcagtcaagggaacctctagaaggtcccctcgagtggtgtaggtttgagcaattacttgttgacagttatgttctatttttcttcattttctggaagaaatgtggctggattaagagttgcacaggtgtgcagttgcagcactggtccttcaagtaataaagcctgatatttaagcaaacggttgtctgacagccacaagtcttctttagcaatgagtatgccattcacatcacgagatgtccacacagtaagatctcttccytgtgtcattttaactgcttcagatactgagactgctactgctgccactacccataaataatgaggccaaccctttgccactacatcaatttccttactcaggtatgccacaggttacaagctggcccctcggacctgtgtaaggactcctagagctattcctgctttttctgtgacatataaagaaaagtcttgccctgttggcatgcttaacactgggacttgggttagagccttctttagggcccggaaagccacttctgcttcaggtgtccatcttactaaatgggtattggctttccgagttttcttaattagtgtgtataatggcctggctatttcactgtacctgggaatccatgtttggcagaagcctgttatgccaaggaaccctcttagttgctttagggttttgggatgaggataagccagtgtaggctgaatgcatttctcactgaggaccctggtgcctttggataattttagacctaagaatttaacctgctgttagctgagctgagcctttggtttggaaaccttgtagccacaggtggcaaggaaatttaagaacacttgggtggggctgggcgcagtggctcatgcctgcaatcccagcaccctgagaggctgaggcgggcagatcacaaggtcaggagattgagaccatcctggccaacacagtgaaaccccgtttctaccaaaaatacaaaaaaattagccaggtgtggtggcgggcgcctgcagtcccagccacttgggaggctgaggcagaagaatggtgtgaacccaggagacagagcctgcagtcagccgagatcatgccactgcactccagcctgggcgacagagtgagactctgtctcaaaaataaataaataaaaaatttataaaaagaccacttgggtggcttgatggcacaaggtttctgaacgggcagctaaaagtaaatcatccgcataccaaaagacaagagtgtccaggtatgagaactggctcaaatcttgggctagtgcctggccaaatagatgggggctatctctgaacccttgaggtaaaacagtccaggtgagttgagacattgggtttgaaggatcttcaaaggcaaacaagaattgagagtcaggatgtacagggatgcagaaaaaggcatccttaaggttcaggactgtaaaccactctgcttcctctgacatttgggaaagcagagtataagggttaggtatagctggatatagagggacaacggcctcattgataatcctgagatcttgcactaaccttctctgtccgttgggtttctgtactcctaaaattggagtattgcaggtactactgcatggttttactaggccttgggcttttaggtctttaacaatcttttggaatccttgttgggcttcgggtctaagggggtactgcctttggtagggaaaggaggtggaatcctttagtttaacttgaacaggacaggcattctttgctcatccatagtgtccttctgttgcccaggcttcaggattaattccttcctcaagcaggggacaacaaatgggtgttccttctcctatgttcaggtgtatagtggcccctgcttttgctagaatgtctctccctaacaagggagtggggctttcaggcataattagacaagcatgtgaaaagagtaaagttccccagtcacaacttagtggctgggagaagtatctagtgactggctgtcctaggaccccttggatagtgacagatctggaggacagttgtccrggacaggagagtaagactgagaaggctctgccaatgttcaggagacagttaacctcctggccctcaatgttcaagcatacccggggctctgtgagggtgatggcattggctggctcttgcccagggcaccctcagtcctgctgctggatcatctggttagtggcttctgactcagaggaccttcgtcccctggggcagtgggccttcccgtgattcccttgacataaggggcatggatgagggggcagcttatttctactcagacaatctttttaaagtgtccttgtagaccacactggaagcaagccctattaggcactcaatttgcccagcttttccgtgttccagagcctccaaattccacttgcctgagtgccatgactaaagtggtagcctttttcttatctcattggtcctgttccacctgttcctcctgatctctattataaaaaactgaggttgccaactccattagggtttctaaattttgctccaggcctaaggcagacttttgaaggtttttttctaatgtctgcagctgtctgagtgataaacttatcctttaagattagttagccttcaatagagtcaggtgacagagaggtatgcttcctcaatgcctccctttgtctctccagaaaggaagtaggattttcttcctttcctgtgttatagtagacatcattgaataatttataggcttcttcctagttttccttagtccttctaacacgcaagttagcaaatgtctgtggcaccaatctccatgttctgattctgcatccctctgagggtctacactgggaactgcctggtggcagaattgttctgwggggaactattctctttcctctgttgtcatcctatcattgacctgactgagataccagagattgacaaactctcgggctgcagttatggtggcacttctctcatatggggttagtgtctgatctagcagtaacattatatgtctccatgtcagatcaaaggattgtcctaacccttgtaaaacatcagtatagccatcagggttatctgagaatttacctaggtctattataatttgcttcaagtctgagaggaaaaaggcacatgcactctgactgggccgaattctccagaatacatcttaggggcatttttgccttggggggaagtttcccatctgaaaaaaacaaacaaacaaacatagggacgccagcacccctagtaattttccaatggacattagtcttacagcgtcctctgtggtcctaatgcttattccttttcaggtcacccatagacctctgcttattggattagttacgctcactgatgtagcagtcctgcacctgttttcctgcctttcttgaccacaaagaaaggggtctgggctgctggattctagtggtcctttaccagcaagcctgacattgcctttgcactcaggggcgagttctaragctgggctgggttcctgagtatttcataataacccatttgccccatcaagatgcattcctacaaacaaccgttcttatgcaaattcatttcagagagggtgtgggtaaccttttgagtcaggattgagatagagttttttgattctgtaagtattttaaggcttggctgagtgcaaacagctcgcacgtttgagcagaccaattattaggcaattttcttaactctgcttctacaagagtttccctcaattattgaatacccattgtgttttttyctcaatcacctgggaggaaccatctattgtcctgtcctgaagggagtccctcctaggtctgttcagacatttgtatggtaattaagatttaaatcccctgttaggaaatctgctgggttaacggaattttctgtggttaatgttaaattatctttctctaacagaatagccccatactttaagatttttaagttagtaagctacctttttgcttttttgacttaggatagttctgaactggtgaggtgtgctcacaatgaggtttcctctaaaggctaattttctactttcttctgttagcaaagcagttgctgctacagaatgaatgcatttgggccatccacaggttcctgggttaaagattttttataggaagtctactggttatcagtggcctcagtgctttcaggctacatccttgtttacactgacaacaaagtggtattggagtgttatagggtcatggagaaaactttcagttatcaattataggttttaaatttaccctggcttttaaagaaatagggtacactattttttctttactacttctatctttctctttctctctttctttctcctttctgtctttgtagatggattttggaaacagtggaaggacattcgctcattgcccccatttgccactatatgaatatgtgcctcccttttatttactcaatttgctttcatcctgatctattatgttgttgtagacccagttccagttgttaaagtactgggttatcatttctaaggccctgacaagggtggtagggaatgggtcccacataactgctcatgtcaagagttgtatgcctaaattgggagggacaccagcgacaagactccctgggttcatagcctaggggcctaaggatgcagcatagatcttccttagatccctttggagatacaacctgctgtaatacttgggagaggaagtgaaggtctgaagcattagtatctaggaggcagggagaggaggaagtagattcagaggtaatgagaattttggggctactctttcaggaaagtcgtggtccagacccaggaggtatgggtcagaaggaaaggtaggggcacacgcatgggtgactgttgagtagagacttctggctgcaccatgatctcaaccggctaatgccgggagttcaggatgacagctttctgcctctagtcggccctcagcttccccagaaaaattgaaagcagaagctggttccaggcagaccaacactcccaacacagaagggttgggggttgttagaaagccctttcccagacagcttcccacctgagtcttaagttcagtggccatgctaatcgtttttaactggctgacaggtgcctggtattttcctccaattctaaggaaggataggacagaatagcaagcaaaagtagtccaatattactcaccactttggaggtcccttcatggtcaccaaatgttaccgggggatccttgctcccagagctcccaagatggtggcgggccacttcaaagatggtggcaagcctcgtgttctctgacctggggttcttggcctcacagattccaaggaatggaatgttgcaccatgcagtgagtgttatagctctaatagaagctgtgggtcatggaagagaaccatggaacccagcaactagtgttcagcttgataaggacgaacccaggcacttagccatgcaggaacagtggtgagtctttagcccgattgggagcggcaatgggcacctcgctggatcagtagtgtggcagacaccctgccagatccagagtggtggaagtaagtggcaagtctgcgatggcggcaaacagcagtggtggatggtgagtgaaagctcagctccagctgtatatcagagctcccataaaataggagggggcccaaggggggttgccccattttttaattttttaaaaaaatttttctctgactgtgttaatttaaaagaacagtctttaagctctgaaattctttcttctgcttcatctagtatgtcattaaagttttcaactgtattttgtaattcatttagtgactttttaatattcagaagttctggtttttcaatatatttatctcatctttcatatcctgaatttttaaaatttattttggttttcaactttctcttgaatctaattgaactaccttacaatctatattttcaattctttatctgtcatttcaaagtgttcattttggttaggatccattgctatggatatattgatgtcctttgggggtgtcaaaacaatctcccttattgtactgccagagttcttgcactggttccttctcatttgaagcagctgtcacttcttagttttgaaattgccattgtacagataaaaattcctcagtggtttgactgtaatggatgtcatgtatgaccttttgcctccatatctgggtgctttcaatgtgccaagggctctgtatgagttctttggctatatataacttttgtgtcgtggctttctcaaatgctgcttatcrtaatgatgcattggccatatgatctggcacactatcttctgtgagctgggagtgcagagctctcagaaagcttatcttgcacgttagcactatgctgtgtcagcaggtttttatttggtgggaagtttgctctacagtagagtaggggatgcgtaagagccagcttaccctggggtactctaatgaattatggaaacacccaccctgatggggacggtagagggagtgtttggtttgatatgctgagatcttaggggagggggctgcaccagcaacttgtcctggacaggaaggaacataatctgctttcctataatgcccctgacacagggatcataaccttcagttcagatatatgctgtcttttatctctagtccacaatgtgactgaggtttgcaggaaatgcccatctgccagttactgccaaaattgcctttgggcagacgtcttcctgcagcccaaaacatacagttctgtggctggtctgcactctgtggcagggatgctaccactctgtgtagagagaggaagatgaaccccagtcattgtttgagcccaggtggtgggcacacattcagtgtggatggagccactattaaaagtgctagacgarcaaccacaaagtgcacttgcaccagcccccagtgggaaaagccttggctgcatctgtggcaatagatggggtggcaggaggtgatctctctacatttgttgccagtcactagtgctgcccatccactgagacagaaccatactctctcctgcattggagatcagcattgtacctgtgtttcctttgtcccaagtggtgctttggagggctctgctccccattcccataatggtggctcatgccaaaggctagatctctagggatcctgcagttccctaaggatctagtgatcctcttatttgtcgaagtcagagcagattctggggtatgtttgcagggtatctgttgatgcagtgaaataagagctgagattccatgggcaagatggtggcttatactgggtgcaaaacctttatggcaccttccacctgaatttgggttgaggaatcatgtgagtacaactgcaggagctcaccaaccagtgttctgcccccaggaagttcccacataaccattgagagtgttactcaggctcatgagggcagaggaactttccaacaatttsttggtcagcattctgtcacatgggtgaggggagcaaagtaataccctacctaacctgtccatggaactccaagctttttgggggccaatctctgccagatttttgctgcctttcttttctgtaccctagcttattctgtagctctctgagagtttttggcactcttccctcagctttccactcggggtgactgctcacccataactttgatctcttttatgaggagaactggcatttggcatctctagtcagtcatctaatgggaagcctggaaggggctcgcattggagaagctgctccaaactcgaatcagaaagacactaatttccttgtctgagaactggcaagtcttatgtttaaatcttcgatcyattttgagatgatttttgtgtatggtttaagataagggattaatttcattcttttgcaaatggatatccagatttcataaaataacttattgaagagattgttctttcttcactatgtattcttgttacttttgtcaaaagtttcttgactttatacacatggatttagttttatttgctttcaattctattcaggcaatgtgtctgttttgatgccaataccatactgttttgattactatagctttgtaatataattttaagttaggaagtgtgatgcttccacattattattattattattattttgataaagattgcttaggctattcatggctttttgtagttccatacaaattttaggattatcttttctatttatgtaagaaaatttcatttgaattttgatagcaaatgcattgagtctgtagatctggctgttaatgaagatattaacaatattaattttccaatctgtgaacatggaatatctttccattcttttctgcctattttaattttttcatcaatgttatatagttattaatgtacagactttctcctcttggttgaacttatgtgttagtattttaatcattttaattctattgtaaattagattatttcctgatttatttctaacattttatgtgaaatattaggatttttacgtatgagaacatgtcatctgcaaacacaattttgcattttcctttccaatttgcatgctatttatttatttatttatttatttatttatttatttgcctcattgctctggctaagacttccagtgacatgttgaatagaaatagccaaagtgaacacctttatcttattccttatgaggaaaagctctcagcttttcaccattgagtctgatgttagctgtgggcttgtgatatatgaccttgattgtgttgagatacatttcttctgtacttaatttgttgagagcttttatcacaaaaataatgttgaatcttgtcaagtgtatttttctttacatgtaatgaaatgatactatgatttttatccttcattctggtaatgtggtgtgtcatgtttattgattttcatatacagacttgtgtcccttaactatgggatacatttgtagaaatgcattgttagacgattttgttattgtgtgaacaatatagagtgtacttacagaagcatagatggtatagcctactacaaactttggttatatagtatagtctctagttcctaggatactaacatatacagcatgttactgtactgaaaattgtaggcaattttaatacaatggtaagtatgtgtttatccaaacatatataaacatataaataatactggtattataatattatgcgaccaccatcataaatatggttcattattgaccaaaacatcatatgcagcacattgttgtattaaaacatctatgcatcccagggatgaatctcaattaattgttttgtattatccttttaacatggttgaattaggttttctggtattatgttgaagatttttgtgtttatgttcatctcagatatttacctgtaattttattttttatctggccttgatatcagggtaatgctgggcttgtagaataggtctgtaatttttttcctcctctttgatttttctgaagagtttgaagatcgtcattaatttttctttaaatcattggtaaaattcactagtgaaaccatcaggttctgggcttatctttttttgggagagttgattacttatttaatctttttattcattattggtgtgttcagactttcagtttattaatgactcagcctttgtagtttttatggtgtaggttctatgtttctaggaatttacttatttcttataggttatccaatctgttgacatataattgtttatattagtctcttacaattttttacttctatgtttccacttgttatgtctacttgtttattttttattttatttatttgagtcttttctatgttttcttaggtagtccagctaatgttttctcaatgttgttcttcagttttttaaaaaaaatcttagtttttttcagtattacattatttctactctgatatttattattttcttccttatgtttactttgggcttattttggcctcttttctagtttcctgaagtgtgatgttaggtattttatgtgtattctttcttgtatcctaatgtaggtgtttattgccataagtgctcccttagaacagcttttgctacaactcataatatttggtgtgttgtgtttttgttttcatttgtccaagatttttttttaatttccttttattagttgacccattttttttcagaaggatatttgtttatttctacataatggggagttttctaattttctaaattgatttttagtttcataacattgtggctgaaatgatacttcatacgattttgatgtttttaaatttggtaagacatgtattgtggcctaacaaattgtctgtcttggagaatgttccatgagcacttgagaagaatgtgtgttctgctgctgctagatggaatattctttatattccagttgggtcgatttgttctcaagtgtagtttaagtccagtatttccttgttgatattctctccagatgatctatacattgttgaaagtggagtgttgaagtactgtacaattattttgttactctcttcagatctattataatttgctttatgtagctatatatatctcatcaacattggaccatataactatataaagcaaattgtaatatcatcttgaataatagactgttttatcattatataataacctcctttgtctcttgtgggccttattttttacttcaactatatyttgcctaagtatagccacctctgttactttttgatgctgcaatttgcatggaatatatttttctatctctttattgtattctgcacctctagaatttcttttcctttctcttttatttaattgtttgtatctctttgttgtacttctcattttgtttgtgtatcattttcctgaattcatttagttgtctctatgagttttcttgtagctcgctgagattctttaaagtgattattttgaattctttgtcaggcaatttgtagttctatatttctttggggtcagtcactggggctttattttggtccttcaattctttcatatttccttgatcctttatgttccttggaggcttggattgttgtcttcacagttgaaaaagcagttatcttctctactgtttataacaggctttggggaagaaagatctttaccagtgagcccagccagatattctgggaggcgttcagaccttttccatggatgtgccttcttcactcttcttaattattcttagggggaaagactgagtattgtttaccttctctctatgctgcaaagcgagacctggtgctctgaccatcccatttattttccctaaagcagtgtgtcctgagttgttcaagtttatatgccctctctcaatccagaagattcaagctgactgttaagattctgacctgattatgagatccatatgctatttattgttctcatgtgagtcatgcacagagatgtgtggggtgctttccactggggaggaaggaagcttggggcacatgttggctgcgtgtggggtcctcaggtaagtcaccctgcagggcttatggacaattttcttggtggagtccatgtactggtaagtagtattcatgactgattattgtgtattgcatgctggctcttatgtgtttcctctccttttcactgctcctagttaactgcagagaattcagctttgctgatgtactctgttttgagtggggcaagagagaaggtcatctcctgggcagtattctgcatggccggggaagctgtgtctccaactttaatttgtgggagaaatttccttttccttgggcctcttttggcaccaagctctgttaccttagggtagaggtgatacagttaatgggaaactacttctcttaccctcttcaacatatttactcttggagttttttgttccaccagggtgctacacctagaatcgaaagctcccacaacattattatttttaatgaataaattaaattatttttcayctgcaactattcctatgggagtattactcttttaaaattttctttatcttaacagatacatactagttgtacatatttatggggtacatgtaatatttcgatacaagtatacaatgcataatagtcaaatctagtaattgggatatccattgcctaaaacatttattattactttgtgttagtaatattccaaatcgactcttctagttattttgaaatatagaatacattgttgataactatagtcaccttattgtgataccaaacactagattttattctttcttttttttaaattatattttaagttctgggatacatgtatattttaagttctgcggaatgtgcaggtttgttacataggtatacacatgccatggtggtttgctgcacctaacaacctgtcatctaaattaggtatttcttctaatgctatccctcccctagcaccccaccctatgacaggccccagcatgtgatgttcccctccctgtgttcatgtgttctcattgttcaactcccagttatgagtgacaacatgcagtgtttggttttctgttcttgtgttagtttgctgagaatgatggtttccagctacatccatcttcctgcaaaggacatgaactcatccttcttttctggctgcatagtatttcatggtgtatatgtgccacattttctttatccagtctattattgatgggtatttgccttggttccaagtctttgctactgtgaacagtgctgcaataaacatatgtgtgtgtgtgtctttatagtagaataatctataatcctttgggtatatacccagtaatgggattgctgggtcaaatggtatttctggttctagatcctcgaggaatcaccacactgtcttccacaatggttgaactaattgatactccaaccaacactgtaaaagcgttcctatttctccacaccctctccagcatctgttgtttcctgacttgttaatgatcgccattctaactaacatgagatggtatctcattgtggttttgatttgcatttctgtaatgaccagtaatgacgagctttttatttcatatgtttgttggctgcataaatatcttctagtgagaagtgtctgtttatatgcttcacccactttttggtgaggtttgtttttttcttgtaaagctgtttaagttccttgtagattctggatatcagccctttgtcagatggagagattgcaaaaattttctcctattctgtaggttgcctgttctctctgatgatagtttctttgctatgctgaagctctttagtttaattagattccatttgtcaattttggcttttgttgccattgcttttggtgttttagtcataaagtccttgcccatgcctaagtcctgaatggtattgcctaggttttcttctaaggtttttatggttttaggtcttacatttaagtctttaatccatcttgagttaatttttgtataaggtgtaagtaaggagtccagtttctgttttctgcatatggctagccagttttcacagcactatttatttaatagggaatcctttccccattgcttgtgtcaggtttgtcraagatcagatggttgtagatgtgtggcgttatttctgagacctctgttctgttccatttatctatatgtctgttttggtaccatgctgttttggttactgtagccttgcagtatagtttgaagtcaggtagtgtgatgcctccagctttgttcattttgcttaggattgtcttgactgtacaggctcttttttgtttccatataaaatttaaaatattttctaactctgtgaataaagtcaatggtagcttgatggggatagcattgaatttataaattactttgggcagtatggccattttcatgatattgattctttctatccatgagcatgggatgtttttccacttgtttgtgtcctctcttatttccttgagcagtgatttgtagttctccttgaagaggtcattcacatcccttgtaagttgtatttgtaggtattttattctctttgtacaaattgtgaatgggagttcactcatgatttggctctctgtttgtctgttattggtgtataggaatgtttgtaatttttgcacattgattttgtatcctgagactttgctgaagttgcttataagcttatggagattttgggttgagactatgggctcttctaaatatacaatcatgtcatctgcaaacagagacaatttgacatcctctcttcctatttgaataccttgtatttctttctcttgcccgattgccctggccagaaattctgatactattttacacaggagtggtgagagagggcatctttgtcttgtgccagttttcaaataartgcttccagcttttgcttttgcctcgtcagtatgatattggctgtgggtttgtcataaatagctcttattattttgagatatgtttaatcaatatatagtttattgagagcttttagcatgaaagggtgttgaattttatcaaaggccttttctgcatcgattcagataatcatgtggtttttgtcattggttctgtttatgtgatggattacatgtattgatttgtgtatattggacaagccttgcatcccagggatgaagctgacttgattgtggtggataagctttttgattcgctactggattcagtttgccagtattttattgaggatttttgcattgatattaatgaaggatatttgcctgaaattttcttgttttgttgtctttctgccaggttttggtatcaggatgatgctggactcataaaatgagttagggcggattccctctgtttctattgtttggaagagttacagaagaaatggtatcaactcctccttgtacctctggtagaatttgactgtaaattcatcttgtcctgggctttttttttttttttttttggttggtaggctattaattactgcctcaatttcagcaattgttattggtctattcagggatgtgacttctttttggtttagtcttgggagggtgtacgtgtccaggaatttatccatttcttctagattttcttgtttatttgcatagagatatttatagtattctctgatggtagtttgtatttttatgggatcagtggtggtattcccttcatcatttttattgcatctacttgattcttctctctttccttctttattagtctggctagcagtctatatattttgtagatctgtacaaaaaaaaacagctcctggattcgttgatttttcgacaagttttcatttctctccttcagttctgcactgatcttagttatttcttgtcttctgctagcttttgaatttgtttgctgttgcttctctagttcttctaattgtgatgttagggtgtcgattttagatctttcctgctttctcctttgggcatttagtgctataaatttccctctaaacactgctttagctgtgtcccagatattctggtacattgtgtctttgttctcattggcttcaaagaacttctttacttctgctttaattttgttattttcccagtagtcactcatgagcaggttgctcagtttccatgtacttttgcagttttgagtgagcttcttaatcctgacttctaatttgattgcactgtggtctgagagactctttgttttgattttcattctttttcgtttgttgaggagtgttttactttcaattatgtggtcatttttagaataagtgtcctgtggtgttgagaataatgtatattctgtttatttggggtggagagttctgtagatgtctgttaggttcacttggtctagagctgagttcaagtcctgaacatccctgttaattttctgtgtttttgatctgtctaatattgacagtggggtgttaaagtctcccactactattttgtgggagtctaagtctctttgtaggtctctaagaacttgctttatgaatctgggtgctcctgtattgggtgcatatatatttaggatggttagctttacttgttgcatttatcactttatcattatgtaatgcccttctttgtatttttttaatctttgttggtttaaaatctgttttattagagagtaggattgcaacccctgcttgtttttgctttccatttgctaggtaaatattccttcatccctttattttgggcctatatgtgtctttgcaagtgagatgggtctcctgaatacagcacactgatggctgttgactctttatccaatttgccagtctgtgtcttttaattgggacacttagcctgtttacatttaaggttaatattgttatgtgcgaatttgatcctgtcattatgaagctagctggttattttgctccctagttgatgaagtttcttcatagtattgatggtctttacaattttgtatttttttttgcagtggctggtacagttttttcctttccatgtttagtgctttcttcaggagcttttgtaaggcaggcctggtggtgacaaaatctctcagtatttgcttctctgtaaagaattttatttctcctttgctcatgaagctttgtttagctggatgtgaaattctgggttgaaaattattttctttaagaatgctgaatattggcccccactctattctggcttgcagggtttctgcagagttctgcagtttgtgtgatgggcttctttttgtggataacctgtcctttctctctggctgcccttaacattttttccttcatttcaaccttggtgaatctgacgattatgtgtcttggggttgctctttttgaggagtatctttgtggtggtctctgtatttcctgaatttgaatgttggcctgtcttgctaggttggggaagttcgtcttttaatattctgaagagtgtttttcaacttggttccattctctctgtcactttctggtacaccaatcaaacgtaggtttggtcttttcacatagtttcacatatttcttggagactttgtttgctttcttcattctttttttttctaatcttgtcttaacgctttattttattaagttaatcttcaatctctgatgccctttatctgcttaattgatttggctattgatacttgtgtatgcttcacatagttctcatgctgtgtttttcagctctgtcagatcatttatgttcttctctaacctggttattctagctagcaattcctctctctttcaaggttcttagctttttttgcattgggttagaacatgctcctttagtttggaggagtttgttattaaccaccttctgaagccttcttccatcaattcatcaaactctttctctgtccagttttgttcccttgctggtgaggagttgtaatcttttggaggagaagcagtgttctggtttttggaattttcaggctctttgtgctgttttttcctcatcatcatggatttatcttcctttggtctttgatgctggtgacctttggatggggtttctgtgtggatgttctttttgttgatgttgatgctatcccttttggtttgttagtctattttctarcagtcaggcccctctgctgcaggtctgctggcatttgctggaagtccactccagaccctgtttgcctggttattgccagtggaggctgcagaatagcaaagattgctgcctgtttctttccctggaagctttctctcagcggggcaacttccagatgccagccacatgtgtcctgtatgaggtgtctgtcgacccctgcttggagctgtctcccagtctggagtcacagcagtcagggatccacttgaggaggcagtctgtctcttagcagagctctagtgctgttctgggagatctgctgctctcttcagagtcagcaggcaggaacttttaagtctgctgaagctgggcccacagccgccccttcccccaggttctctatctcagggagatgggagtttaatctgtaagctgctgactggggctgttgcctttctttcagagatgcccttccaagtgaggaggaatctagagacrcagtctggctacagtggttttgctgagctgtggtgggctccccccagtttgaacttcctgaaggctttgtttacactgaggggaaaaccacttactcaagccttagtaattgtggccctccctccccccaccatgccagagcatgccctatcgacttcagactgctgtactcacagtgagaatttcaagccagtgggtcttcacttgctgggttccatgggggtggaattcggtgagctagaccacttgtctgcctggcttcagccctttttccaggggagtgaacagttctgttttcctagtgttccaggcgccaccgggctttgagaaaaaactcctgcagctagctcagtgtctgcccaaactgctgcccagtgttttgcttgaarcccagggccctggtggtgtaggcacctgagggaatctcctggtctgtgggttttgaagactgtgggaaaagcgtgttatctggggccgtattgcaccatccctcatggcacagtcccttatggcttcccttggctaagcgagggggttccctgaccccttgtgcatcccaggtgaggtgacaccccaccctgctttggctcatcctccatgggcttcacccactgtctaaccagtcccaatgagatgagccgagtacctcggttggaaatgcagaaatcacccaccttctgcgttgatctggctgggagctgcagaccagagctgttcctatttgaccatcttgcctgcccccttttattctttcaaagtatatatatatatatttattattattatactttaagttttagggtacatgtgcacaatgtgcaggttagttacatatgtatacatgtgccatgccggtgtgctgcacccattaactcgtcatttagcattaggtatatctcctaatgctatccttcccccctccccccacccaacagtccccagactgtgatgttccccttcctgtgtccatgtgttctcgttgttcaattcccacctatgagtgagaacatgcggtgtttggttttttgtccttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacatatatgtgcatgtgtctttataacagcgtgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctggctttttaatgattgccattctaagtggtgtgagatgatatctcattgtggttttgatttgcatttctctgatggccagtgatggtgagcattttttcgtgtgttttttggcagcataaatgtcttcttttgagaagtgtctgttcccatccttcgcccactttttgatggggttgtttgtttttttcttgtaaatttgtttgagttcattgtagattctggatattagccgtttgtcagatgagtaggttgcgaaaattttctcccaatttgtaggttgcctgttcactctgatggtagtttcttttgctgtgcagaagctcttgagtttaattagatcccatttgtcaatttaggtttttgttgccattgcttttggtgttttagacatgaagtccttgcccatgcctatgtcctgaatggtaatgcctaggttttcttctagggtttttatggttttaggtctaacatgtaagtctttaatccatcttgaattgatttttgtataaggtgtaaggaagggatccagtttcagctttctccatatggctagccagttttcccagcagcatttattaaatagagaatcctttccccatttctkgtttttctcaggtttgtcaaagatcagatagttgtagatatgtggcattctttctgagggctctgttcttttccattgatatatatctctgttttggtaccagtaccatgctgttttggttactgtagccttgtagtgtagtttgaagtcaggtagcatgatgcctccagctttgttcttttggcttaggattgacttggcsatgtgggctcttttttggttccatatgaactttaaagtagtttttttccaattctgtgaagacagtcattggtagcttgatggggatggcatcgaatctataatttaccttgggcagtatggccattttcatgatattgattcttcctacccatgagtattgaatgttcttccatttgtttgtatcctcttttatttccttgagcagtggttcgtagttctccttgaaaaagtccttcacatcccttgtaagttggattcctaggtattttattctctttgaagtaattgtgaatgggtgttcactgatgatttggctctctgtttgtctgttattggtgtataagaatgcttgtgatttttgtacattgattttgtatcctgagactttgctgaagttgcttatcagcttaaggagattttgggctgagacaatgtggttttctagatatacaatcatgtcatctgcaaacagggacaatttgacttcctcttttcctaattgaataccctttatttccttctcctgcctaattgccctggccagaacttccaacactatgttgaataggagtggtgagagagagcatccctgtcttgtgccagttttcaaagggaatgcttccagtttttgcccattcagtgtgatattggctattggtttgtcatagatagctcttattattttgagatacgtcccatcagtacctaattcattgagagtttttagcatgaagggttgttgaattttgtcaaaggccttttctgcatctattgagataattatgtsgtttttgtctttggttttgtttatttttgttcacagtaatcaacctgcattatttccccttcccagtactcttcccagcctctggtaatcaacattctattcattaccttcataagattaacattttagctccaacacatgagtgaaaacyattatcaagaagccacaaaggtgtttttggccgggtgaagtggcccacacctttaatcccagcactttgggaggccaaggcaggcggatcacaagatcaggagtctgagaccagcctaaccaacatggtgataccccgtctcttctaaaaatacgaaaattatccaggtgtggtggtgtgcgcctgtaatcccagctactcagctactcaggtgggtgagaccrgagagttgcttgaacccaagaggtggcggttgcagtgacccataacataataccatagactgggttatttaagcaacagaaatttattttttcatagttttagagggtaggaatctgatatcacggtgccagtatggtcaggttttggtgaaggctctcttcctggcttacagatggccaccttctcacaaggctcagggaaatagaataaatacctctatcttcttcttataaggccacagtcctatcatattaaagcctcactcttatgatctcattaaatcttaaagattatctctagatacagtcacattaagggttagggttgcgacatataaatttggtgaaagaagggacacaatccagtccgtaggagtgaaaatgtggtaatagtgaatttgttgagcgtgggtccattgacacacttcatttgctgtgaaatgagttccttgattagaagaggcattatgatggggaaataaagcaatgttttcccaataagtctagagtagttgctacttcttacctactaaatccaatgagaattatgttgctgatttaatggaccagtgcaatgccttgtgtaaggaaaaggcaaagtcctacaaactaaattattgcaaggagctgaagagtcctgctcctgaggtacgatattgtattgcttgctttgttagctgaaacaaactgcttccggctgtctttactaacagacataggaaaaaaaaaacattcttttagtcaatagctctmtaccagataccaggggatgtgttaatttgctctagcagtgaacccacatttggcacaacagctgtttggagttatcatctcatcaagctcacaataatccattgtcattctccaggatccatctgttttctgcacaggccaaataggagatatgtgagttaaatggggatgtgatgggaattaccacccctgcatcctttaagttcttgatggaactggtctttgcaatccctccaggaaggcagtactgattttggtttactattttcctagataggagcagttttagttgyttctatttatcctctaccatgacaacagcactcactccataggtcagggaagtgatgtgggaaktctgccagttgctgagtatatctattcaaattatgcactgcagagctgaggaaataatcgcaagatggtttcatggactcwctgtacacgctgtgaaatgaatgtcagctaaacctatgatctgatggtctgacagagattttgtctcttctgcctgtccactgagctcaggttcactccattgttccttctcttctgctccaggaggcccaggtgtctatgccattgcctctgtccctctgtggcctacaggtgataaaagatttgcagggaggacacaaggacactctgggaggctggaaatgattatggattagaggctttgttatcacaccacacccacctgaaaatagcaaaatagcaggtagagagtcacactgtaaaattttatccaagaaggaacatgagagctggacataaaagtgaaataaacttcagaaactttaaaaattttagccagcagcagcccatgctatgggtgggtccaatggaaatttgtgagtgagtcaccagtgtgtaagagggrgagagaatttctctctgatacatattttcattggggaactgggaaatccaggccacgagggagctccttgatcctaccaagcacaggatctgacttggtgagccgtgaggaggctatgaggagtggcattgggaagtgctttgtgtgcacttctatactctaccactaatagaaggaggacatttctaatcctaactcatagagaactgcacggaaatctactatccagaatgggtgaaagtctccggtttggcaagtctctggactgagatttgcaatctagtctcatgtggggaaggagacttcatggacagaactgagaggtgagtgtggcatgggcatgagctgcaggtgcagaaattgggagctcttcccttggcaggactagaccagcatggatgtggcctgggagcctcagttttgttccaatcagggagttcggcagcctgggacaatttaatgatctgaaggcaaactgtttgtgtctcgtctggctgttttagcttgctgccaatggtaggttgcaggagagagctccaccaggttgagagtgtggaagcaatgtgggacccactgccacatgctagggtttgaattcaaagctgcccctttcttcatgcatgctctttggcacagcagaggttccttcactccttcctggagcattgccccagtggtgttagaattgctatctaactcctgtctgggctggtgcttgtgcgtgccattggggagcctaagcatggacttgcctagcccagtcccactcagctttgcccctttcacctgccttggatacagacaacaggaccacgcccccagggagctctatagcctagcccattttctgagatatctgagtatttatcctggtaaacaaagctcaagcttgaaccccacagccacgaccacagctggctctcacctgaaagtaccacctaatgaacaggaggacaaactgcatagtccattacaacatcggccgacacaatagcatagcactcagaaaggagatatgatctgtgtgacatctgctgccttcattgcccacacaaccccagctactcagtaggtcttgaacccacttacccacctggtacattaagactacaattggcatttgagaaagccaccacactgaggctatttatgactaagaaaattaaacaaattctacactactcccctgctactccagtcagtcctttttttggtgtccaccactgaaggacgtgaggacaggtttgcctcttcaaattctgcacagcattaccccatctctggggctgagcatagaacccaggccactgggcatttcacagactactccattgcttgaggcacaggagatcttctccgtgtaaacaaagacccctactgcttctgccacagctggctggctcttacctgtaagcaacacctacagccctgaagtttgaactaagcaacccaatataaaatcagctgacacaagcttgaggtatagagaaaaatatctgggaaccagtcccagataaacttcccaagacctctgccaccccagagacacaggagaacataagcctattcacatattcagtacactgctactacaaccagcatttgagaaacacattaaaactgtctataaccaaggaattcttatagagtgcttaccactaaaaacacttagaagcaaagccaaacaaccctactcaacaaacattatagtcatatctccaaagggaataaatatggcctttataagcaaaagtaaatttaaaaataacaagagaaaatatctccagatgaggagaaagcagtgtaacaattctggaaatatgaaaaaatgtgggtgttatgacattcccaaacaagcacaccaacttggtagcaatggatcctaatcaaaatgaaatttttgaaataccacgtaaagaattcaaaacattaattttaaagatactcaatgaaatcaaagagaaagctgaaaagcaatacaaagaaataaaaaatcaattaaggatataagtgagaaatttaccaaaaagatagatattaaaaaacaaaaaaaatctgaaaataaaaaattagaaaggaattacaacatacaattaaaaccttcaacagtagactaggccaggtagaataaagaatctcagaacttgaagataggtctttcaaattaatccastctgacaaaaaaagaaatagtttcaaaaaaagccttcaaaaagtttggaactatgtaaaatctccaaacctatgaatcgtaggtattcccaagagagaataaaaaacacaacaagattgcaaaatctattcgaggaaatagttgagaaaagcttccctagtctagtaaaaggtctagatatccagatacaagagactcaaggaattctggaaaaattattgcaagaaagtacttaccatggcatataataaccagactacaattgaagtgaaggaaaaaatcctaaaattagcaacagaaacgttttgagtcacctataaaggaaagcccatcacataaacagcagacttctcaacagaaactttataagcctgaagaaattgaagttctatttctagagttcttcatgaaaaaaacacttttaaatacgaattttgaatcctgctctaatgtttataaatgaagaaatgaagtattttctagatgaacaaatgctgagtgaatttatcatgactatactcgttctacaggaaatgctgacagagttctaaataaggataaaaaagtcaatactctccatcataagagcacacaatagtataaaactcacaggccaaagaatatacgaaaaaactagataacaattaagattatgacaggaacaaaacgtgacacatcaatatcagccttgaatgtgaatgaattaaatactccacttaaaagacacaattggcagaatagatgttaaaaacatgatctattattttattcttgaaaaagactcaccttactcataaatacaattatagactgaaggtaatgggtgaagacagatgttctgtgcaaacagacaccaaaagtaagcaagagtatcatgtgtttcatatgtttataactggcttttgtaataaggtgatactgacatcatagaatgagatagaaataatcccttccatattgattttatacctatgtcagttaaaactggctttaaatcaagaacagtaaaaaaaggtcagtatataatgataaatggatcaattcaacaagaagatgtaataaatcctaagtatatatgcacccagaatcataaaacaaatattactagaactaaggaaagatatagcaatacaataatagctggagacttcaacactccagtgacagcactacacagattatcaagccagaaaaaggaaaaacaaatgcaagagttaaactggacgttagaccaagtagacctaatagacatttaaagaacattctcaacaaatttagaattcctccaatcggctcatggaaaattctccaggatagaccatattttaggccacaaaacaagcctcaataagttttaagaaatcaaacttataaaaaatatcttttcagaccacagtggaataaaactagaaatcaattccaaaaggaacccttgaactgtaaaaatacatggaaattaaacaacatgttcctgcataatctttgagtcaatgaaaaaatgtagacataaattaaataatatttgaaacaaatgaaaatggaaacaamacatacctaaacctttgtaatacagcagaactggtatttacatggaagtttataatgttaaatgcctacatcaaagtaataaaaagactacaaattaacaatctaccatcacaactcaatgaaccagaaaatatgaacaaaccaaacccaaatctaatagaagaaaaataacaaacatcagagcaaaactaaatgaaatttagagcaaataaacaatattaaaaagcaatgaaatgaagtttatttaaaaaaataatgaaaattgacagaactctctctagaataaccatgagaagaagagagatgattcagataaacacaattggaaatgaaaaaggaggcattataactgatatcacaaaaataagataactagagagtagcatgaacaactctatgctaataagcaagaaaaactagaggaaatggataaatttctggaaacatacgacctcctaagattgaaacggaaaaaaatagaaatcatgagcagatcagaaatgagtactgagattgagtaataataatattaaaaaacttcccaacaaagaaaggcccaggaccaaatggatttacagctcaattctacccaatgtgcaaagcagaacttattccagtcctactgaaacaatttaaaaaaaaaatcaatatggaagggattatttctatctcattctatgatgccagtatcaccttattaacaaagccacatataaacatatgaaaatagaagagaaaagaaatctacaaaccaatatcccagataaacatagatgtgaaaatcctcaacaaaattttaactaactgaatccaacaccacatcaaaaggataatacatcatgatcaagttggttttaacccagagatgaaaggatggttcaacatacacaaatcaataaaagtaattcaccacataaacagaattaaaagcaaaagccatatgatcatctccatagatgcagaaaaaaattaatagaattcagcataactttattataaaaactctttaaaaactaggcatagaaggaacgtacctcaaagtgataaaaaccgtatataagaagcccatagccagccttatactgaatggggaaaagttgaaagcattctttctaaaaactgaaacaagacaaaaatgcccattttcactgctccttttcaacgtaatactggcaattgtagccagggcagtcaggcaagagaaagaaataaaagccctctgaatttaaaaagaagtcaaattatttctgtttgctgataatatgaccttatacatagaaaactttaaagactctaccccaaagactcctagatttgataaatgaattcagtaaagtttcaggatacaaaatctatgtacaaaaattactatttaccagtaataatcaagcttagaaccaaatcaagttgtcagtttgttagcatttacaatagctgtaaaaataaaatatctggaatgcatttaaccaaggaagtgaaaaatacctacaaggaaaactatcaaacactgattaaaggaatttgagatgacaaaaataaattgaaaaaatcttatgctcttgaataagaggaatgaatatcattaaaatgtctatattatctaaagcaatctacagattcatttcaattctcatcaaaataccaatgtaattttgcacagaattagaaaaaaatcaccaaattcatatggaaccacaaaagagcttgcatagccaaaacaatcctatgcaaaaggaactaagtcggatgcatcacattacctaatttcaaattatattacaaagccatagaaactacaacagcatggtattggtataaaaatagacacatagatcaaaagaatagaagagagaacccagaaattaagccacataactacagccaactggtcttcgataaagtcaacaaaagataggctgtgaaaacaacatcctattcaaaaagggttcttggaaaattaggtggccatacacagaagaataaatatggacctgtatctctcaccatatgcaaaaattatcacaaatgtattaaaggcttaagtgtaagaccaaaactataaaaatacaggaagaaaacagggaaaactattctgaacatcatttttggcaaagacatcatgacaaagaccttaaaaacaaatgcacaataccaaaaatagacaaatgggacttaaactaaagtgcttctttacaacaaaagaaattatcaacaaaataaacagamaacgtgcagaatggaataaactatttacaaacaatacatccaataaaatattaataactaggttccacaaagaactcagacatctcaacaacaacaaataattctgccaaggccaggtgcagtggctcacgcctgtaatcccagcactttgggaggccgaggtgggyggatcacgaggtcaggagatcgagaccaccgtggccaacacggtgaaaccccatctctactaaaaatacaaaaaaaaaattagctgggcgtggtggcgggtgcctgtagtcccagctacttgggaggctgaggcaggagaatggcgtgaacctgggaggtggagcttgcagtgagcccagatgacgccactacactccagcctgggccatagagtgagattccatctcaaaaaaaaaaaaaaaaaattctgctaaaatgtaggcaaatggcataaacagactttttcaaaagaagacatacaaatggccaacaaacacataaaaaactgcttaacattattaatcaatgaaatgcaaattaaaatttcgattagctattgtattacaccacagtagctattactaagaagtcaaaaaataacagatattggcaagtatggagaaaaaaggaagcactcataagctttagtagaaatattaatgaatataacttgtaattaatacaatacatagggttctcaaagaattaaaaatagaactaccattctatgcaataattccactactggttatctaccaaagggaaataaattttatacaaaaggatatctacactcatgtgtttataccagcattattcacaatagaaaagatatagaatcaactaaactgtcaatcartggattatcggataaagaaaatgtggtgtatatatacaatggattgtattcagccattaaaaaagagaataaagtcatttttttttttccagcaacatcaatggaactggaggccattgtcttaagtgaatggtttggaaacagaaaggcaaataccacatattttcacttataagtgagagctaaataatgtatagaactggacataaggagtaaaataatagacactggagactcaaaaggatgggagggatcagagggggtgaaggatgaacaattacttagcggatacaatgtacattattaggttgatggctacactgaaaccccagacttcaccattatgcaatatatccatgtaacaaaactactttctcctaaattataaatattaaaacaaaaacaaaaacacctctattgttcacctgacctccataagccactattctgattgtagactatagtgtcattttaggtctcctggcattagtatcagttcaggacctgtgtccaatattctccaaaacttctgattatttttccctaattcttccatgccataatttattttggggaaagctgtgagaaagattgacattatatgttgttgggcgtgtggtgggatgcttcttccaggggacccattcttcccttcattcaagggttgtgagtctgtaaactggctcaagcctgggaattgattgaagggccatgactctgttttatgttacaagctagaattttgttcaattgacctaggactcctctgcttatacagatttagtaagaatataatggaattattatctgtctcactactagaaacatgattaactaacaatgtcataggtctgcatcagtcagattattctgattgctgctttgactcttctgcttatgtagtttttgtcagttaagtgctgccacttttcccctgccacttgggaatccaattatttctattaaatttattttttttagtttaatggtatcaatccatgtaatttctgacctacagagaaaagtgatcttcaaagacgatagggttcccacaaaaatttatttctcgtaattgtggctaagaattgttctcagtactctcccaaggtcggggagaagatcttaaatgataaatgtcgctaagaatttggattctttcctctacagtatgtcaaggcaggactggaatttcaacttcatttagtgtaggacaccttttggtctatgtgtttctaaactttttttagagtattttctgacacactgagctgcaacactaaatcgagactctctccttcttgggctcatatcaatacatttggcctgtttcaggtttgtgtttcttccacaattatccatacttttaatatccattgtcatacgtattccctggatttatgtctatataaattagaaaaataaacatgacctgacaagacttgagtctagttataggtctagaagcaaagaagggtggtatggtgggtcctaacaatgatcagcagtgtcttacttctgcttcttctcagagcttaagttgtattttatttcgctgcatgtaatctcttgctcacaggtacccagatatctgcagtaacccagcaatccatttgtgcaatagcttccaccactgctctaagcattttccagcctacagtctaaactatgctatcattccagttagtattccaagtcagaaaagacacaacagtccctcagactgtccccagagaagctagaactttacaagcaagttccattyatattctttcattccaatggaggaaccaataatttgatggattctttcagacactcagtgctgtgttagagagggagtgggacaagggcaagcagaaatgacatgaaattttctagcatttccttggttgcttcagcttcttagcttgtttcaagagttctcacaaaactactttgctctatatattttggggtgttttgttttgtttttgtttttttgtttttttgtttttttgtttttttkttttttttggtgtttccatggggcaatgagggcctggcgctttctgctctgccatcttgctgatgtcactcttcagtagtatctcctcttctcatcatgtttgtctgtttttatatctttcttttataaggttgtggttcaccttgaaactattctaggagcctcagttcaacatgttaaactgaagaaaatgaagtactcttttcagttgtggatcgcaatgatgtcagcaaagggacatgatgggaaggtatttttacctctttctttacttacttttttctttgtgtaaacatttattgagcttctattgtggtccatatgttagaggtgtagagaaaagaaactcatgaaaaaaataagtaaaatagtaaaatatttaaagaaagcacagtttggtgaatgcctatacggaataggcatatatgctattcacagagagtgtgcccattcctatatggaaatcagtgaaggcttcttgatggaggaattgcagtctcccaaatcttgaatgatttggaaaccttaaccaggtagagaagagataaagattatgccaggcagaggggaaaccacggcaagaacaaggacacaggggaatgaagctaatcttagtatgttgtatgctaggtactcagaacatgtaggtttcaataaagccttaagtgattaggtaacttcagttgtcaagttccacctttaccttccccctgagatgttttaaaaatacatgtacagagctatctgcccatctcctgtttatttttcccttccttttcatatctgctatgattagaagctgatacaggtacttgtgaaagaagcttcccttatgccaggttttttcaggcttgctgaagacttttaatatgaacactttgagaactataagataaattcaacattctggagaatttaacttttgtgaatataggaatgttttctgccaatgggaatatttgtgttagagcatgacacatccaaatttgaagtgcaggctacctcctagttttgttatcttgggcaagttacttagctattctgcagtttactcatacgtaaaattaagctattgatacccattttacagctttattttgtggattaacaatattttttataagatatctcacatacaatagcccttccataaggcagaactcacacgaccctctctaccttaaaaaaaaaaaaagtcacttttaaaattttttcaaatacccagttttctttgcagaaacactttggaaatctctcagaacaaaacgtttatacaaattcacaaggggaggaggtttggctctgagatgaaagtttataatcagaactttagatcaaaactaaagctgaaatcaaaaacaaaaagtttattttcagttcacttccagaagacactgtcttataatttggataaactgttaacatacatgctgactgtcaaaactggtcctgtaattacaaatctggaaagaaaaagaggggggaaaaatctgctctcctcttacttttttatgataccagatttagagctgggattatgatgccagatttagagctggtggtcataaccactttaccatgttgctcattaataatcacttaaaataggtagaaaagggatgtggccattttctaacccatactttttatgttaatgtagctcttttttaattacaaacctaatttaaaatttttaaattttgtgactacataatagttgtatgtatttatgggatatataagatgttatgacacatacatacaatgtgtagttatgaaatctgtaactgaagtatccaacagtttaaacatttattatttctttgtggtgtaactttccaattccactctcttgttttataatatacaacaaagtactttaaactatagtcacccaattgtgctatcaaacactagaccttatttcttctctttttatactcaataatcatccccacttctcttgcagtttcttgtgcatttgcactataacatttatttctttttatactatctcttaaaaaatggttgtagttattatcatagtcatatcttcaagaayaaaattccacattcaatgaaagtaaattcaaaaataagaacaatcccctattcccctggttgctcagaaatcaacgtatagatgcagaaagcctgaaaaagaaatgtactataacactctcaaattaaaacaataattcttcagcaatagactctgtgcaaaagaaatcttcaaaatgccagataaggaaatcaaaatattgactttaaaaaaggcttaatgaaattaaattgatttttttttttttttttttgagacagagtctcactctgttgcctaggctagattgcagtggtgcaatcttggcctactgcaacctctgcttcccttgttttcctgcctcagcctcctgaatagctggggctacaagcacacgccacaacacttggctaatttttgtatttttagtagagatggggtttcaccatttttggccaggctagtctcaaactcctgacctcaggtgatccaatcatgctgycccctaaagtgctgggattacaggcacgagccaccacacctggaccttaaatggaaatttgtaaagcaatacaaatatattagaatatcaacttaggctgttaatatgaaatttactaagaaggtagattttctaaaaaaatgtaatagtaacagaaattttggaacttataaattcattgaaggggttacaaaaacattccaaagaccaagcagaaggaagactctcgaaatatgaagacacatcttttgaagtaatccaatcaaacaaaaataaagacaaatgaacaaagcccttaagatgagtgtgcaaaaataacaatacttacaatttgttggtattactgaggtagaaagaaagataaaaaataagtttagaaatcctatttaagaaaattatttatggaagcatctcaagtgtagcaagagatttagacatccagatacagtagtcccagcaatccaagacaaatacattgcaaaaggcatattaaatcagtatatctaaagtcaacataaaagaaatacttctatgatcagcaagaaaaatgcatctagtcacctatgaaagaaaccccatcagastaagaatgagcttcttagcagaaacttcgcaggtcagaagaaaatggaatgggatttacaaattgctgaaagaaaaaaatacaataaaaatgtttatatccagcatgattaagcttcataaatgaaggagaaataaagtcttttccagacaagcaattgctgagggaatttatcaccactagagcagacttaaaacaaatgctcaaaaatgtccttgacatggaaataaaaggtatatgttcatgattatgataactcattaacatataaaactcaatgatattataaaacaatcacataaagaaggaagaaaagtcaagttgttaacacaacaaaatttcaccaaaccataaagacaaacagagaaaaagaaacaatgtataaaacaactgaaaagatttagtgacctgacagaaaataaacctcatgtataaatgttaaccttgaactcaaatggattaagtactcttctaaagagagatagattggcagaaaatataagaaacatgatccatctaaatgctgcttccaagaaattcaccttctctgtaaatacatacatagactgagagaaaagggttgaaaaaagatattttatggaaatagaaactaaaagagagtaggaatagctttacctatactagatatagcagatattaaattaaaaagttaaaaaagacaaataaggtcattgtataatgataaaaggatcaatgcaacaggaggatataacattactcagtatatatacactcaatactggagcaaccagattcataaaacaaatattactacatctaaagagagaggtggaaaataatacaataatagtgtgagacttcaactgcgcactcacagcattagacatcattaagacgggaaatcaacaaagaaatattgaacttatttggactttaggtgcaatagacctaacacactttgacagaaaagtctactcaacaactgtgaaatgtacatttttttcacataagcacatggaacattctccaagatagaccatgtatgaccttgtatagaccttgtattttaggccacaaaacaagtctcaatgaattttttaacattaaaaacatatcaagaatcttctcagaccacgcttgaataaaactgaatatcactacttttgggaactttggaaactatacaaatacatggaaatcaaacatgttccttaatgattattgtgtcaatgaagaaattaaggtggaaattatagcaatttttgaaacaaatgaaaaggaaaacacaacacatcaaattctgtgggataaagaaaaaggagttcccaaagggatgttcatagtattaaatgcctatactaaaaaagtaggaacattacaaattaacaacctaatgatggactgccatgaactagaaacacaagaacaaactaaaccgaaagtggcagaagaaaatgagttaaaaaaaaaaattctagtagaactaagtaaaatagagaccaaaaaggaaaggtagaagtacaaagggtcactgaaacaggaagtgttggttcttaaaaaaggtaaacaaaataatccactatccagattaatcatgaaaaaaagagagattacaacaaaatcagaaatgaaaaaagagagattacaacaaaatcggaaaagcaaaagaagaaattataaatcacatcacagaaatacaaayattcttaaaaattattattaagaactctacttccacaaacaagaaaacctagaggaaataaattaatttctggaaacatgcaacctcccgtttgaatcaggaggtaatagagaacttgagcagacctataatgaatagcaacattgaatcagtaataaataatttgtaacaaaggaatctcagaactaaatggattttccatacacacaaagaagaataaacagttcttttgaaattgctccaaaagttcaaagaggagagaattcttcataactcattccatgacaccactatcaccctgataccaaaaccatacaagaacacaacaaccacagaaaaactacagatcagtagtctgaagagcatagatgcaaaactcctcagcaaaatactagaaaaccaaattcaacatcataacaaaaagataatacgccataaacaagtgggttttatattaggaatataaggatggtttaacatatacaaatcaataaaagtgatatattacataaacaaaaataacaaaaccatataattatctcaagagatgcaggaaaaagcatttaataaaatttagaatctttttatgataaacagtctcaacaatctaggcataaaatgaacatatctcaatgtaataaaggccacatacaacaaacccaaatctaatatcacactgaatggagaaaagttgaaagcatttcctctaagaactagaacaagacaaggatgcccactttcaccactcctattcaacacagtactgaaagtcctagccagagcaatctggcaaaagaaagaaataaaagatatccaaactggaaaagaggaagtgaaattttttcctgttatctgactatataatcttatatcttgaaaaacctaaagactccaaaaagaatcccctagaattgataaaagaattcagtaaagtttcaggatacaaaatacatgtataaaaacaagtagcatttttttacaccaataaaagtgtagctgagaataaaatcaacaatgcaattccatttataatagttacaaaaaataaagtagaactccttgttaattaataagatgaaatatatataatgtatatattacatataaatatataacatatttatatattatatattatatatattatttatatttatatttatattgaaatataattatatattatatattaaatatgttataatcagatttatatttttaaattatataatatataaatataattatatgtacttttactgatatatatctgtatacatatatacatacgtatatgtatacacatatatacatacgtacatgtatacacatatatacatasgtacatgtatacacatatatacatacgtatatgtatacacatatgtacatatatacatacgtatatgtatacacatatgtacatatatacatatgtatatatatacacatatatacgtatatatgtatatacatacatacacgtgtatatatgtattgtccaatgtattgaattgtgtatatgtatacacgtgtatatatatttgtgtatatatatatacacacatatacacagtagtttgtagttttactgatatctatatctatatcactatatatatatcagtatatatatcagtatatatagatataagtatatagatatagatatagatatcagtaaaactacagactactgatgtaagaaaaagtagatgacacaaataaatggagaaacatcccatgctattggattggaagaattaatatatacaaaattatatatatatatatcagtaaaactacaaaatgctgatgaaagaaaaagtagatgacacaaataaatggagaaacatcccatgctattggattggaaaaatataaacaaaattaccatactgctctaagcaatctacagatttaatacttttcctatcataacatcagtgtcattttttcgaagaattagaaaacattctttttttatttttatttttatttctattattgttatactttaagttttagggtacatgtgcacaatgtgcaggtttgttacatatgtatacatgtgccatgttggtgtgctgcacccattaatttgttatttaacattaggtgtatctcctaatgctatccctcccccctccccccaccccacaacagtccccagagtgtgatgttccccttcctgtgtccatgtgttctcattgttcaattcccacctataagtgagaacatgcggtgtttggttttttgtccttgcgatagtttgctgagaatgatggtttccagtttcatccatgtccctacaaaggacatgaactcatcattttttatggctgcatagtattccatggtgtataggtgccacattttcttaatccagtctatcgttgttggacatttgggttggttccaagtcttcgctattgcagatagtgacacaataaacatacgtgtgcatgtgtctttatagtagcatgatttataatcctttgggtatatacccagtaatgggatggctgggtcaaatggtatttctagttctagatccctgaggaatcaccacactgacttccacaatggttsaactagtttacggtcccaccaacagtgtaaaagtgttcctatttctccacatcctctccarcacctgttgtttcctgactttttaatgatcgccattctaagtggtgtgagatggtatctcattgtggttttgatttgcatttctctgatggccagtgatgatgagcattttttcatgtgttttttgactgcataaatgtcttcttttgagaagtgtctgttcatatccttcgcccactttttgatggggttgtttgtttttttcttgtaaatttgttggagtccattgtagattctggatattagccctttgtcagatgagtaggttgcaaatttttctcccattttgtaggttgcctgttcactctgatggtagtttcttttgctgtgcagaagctctttagtttaattagatgccatttgtcatttttggcttttgttgcctttgcttttggtgttttagacatgaagtccttgcacatgcctatgtcctgaatggtattgcctaggttttcttctagggtttttatggttttaggtctaacgtttaagtctttaatccatcttgaactaatttttgcataaggtgtaaggaagggatccagttttagctttctacatatggctagccacttttcccagcaccatttattaaatagggaatcctttccccatttcttgtttttgtcaggtttgtcaaagatcagatggttgtagatatgtggcattatttctgagggttctgttctcttccattgatctatatctctgttttggtaccagtaccatgctgttttggttactgtagccttgtagtatagtttgaagtcaggcagcgtgatgcctccagctttgttcttttggcttaggattgacttggtgatgcgggctcttttttggttacatatgaacttagagtagttttttccagttctgtgaagaaagtcattggtagcttaatggggatggcattgaatctataaattaccttgggcagtatgaccattttcaaaatattgattcttcctatccatgagcatggaatcttcttctatttgtttgtgtcctcttttatttcgttgagaggtggtttgtagttctcctagaagaggtccttcacatcccctgtaggctggattcctagatattttattctctttgaaacaattgtaaatgggaattcactcacgatttggctctctgattgtctgtttttggtgtataggaatgcttgtgatttttgcgcattgattttgtatcctgagactttgctgaagttgcttatcagcttaaggagattttgggctgataggatggagttttctatatatacagtcatgtcatctgcaaacagggacaatttgacttcctcttttactaattgaatattctttatttctttcccttgtctgatttccctaaagagaacttccaacactatgttgaataagagtggtgagagagggcatccctgtcttgtgccagttttcaaagggaatgcttccagtttttgcccattcaatatgacattggctttgggtttggcataaatagttcttattattttgagacacgtgccatcaatacstactttatggagggtttttagcatgaagggctgttgaattttgtcaatggccttttctgcatctattgagataatcatgtgttttttgtctttggttctgtttatatgatgaattacgtttattgatttgcatatgttgaagcagtgttgcatccsagggatgaagcccacttgatcctggtggataagctttttgatgtgctcctggattcagtttgccagtattttattgaggattttkgcatcagcattcattagagatactggtctaaaattctctttttttgttgttgtgtttctgccaggctttggtatcaggatgatgttggcctcagaaaatgagttagggaggattccctctttttctattgattggaatagtttcagagggaatggtactagctcctctttgtacctctggtagaattcggctatgaatctgtctggttctggattttttttgttggtaggctaattattgcatcaatttcagaacctgttattggtgtattcagtgattcaaattcttcctagtttagtcttgggagggtgtgtgtgtccaggaatttatccgtttcttctagattttctagtttttttgtgtagaagtgtttatactattctctgatggtagtttgtatttctttgggattggtggtgctataccctttatcattttttattgcatctatttgattcctctctcttttcttctttattagtcttgctagtggtctatcaattttgttgatcttttcaaaaaaaccagctcctggattcactgattttttgaagcgttttttttttgtgtgtgtctatctccttcagttctgctctgatctgaattatttcttgcattctgttagcttttgaatgtgttggctcttgcttctctagttcttttaattgtgatattagggtgtcaatttgagatctttcttgctttctcttgtgggcgtttagtgctataaatttccctctacacactgctttaaatgtgtcccagagattctggtgtgttgtgtctttgttctcattggttttgaagaacatctttatttctgccttcatttcgttatgtacccagtagtcattcacgagcaggttgttcagtttccatatggtagagctgttttgagtgagttacttaatcctgagttctagttcgattgcactgtggtctgagagacagtttgttataatttctgttcttctacatttgctgaagagtactttacttccaactatgtggtcaattttggaataagtgtgatgtggtgctgagaataatgtatattctgttgatttggggtggagagttctgtagatgtctattaggtccgcttggtgcagagctgagttcaattcctggatatccttgttaactttctgtctcactgatctgtctaatgttgagagtggggtgttaaagtctcccattattattgtgtgggagtctaagtctctttgtaggcctctaatgacttgctttatgaatctgggtgctcctgtattgggtgcatatatatttaggatagttagctcttcttgttgaattgatccctttaccattatggagtggccttctttgtctcttttgatctttgttggtttaaagtctgttttatcagagactaggattgcaacctctgcttttttttgttttccatttgcttggtagatcttcctccatccctttattttgagccaatgtgtgtctctgcatgtgatatgggtttcctgcatacagcacactgatgtgtcttgactctctgtccaatttgccagtctgtgtcttttaattggagcatttagcccatttacatttaaggttagtattgttatgtgtcaatttgattctgtcattatgatgttaactggttattttgctcattagttgatgcagtttctttttagcattgacagtttttacaatttggcatgtttttgcagtggctgttactggttgttcctttccatgtttagtgcttccttcaggagctcttgtaaggcaggcctggtggtgacaaaatctctcggcatttgcttgtctgtaaaggatttcatttctccttcacttatgaagcttagtttggctggatatgaaattctggtttgaaaattcttttctttaagaatgttgaatattggcccccactctcttctggtttgtagagtttctgccgagagatccactgttagtctgatgggcttccctttgtgggtaacccgacctttctctctgtctgcccttgacattgttttcctttatttcaattttggtgaatctcataattatgtctcttagaattgctcttctcgaggaatatctttgcagcattctctgtagttcctgaatttgaatgttggcctgcctcgctaggttcttgaagttctcctggataatatcctgaagagtgttttccaacttgattccattctcaccgtcactttcaggtacaccaatcagatgtagatttggtcttttcacatagtcccatatttcttggaggctttgttcattttttactcgtttttctctaaacttctgttcttgcttcatttcattcatttcaacttcaatcactgttaccctttcttccactttatcaaatcggctactgaaggttgtgcattcatcacgtagttctcgtgccatggttttcagctccatgaggtcatttagggacttatctacacctgttattctagtttaccattcgtctgatcttttttcaaggtttttaacttctttgtgacgcgttcgaagatcctcctttagcttggagaagtttgttattgattgtcggacgccttcttctctcaactcatcaaagtcattctctatccagctttgttctgttgctggtgaggagctgcattcctttggaggagaagaggtgctctgatttttagaattttcagcttttctgctctggtttctccccatctttgtggttttatctacctttggtctttgatgatggtgacgtacagatggggtttaggtgtggatgtcctttctgtttgttagttttccttctaacagtcaggaccctcagttgcaggtctgttggagtttactaaggtccacttcacactctgtttgcctgggtatcaccagcagaggctgcagaacagcaaatattgcagaatggctgatgttgctgcctgatccttcctctggaagcttcatctcaggggcatccagctctgtaagatgtcagtcagcccctactgggagctgtctcccagttaggctacytgggggtcagggacccacttgaggaggcagtctgtccgttctcagatctcaaactscatgctgggagaaccagtactctcttcaaagctgtcagacaggacgtttaattctgcagaaatttctgctgccttttgttcagctctgccctgccccagaggtggagtctacagaggcaggcaggcttccttgagctgtggtgggctctatccagttttagcttaccagccgttttgtttacctagtcaagcctcagcaatggcggatgcccctcccccagcctcgctgccaccttgcagtttgatctcagactgctgtgctagcagtgagtgaggctctgtgggcttcggaccctctgagccaggcacaggatatgatttcctggtgtgccgtttgctaacgccattggaaaagcacagtattagggtgggtgtttcctgattttccaggtaccgtatgtcatggcttcccttggctaggaaagggaattctccgaccccttgtgcttcccaggtgagaggatgccccaccctgctctgtgggctgcaccctctgtctgacaagccagtgagataaacctggtacctcggttggaaatgcaaaaatcacccatcttctgtgtcgctcatgcttggagctgcagactggagctgttcctattcagccatcttgtaacctcgagcctacaacctgtcttccagcttactaattacttattctatttgtttaataatgcatttgagagattctcatgcattttcagtttgtcaagtgaatttttcttctttttaaattttaatctttaaaaaatgtctctgacggaatttggaattccttctctgcattgtctttaagttcattaggcttcctcaagacacctattttcaattctctgcctgacaattcacatatctctgtcactcctgaattggtcactggtgccttatttagtttatttggttaggttatgttttcctggatgtttttgatgcttatgtacatttattaatgtcttaacattgaagagttaggtgttgttttcaatattcaccgtctgtgcttggtttggcccatccttattgaaagacttcccgtgtattcgaagaggattgagtgttgtcctgtaagtgtgttttcactgaatccataacagcagtaggtggcgtcttaagctgaggaatgctgtgactcttgccaaatcccagaggcactgctttggtggtgttgagtaatataagggaaaatttcctgggtcaccaggtaaagtaagtcactctcttgtctctctttccctcaatatgaaggagtctgtttttatgctgagttgtctagaattgggaaagggatgacatgagtactcctgtggccactacagctggcagtgtgctagattaaacattaagctagcacagtacggggtctcatccaaggctcatggcaactactgcctgactaatgtttataggagactctggtgctcttgagtcagaagtttgggaatcctcctggtactgggttcttcacttcaggacagtcaattcccttctcactagagtgggtctagaaagaccatccaggagctaaggcctgttattggggacttcaggaatctccttgttgcttcattttactatagctacgctggtacccaacttgcaagacaaaatcttctgtacttttcccactcctttcccaaagccacagaagtctcttcaccagctacattgccggagttaaaggaagggtgatgcatgcactcttttggccaccacagctgatgttgtactaggttgggtgcatccaaaatcaattgcctctgagagaacagtgcagctccagggtttttccaaggcctgtagtccttgaggyctgatggccactcaaatttacttcaggcctcgggccatgttagtcagctagtggtggagccagccaggactggagttcctcccactggagctgagaatttccctcattcagaactgctctaaatgttccctgctttggtgctagcataatttttccctatgttgcataccactgggacagggcaggactgggttgcaatgcaaagtagcccattcactttactcaccatcctgtaagcaaacaaattgtctttcaatgaggtgctgatggacaatgagggagggtttgtgtaggcaatgcaagaccatctttcctactctcttcagtgcctcttttattgatattttgttaaaaccagttattgtgattgctcattttattggttcttatgaatgtgttttcttgcatgcatagttgtttaatttggtgttcttgcaaggaggctgactgctgaagcattctattcagccatcctgctctgcctacacttccctataacaggtttgttgaggtataattcatataccatgcaatgtgcctatttaatgtatacaatgtaatggaytttagtacatttagagttgtgcaacaatcatcacaattttagaatattttcgtcattcctaaaagagacctcgtactcattatcagtcactctacaacccactcgcacctccatagccttaagtaaccaagaatctactttctgtctctatagatttgattattctggatatttcatgtgaataggctcatacgtatgtgatgtcttgttactggcttctttcactaggcacaatatttcaagttttatctatattgtatcatatatcagcacttactttgtgtgactgagtaatattttatcaataaattttatttatgtattcatcaattgactggtattttactgttatgaatgattattcatatataagtcttgtataggtgttttggtctttactattttgagaaaatactcttgtattttatttctttccttcaatctcaggaacctgtgaaatttgtagatttgcttggtgaccatgggaaacatgtcagtcctctgtgggagttgatcaaatggtgcctgggtctgtcagtgtacaccatcccttccattggtatgtaaatcatattctacctagaccagtttgwtgtcctgtaatatttcttaatatctaaatataaattttggactaaaggccccatgcaagtccaaaatccagtggggtactgaaatcttaacgctccaaaatgatctcctttgactccatgtctcacatccaggtcacgctgatgcaagaggtgggttctcatggtcttgggcagctccacccctatggctttccagggtatagcctccctccaagttgctttcatgtgttggcattgagtgtctgtggattttctgggtgtactgtgcaagctatcagtggatctaccattctggggtctggaggacagtggccctcttctcacagctccactaggcagtgctccagtggggactctgtgtgggagcttcaaccccacatttcccttccacactgccctagcagaggttttctgtgagggccttgtccctcagcacacctctgtctgggcagtcaggcattttcatacatcctctaaaatctgggcagaggtttccaaacatcaattcttgatttttgttcacccacaggcccaacaccacatggaagccaccaaggtttggggcttccatcctctgaagcaattacctgagctcaatcttggccccttttagccatgattctagccatggctagaggggctggaatgcagggcaccaagtccctgggctgcacacagcaagagggccctgggcctggtccatgaaaccattttttcctcttaggcctctgaacctgtgatggaagggctgccacaaaggactctgaaatgccctggagacattttctccattgtcttggagattaacatttggatcctccttatttatgtaaatttctgcagccggcttgaatttctccttagaaaatgggtttttcttttctatccatcatcaggctgcaaattttccaaacgtttattctctgtttccccttttctgaaggacttgctttgatgtccaggctggagtgcagtgatgcaatcatgactcactgcagcattgacctcctgggctaaagcaatcctcctgcctcaactcctaagttgctgggactacagggctcaccaccacacctggctaagagatggagtttcatcatattgcccaagctggtcttgaacccctgggctcaagtaatctgccagccttggccttgagaagtgctgggattacagacatgagccaccatgctcagctataatgggttttcaattatgtgaaaaatccttatgatgaactatgcagtagcagaggctagaaatgttatatatagcattactaaaacaaactagaaggagttaaaagtaagattataaagtttccttttccatcacttactttctcagtgttctataatgaacatgtattacttgaataagaaaagataaagaacactaggaattaaaatgaagtttattaccttaacttgatatatgwtatcattctgtaggactggctttgttggaagaaaagctcagatatagcaatgagaaataccaaaagtttaaggcagtggaagaaagcctgcgtaaagagctggtggatatgctaggtgatgatggtgtgttcttatatccctcacatcccacagtggcacctaagcatcatgtccctctaacacggccyttcaactttgcttacacaggtacctaattgtattccttacattctgtaatcttaaagaaatagagatgtatgtttccaaggaaagcataattttcttttgcagttggacaagttttaaacmtgcaggtataaaagtgctgtgtgattgaaaactccagaaaacagttgctaatgtcatatgttgaagatactttgccaatatctggtttctccacaataatcctacaagtgcatatgagtatccacattttacagaactgtgcctcagggaggttcagccacttgtcttctatcactcagtgtgatcacactagatccaaagtctcccctggctgctctgaattaaaccaagttaagcttttatcaggatctgtggcttcccagaagattcttgtacagaagacaattctccaagggatcatttacttgacttagctatcatcccctttgaattcaattcattctattcaccaaactaattttcttcacctggtttttaagccatggatggatcatgattatgtgaagtctaaaggcccctggacatgtactaggtcagtttctatggtttctccagagtcttgtcccagggaaccacactattctttgagatgaagatagagaactcttcatcaaatacacgttctcacccaataaacctgtggtccacttaaagttagaatttggaatcctttgctctgcaattttctacttgtgcatctggaggaagacattgaatctttctcaacttatttcctatctaggaagtcagggtaatctatgccttgcagtgttgcagttaagattaaatgaaataatacgtgtaaattaattaacataagggttgtggaggatgagggagaggatattaaacagtccctatccttaatttccttacccttactctctccctggctttgatcactcactcttaatttcttccttcctgtccttccttccttccttccttgcttccttccttccttcttggagttttgctcttgttgcccaggctggaatgcaatggcacaagctcggctcactgcaacctccacctcctaggttcaagcgattctcctacctcagacccccaagtagctgggattacaggagtgtgccaccacacccagctaagttttgtatttttagtagagacaggtttcaccatgttggccaggctggtcttgaactcctgacctcagattatctgtccgccttggcctcccagagtgctgggattgcatacatgagccaccatgcctggccttaatttcttaagtctttgaaaaaacatgctgcctaaattgctgcgtttaagtttctatcacctagttactcagtttctgaagacaggtaaaatactttagtcaataggctagaacccaaggagaaatatactgtttataccttttggggaggattttcctcagcttgaggcttcctatggtttgtaacttttccctctagtttagccttgaacacatttaaagagtgttccttgtaagccagatgatattctaggtaatatggatacaagacccatgatagatgatagctgcaatttagcaagtatctaatatatacgagatactagaagccagaaattctatacattatctcatttatgtttcccccaaatccctcacagcaactgaagttatctttgtgtaaaacctgaggaaactgaatgatgtataaagtgatttaagggtcagggtcaggactgaaattcagttgtattctatctgactttaaatgcaatgttattttcactacatgtatgggttaataatgctcattcatgttttgtttttattgtctttactaaagctgaaaatataagaggtttgtgagaccttttgtcaaagatgtagaattgttggatgccaaataggttaatgttttattcctggttcttttttttcctactgagaaatacccctctcagtttctcaagcttgtataagctttttatgtttgtctcctacttacaagatgggtacactaaatcagatatttaatttttgagccttggctttcttacagctaagatgaggatgctagattgactttgaaggatggttggaaggatataatrtaataatgtgtagagtgctttaaaattattaataatagtgataatgataccatttattggagacatgtatatgtttatattgatattaatgtaggtaatatcaatatctctgctttacttcgtagtattagttayatgtgttttccttgttttatctattcctagaattgttctgagttttacatgtttcatctcattttatcttacagcagccctataaaaaggagaaattattagtgtcctcattttacagatgaaggaatttagacacaaaaatctttaggaaacatttccaaagtcacatagctaagataatatacgaactgggactttaacccaggccctatgatttcagaggaagtgatcttatttattacacagaagaggaaacaggaggctgaacagggtctctcagctatgaagtgaagtgataaggattcaaacccaggtctgtctgactccaaatcctattgcttctaattaactctcttcccttgttcttctgcctcacttagtgctcagtgaagcaaagtaccttctcctactttgctccattgacactctacaatgagaataaatttattaagcatgtattgtgaactatactgtatgcactggtgttagatgaatcagatacattccatgctctcagggagctcctagcttagtacaagagacaaacaaatgttaacagagaatttcagtagaagaaaacaaaggaaggctttctggaataggtgacccctgatctgggtcctgaaggagaactagaaattaatcagaggaaggatgttgagtaagtattacaatggtccacgcagtacgaaccccatgagcaatagaacagaaaaacacacaggaacactgtggacagagggtataaacactacactaactggagagagtaagtttttaatagaggagtgagaggaggagcatgagtttgaaaaggtaagcatgtcatggagaacattcacagccatgctaaaaactgcaaaaaaaatttatttgtcttggcaccctgccccatcctgctttctttgcataatgtcactggaataacacagtaatgaaagagaataatctagcctgcagattctttgaatatttgattagcctatgctatttcctgataacatgcaatcaacaatgtttcatatcattgtatctcaaagaagttatttacagttttcttccactttagtcctaccacgattatcaacataacacctatatgtcataataattgggagaggtgattaccaggacagatggaaggaaacagcttacaaaagtggcctttcactggctttctcccctctccccactttaggtgtctgtactcaaagatytcttggaccatttatatcctgagatgaacagcattggccatacagcattttaaagatctcatctgagaaacccattgatattggtgccaggaatgctaagcagatcttttgtgacctcttcagcatccagcattagagtgaaactcaagatttatatgtcaggtttggcaaaatcataacatgccactctcaagagtccctcttgtacccatgccagtcattaacaattgatcacagcattctttttctctgagaacaaacttgactttgtgatatttaaacagagtgggcttggtcacctccccaattgataagctagacacacaaaatgaaatgttcatgtagtctaagcaaagattctacttaacaaaataatctgctatattgttagctcttcaaaggctgtggtctgtttctatcttgttcacctatgtaatccgcattgactaggacattgcattgttgcacaaaatgcataattattttttgttaaactaacaaatacataattaaaaatataaataagaatgaacatcccagaataacagagtaagaagctcagcaaattctctctcaagcaaaccagcaataaaactggaaaaattactggaaacaaccatttcaagtgtgaaaaatgatcaaatggcataaagcaaattcaggagcatttattcaagaaaaattagtgattcctaataagaaaagttggagtctatgatatttaagctgggatctgttttcccctccgcttctcagatacagctttgaggtacaaaactttcacactgggtagggcaaggcagaccttaaagactgacaactcccattctttccagacccatgttacacagcatctgttgtgggcaagtagagaatactgctacatccaacagcttccattacctgtggcaccttattgtggaagttctaaacaaggtcatggctggtcataagaacttgcagctcttcaaccctgcccaagagaggctgattttacatgaagcagaatatggaagatcttagatacaaaaaattccctgaaagctaaaatttcagtgatactaacaaaattcacagcaacgtaccccagaggtagagaaaaatcagaatcaagagttgataaaatatattaactaaagcatctagttttcaacaaaaatttatgaggcatacaagtaaaaaaggaaaatgagacccacaaacaacaatgcccacctctgccacttgtagccagcaggccatgcctgctagagcttccagcccagcagttcctcttctttctgaactctgccagtggacacagcctcctgttatccagggaaacagaaaaactgcaggataggtgattccacaacccccaccascactcatagccaggcagctagaacttccagcccagcagtcccacttctgtctgaactctgatggcaggaacagcctctagaatataacccaacagcaggtcaggcaactgcacccaaacccgccactcatagccaggaaatccatgtctgatagagcttccagcccagcattcccacatctgcctgaactctgtgtgtggccacaacttcttgaacccccggaaagcacctagacaggggattaagtgaccccaccccatcccacagctcttagatgatcaggacttggtggtggccaagcaagggtgagccctcgttctcagatcactgagagaagtggagatacccaggttcatgggctggcagaggattggggtgtgccttgttccacagggccagcctggcaaggatatgacctgtctactaaatgtggtccctgcctgagggagcccatggaccagaacacctaacaaaagaagtgagggcatggaaccagtgatcgaagggggctcctccaargcccaggagccatctaggtgagcgagtcacctctctcccccacaccacagaggactactgtcatcttggccagaacaccgaagagccctgaaagagagtaggaagagcctatctgcctgctagcactcttaagcgccacctgctggatctcaggtcaaaatgcaaacctaaaatattttgcaagtatgtatcacctgtgaaaactaaggaaaagatccagccagaaataaacattctgtacaaagtcatgaccctttgaaatatacccagaaacaaagccagctgactatcctcaacttatctcacgggtgaagaaacatcaacccttacacatgagaaagaatgaatccaagaactggcaactcaaaaagccagtgtttgcccttacctataaacgtacacattagcctcccagaaatggttcttaaccagagtgagctgactgtggacatagaattcagaagytggatgacaaggaagctcagtgagaatgaggagaaagttgaaacataatccaaggaatccaataaaacaattcagtagctgaaagataaaatatccattttaagaaagaaccaaattaaatttttggaactgaaaaatttacttccagatctccacaatagaatctgaagcatcagcagcagaaaaattaagatgaagaaagaatctctgagctggaagaccagcttatacaatcaactcagtcagacaaaaataaagaaaaaagaatttttgaaaatgaaaaaatcctttgagaaatatgggattatgtaaagataccaaatgtatgactcatggtgttttcaaaagaaaaggagagagagtaacttgtaaaacatatttgaggatatagtccatgaaaatttccccaaacgtcccagggaggaggacatacaaattcaataaatacacaaaccccctgtagatactacacaagatgacaaaccggaaggtacatagtcatcagattcaccaagatcaactcaaaagaaaaactcttaaaagtagytaaagagaaaaatcaggttacctacaaagtaaaccccaccagactctctgtaagaactctctgtaagaaacctacaagtgagaagagattgggggcctattttcaatattgttacagtgaagaattttcaaccaagaatatcatattccatgaaactaarcttcataagcaaacgagaaataaaattcttcccagacaagcaagtactaaaggaatttattattaccagaccacccttacccgagttctttaagagagtgctaaatatgaaaataaaggaccaaaacttgctacctcaaaaatccactcaagcacatggcccataaacaatataaagcagctatgcagtcaagtctaaaaaacagtcaacaacatgatgacaggatcaaaatctcataaattaatactaaccctgaatgtaaagggtctaaaagtaccacttaaaatgcatagagtggcaagctagataaaaagataaaacccaacaatctactgtcttcaagagacccatttcaactgcaatgacacccacaagttcaaagtaaaaggatggagaaagatctatcaagcaaatagaaaacaacaacaacaaaagatcaggagtcattattcttacattagattaacaaattttaaaccagcaacggtcataaaagacaaagaagggtaatacttaataataaagagttcaattcaacaggaagtcttaactatcctaaacatatacacacccaatgtagaagtacctggattcataaaggaagttcttcctaaccaatggaaagatttagacagccacaaataataacgggggattttaacatcccactcactgagttagacagatcactgaggcagaaaactaacaaagaaattctggattgaaacttgacatttgatcaattggacccaatcaacctctacagagtactccacacaacaaccacagaatatatatttttctcatccatacacagaacatattctaaggtccaccacatccttggacataaagcaaatcacaataaattcaaagaaatcaaaaccataccaagcaaactctcagaccatagtgcaataaaagcagaaatcaataccaagatctctcaaaactaccagaaaatggaaattaaacaactttctcctgaataactcttgggcaaaaaacaaaattaagacagtaattaaaaattactttgaaattaatgaaataggagacacagcttaccaaatctttgagatgcagttaaagcagtggtaagagacaaatttgtagtgctaaacaccttcatcaagaggttagaaagatgtcaaattaacaacctaaagacagtcagataaacaagaaaaaagaacatccaactccgaataaagtagaagaaaataaacaactaaatcagagaactgagctgaattcagacctaaaagaccatacaaaacatcaatgaaaacaagtgttgctccttcaaaagaataaacaagattgatataccattagctaaactaacaaggaataataaaaaataaagatccaaatgagcacaatgagaaatgacaaagatgatattacaactgattccacagaaatagaatagttccttagagactatacagaacacctttgtgaacacaagttagaaaatatagatacaatggataaattcctagaaacacacaacctyccaagatagaatcagggataaaagtgaagacatgaacagataaataacaagttcagaaattgaatcactaataaaaaaacttaccaacaaaaaagagcccaggaccatggattcacggccaaattctaccagacatataaggaaaaactgataccaatcctactcacactttcccaagaaaatcgaagaagagtcttctccctaatgcattctatgaatccagcagcattctgatacaaaaatctggcagagacaaaatgtaaagtaaaataaaaaaaaattcaagtcaatatccctgatgaacatggatgcaaaaattctcaacaagataatagcaaactaaatccaccagcatatcaaaaagttaatccaacacagtcatgcaagttttatttctgggatgcaaggttgattcaccatacagaaatcaataaatgtgattcaccaaataaacagaatcaaaagcaaaaactacatgatcatctcaatagatacacaaaaagcctataatataatccaacatcccttaatgacaaaagccctcaacagattaagcattaaagtagcatacctaaaaatagtaaaagccatctacgacaaacccacagccaacgtaatactgaatgagcaaaaactggaacggttccccttgggaactggaacaagacaagtatgcccactttcaccrctcctattcaatatagtactggatgtgctagccagcgcaatgaagaaagggaataaataaaaggcacccaaataaaaagagagaaaatcaaactctctctctttactgatatgattcaatacctagaaaaccctaaagactctgctaagtctcctggaactgataaatgaattcactaaaattttaatatactaaaccaatgtacaaaaatcctaacatttttatacaccaatattgttytaggtgagaatcaaatgaagaacagaattccatttacaatagccacaaaaaaaaaaaaaaggaatacctaggaacccatctaaccaatgaggtaaagatctttacaagcagaactgcaaaacacagctaaaagaaatcagaggtaacacaaataaatgggaaaatatttcatgctcatatattggaagaatccacatagttaaaatggccatactgcccaaagcaatttacagattcaacactactcctatcaaaatattaatgccatttttacaaaatttgacaaaattatttttaaattcatttggaacaaaaaaagaacctcaacagctaaagcaatattaatcaaaaagagccaatacagaagcatcacattgcccaacttccaaatgtactataaggctacaataatcaaaacagcatggtactgctgcaaaaaaagacacatagaccaaggaaacagaattgagaacccagaaataaacctgccacctacaaccatctgatcttcaacaaaatgagcaaaagtaagcaatggaggaaaggactctctattcaataaatggyactrtaatagtttgcctgccgtatgcagaagaatgaaactggatctctacctgtcaccatatatgaaaactaagttaaagtagattaaatatttaaatgtaagacctcaaactataaaaatattgacagatagctgggcaggtgccctgtaatcccagctactcaggaggctgaggcaggagaatcgcttgaacccaggaggcagaggttgcagtgaatcgagatggcaccactgcactccaacctgggtgacagagcaagactccatccaaaaaaaamcaaaaaaatcctagaagaaaacctaggaagatggatgtcgagatggctgaataggaatagcagcttcagtctgcagttcccagtgagatcaacgcagaaggggagtgacttctgcatttgcaattgaggtaacctaatcatctcgctgggactggttaggcagtgggtgcagaccatggagggygagcagaagcagtgttgggcattgccttacccgggaagtgcaaggagtgggggyctccgttccctagccaagggaagccctgagagactgggctatccagcccatttactatgctttccccacaggtttgcaatccaaagaacaggagattccctcttgtgcctacaccaccagggacctgggtttgaaacacaaaactgggaggctgtttgggcagtcactgtgctagctgcaagagttgttttcttgttgtttcccagtggcgcctggaactccaccaagacagaaccrttcactcccctggaaagagggaaagggggctgaagccagagagccaagtggtctcgctcagtggttcccactcccatggagacaagcaagctaagaaccactggcttgaaattctcacagccagcacagtactctgaagtcaacctgggacgatctagcttggtggggggaggggcatccgccattactgaggcttgactaggcagttttcccctgagagtgctaacaaggcctgaaagtacaggctgaagggaaatcaacacagcatggcaaaagcagctatggccagactgcctctctagattcctcctcactgggcagggcatctctgaaagaaaggcagcagccccaggcaggggcttatagataaatctttcatctccctggggcagagcacctggggggaaagggtggctgtgggcacagcttcagtgaacttaaacatttctgcctgatggctctgaggagagcagcagatcctgacaagggggtttctcccagcacagtggtcaagctctgctaaggaagagactgcctcctcaagtgggtctctaaaccttgtgcctcgtgactgggatagacctctcaacagggtttgacagacacctcatacaggagagctctggctggcataaagccagtgcccctctgggattaagcttccagaggaagaagcaggcagcaatctttgctgttctgcagcctctgctggtgatacccagacaaataggttctggagtggacctccaacaaacttcagcagacctgcggaagaggggcctgtctgctaaaagacaaactaacaaaaagaaagcaacaacatcaacatcagcataaagaaacccttacaaaaccccatccaaaggtcaccagcctcaaagatcaaaggtagataaatccactacaatgaagaaaaaacagcacaacaatgctgaaacttccaaaaacaagaatgcctcttctcccccaagtgatcacaaatcctctccagcaagggcacaaaaatgcatgcagaatgagtttgacgaattgacagaagtaggcttcagaacgtgggtgataaaaaactcatctaagctaaagaagtgtgttctaaaccaatgcaaggaaggcgtgaagacaagattagagaaaaaagaatgaaaaggaatgaaaaaagccttcaagaaatatgggactatatgaaaagaatgaacctacgatggattggggtccctgaaagtgatgaggagaatggaaccaagttggacaacacacttcaggatattacccaggaaaacttccccaacctagcaagacacacgaacattcaaattcaggaaatactgagaataccactaaggtactcctcaagaagagcaaccccaagacaggtaatcctcagattctccaaagttgaaaggctggaataaatgttaagggcagctagagagaaaggtcaggttacctacaaagggaaacccgccagactaatagcagatgtctctgcagaaaccctacaagccagaagagagtgggggccagtattctcaaagaaaagaatttttaactcagaatttcttatccagccaaactaagcttcataagcaaatgagaaataaaatcctttccagacaagcaaatgctcagggattttgtcactaccaggcctgccttacaagagatcctgaagaaatcactaaatatggaaaggaaaaactggtactagccactgcaaaaatacaccaaaatataaagaccaatgacactatgaagaaacagcatcaactaacgtgcaaaataactagctagcatcatgatgacagaatcaatttcacacacaacaatattaaccttaaatgtaaatgggctaaatgccccaattaaaagacacaaactggtaaattggataaagagtcgagacccatcattgtgctgtattcaggggacccacctcacgtgcaaagacgcacataggctcaaaataaagggatgggggaatatttaccaaataaatggaaagcaaaggaaaacaggggtttcaatcctagtctctgataaaacagactgcaaaccaacaatgaccaaaaaagacaagaagggcattacataatggtaaaatgatcaatgtaaaaagaagagctaactatcctaaacatacatgcrcccaatacaggagcaccagattaataaaaaaaaaaaagttctcagagttctacaaaaagacttagactcccacacaataatagtgggagactttaacacccaactgtcaatattagatggatcaatgaggcagaaatgtagcaaggatattcaggacttgaactcagctctgaaccaagcaaacctaatagacatctgcagaactctctaccccaaatcagcagaatacattcttcctaacaccacgtagcacttattctaaaattgaccacatagttggaagtaaaacactcctcagcaaatgcaaaagattggaaatcataacaaagtctcacagaacacagtgcaatcaaattagaactcaggattaagaaactcactcaaaaccacacaactacatggaaactcaacaacctgctcctgaatgactactgggtaaataacaaaattaaggcagaaataaataagttctttgaaaccaatgagaaccaagacagaacataccagaatctctgggacacagctgaagcagtgttaagagggacatttatagcactaaatgccaaaatcagaaagggagaaagatctaaaatcaacaccctaacatcacaattataagaactacagaagaaagagcagacaaattcaaaggcaatcagaagacacaaaataagatcagagcagaattgaaggagataaagactcaaaaaaactttaaaaaaaatcaatgaatacaggagctggtttttcaaaaagattaacaaaatacatagaccacttgccagactaataaagaagaaaagagagaagaatcaaatagacacaataaaaaatgataaagggaatgtcaccactgatcccacagaaatacaaactaccatcagagaatactataaacacctctatgcaaataaactagaaaatctagaagaagtggataaattcctggacacatacaccctcccaaggctaaaccaggaggaagtcacatccctgaatagaccaataacaagttctgaaattaaggcagtaattaatagcctacaaaaaaaaaaaaaaaaaaaaaacccaggaccagacgcattcacatgaggattctaccagaggtacaaagagcagttggtactattccttctgaaacgattccgaagaatagaagaagagggattcctccctaactcattttatgaggccagcattgtcctgattccataacccggcagagacacaacaaaaacagaaaatttcaggccagtattcctgatgaaaatggatgcaaaatttctcaataaaatactggcaaaccgaatccacctgcacatcaaaaagcttatccatcacgatgaagtcggtttcataactgggatgcaaggcttgttcaacatacgcaaatcaataaacataacccatcacataaagagaaccagtgataaaaaacacatgattatctcaatagatgcagaaaaagccttcaataaaattaaacaccgcttcattctaaaaactctaaataaactaggtattgatggaacatatttcaaaataataagcactatttatgataaacccatagccaatatcataccaaataggtaaaatctggaagcattccctctaacaaccaacacaagacaaggatgccgtctctcaccattcctattcaacatagtattggaagttctggccaggccaatctggcaggagaaagaaataaagtctattcaaataggaagagaggaagtcaaattgtctctgtatgcagatgacatgattgtatatttagaaaaccccatcatctcagccccaaaactctttaaggtgataagcaactccagcagtttcatgatacaaaatcagtgtgcaaaaatcacaagcattcctatacaccaataatagacaagcagggagccaaatcatgattgaactcctattcacaattgctacaaagaaaatttaaaaacccaggaatacaacttacaagggacgtgaaggatctcctcaagaagaactacaaaccactgctcaaggaaataagagaggacacaaacaaatgaaaaaacattccatactgatggataggaagaatcaatatcatgaaaatggccataccacccaaagtaatttatagattcaattctattcccatcaaggtattagtgactctcttcacagaactagaaaaaactaatttaaattttatatgaaacaaaaaaagagcccatatagccaagaaaaccctaagaaaaaagaccaaagctggaggcatcatgctacctgactttaaactatattacaagactacagtaaccaaaacaccatagtattggcaccaaaacagatatatagaccaatagaacagaacagaggccttagaagtaagaacacacttctataaccatctgatcatcgacaaacctgacaaaaacaagcaatgaggaaataattacctatttaataaatggtgctgggaaaactggctaaacagacacttctcaaaaaaagacatttatctggccaacaaacatgaaaaaaagctcatcatcactggtcattagagaaatgcaaatcaaaaccacaatgagataccatctcaccccagttagaatggtgatcattaaaaagtctggaaacaacagttgctggtcaggatgtggagaaataggaatgcttttacactgatggtggaagtgtaaattatttcaaccattgtggaaggcagtatggcaatccctcaaggatctagaacaagaaataccatttgacctagcaatcacagtacagggaatatacccaaaggattacaaatcattctactataaagacagatccacacatatgtttattgcagcactatttacactagcaaaaacttggaatcaacccaaatgcccatcaatgatagattggataaagaaaatgttgcacatatacaccataaagtactatgcagccataaaaatgaattagttcatgatgtcctttgcagggacttggatgaagctggaaaccataatcctcagccaactaacacaggaacagaaaaccaaacactgcatgtttttactcaaaagcgggagttgaacaataagaagacacacacacagggatgggaacatcacataccgtggcctattatggcattgggggaaaggggagcaagagcattaggacaaatacctaatgtatgcggggcttaaaacctaaatgatgggttgataggtgcagcaaaccaccatagcaaatgtatacctatgtaacaaacctgcacattcatcacatgcatcccagaacttaaagaaaaataaaaataattttaaaaagaaagaaaacctagtaaatacttttcttgacatgggttttggcaaataatttatggccaagttcctaatagcaattgcaaaaaaaaaaaaaaaaaaaaaattgacaaatgagwcctaattaaagtaaagggcttctgtgcaataaaataaattaccaatagaatcaacaaacagtaacagaatgggaraaaatatttgcaaactatacatccaacaaaggcctactatccaraacctacaaaaaacttaacaaatcaacgtgcaaaaaaraaaccacctgaacaaccacatgttgggtactatgtttatgacctggaagataggatcactagaacctcaagccacagcatcatacaatttactcaagtaacaaatctacatgatgtataccatttaatatataataaaagttgaaattaacaaaaaaaacaatgacaacaaaaacaaaatcaggcaatagaatcattcttttatcttggacttagaagacaaataatacaatgaggatatttaaggatattcagacaactaaagaaaaccatgttctaagaatcaaaagatggaatgacagtattttattaaatagagactatcattgaagagatgaaagttatttgaaagaaaaagcaaatagaaattttgaagttgaaaattaattaaaattaaaattcactagaggagctcaacattatgttttaaatggaagaataaagaggaaagaatcagcaggcttaatgatagatcagttggcataatttaatctaatgaacagagagaaaagcaaaagaataaaaataaacagtctcagggaccattgtgatacccatcaagcatactaatatatgcatatggagaattccagaacgggagatgagtaagaaaagatgaatcaaaaaaagtttgaggacattatatctgaaaatgtgatgaagttaacaaactctaagtaggacaaatgcaaagatatccaccctaaataaatgaaaaattcaaaagtagcaaagaaaaataacctacccatcaactagaaggaaaccacaataacagtgatggatgagttatcagaaacaaggaagccagaaaacagtgagatgatatttttaaaataataaaagacagccaaccaatactcttataattcacagaatctttcaaatgttaagacaaaataaaaacctttgcagataaactaaaactgaaagagaattgtgttgctaggagatcatctttacaagaaatactacagggagtttgtcttggtgaaagaaagtgacaccagacaataattcaaagtcatatgaaaaatcaaggagctctggtgaaggtaattacaaaagacataataattacaaatttattattatttcttctcttgcttttaaaaataatacccaaaacaattattaaatggtatgttttgaattatatataaatgtaatatatatgacagcaatagcacaaaggaatggagaaggaataaagctatattgtaacaagaaaatgacactcaaccataactgaaatccaaaaatggaatgaagactactggaaatggtaagcaggttaatgcaaaagactctacaaatgtactttcctcttttttcttgtcttctttcatacacacgcacacataaaaacacatacatacattatataaagcraaagctatagcactgtattgttggattayctctctctctctctctctctctctmtatatatatatatatatatatatatacccacacacacatagtatacataactataataacacagaaaaggattagagaatgcagctattttgctgcaaactttttgtattttactgtaaattagttaatagattctgaagagttaagatggctgttttaatccataaatcagtcactaaaaatacctcaaaatatagcctaacaactcaaaactaattaaaataatatactggaaaagtatatatatgtgtatatatatcttaattaaaataatatactggaaaagtatatatatatatataacaaaagtatgtaaaagaggaacagaaaaaacgaggcatatagaaaacatgtagcaaatcaggtatataaatacaacaatttcagtaataacattaaatttgaatggaacaaacactccaatcaaacggcaaacatgccaggctggatgcaaaaaatcaaggatcaacagtatgctatatacaaaggacacaattaagattcaaatagattgaaactaaaaggatgggaaaagatatttcctatctattattttccccacttgagatattggaaagcactcagcagtctccacagagtatatacacaaggcttctattgaaaggcaaaaggtatagggcagtgacagtctaagaatgcagacaagcattaagggtgtgaaataaatacattgtaggcaaccattgtggatgtaggattgatttcataatgcaagatgcctatgagccctaatcacatacacagaccatgctgaatcttgagctttaataatcaagatttgtacaaggaatcttggcttatagaggtctcaaaaacaagctctccagaggtggttttgctgctgtkgtttttgttgctgatgatgatgatttttgttaccctcaccacataattaagatagactttccaaacaagtttcaatctattattaaataagttgatttgggttccaagatggccaaataggaacagctccagtccacagctcccagcatgagcgacgcagaagatgggtgacttctgcatttccaactgaggtaccagatgcatctcactggggagtgttggacagtgggtgcaggacagcgggtgcagtgcaatgagagtgagccaaagcagggcaaggcatcgcctctcccaggaagtgcaaggggtcagggaattccctttcctagtcaaagaaaggggtgacagaaggcaccttgaaaatcgggtcactcccaccataatactgcacttttccaatggtcttagcaaagggcacaccaggagattatatcctgcacctggctcagagggtcctacacccatggagccacactcattgctagcatagcagtctgagatcaaactgcaaggtgacagcgaggctggaggagaggtgcacaacattgctgaggcttgagtaggtaaacaaagcagccaggaatcttgaactgggtggagcccaccacagctcaaggaggcctgcctgactctgtagactccacctctgggggcagggcatagccaaacaaaaggcagcagaaacctctgcagacttaaatgtccctgtctgacagctctgaagagagtagtggttctcccagcacagtttgagatctgaaaacggacagactgcctcctcaagtgggtccctgacctccaagtagcctaactgagagacaccccccagtaggggcagactgacacctcacacagctgggtacccctctgagatgaagcttccagaggaatgatcaggcagcaacatttgctgttcagcaatattcgttgttccacagctttcgttgctgataccaaggcaaacagggtctggagtggacctccagcaaactcaaacaatcctgcagctgatggtctacgctgttagaaggaaaactaacaaaaagaaaggacatccacaccaaaaatccatctgttggtcaccataatcaagacaaaaactagataaaaccacaaagatggtgaaaaaacagggcagaaaatctgaaaattctaaaaatcagagcacctctccccctccaaaggaacgcagctcctcaacagcaatggaacaaagctggatggagaatgactttgacgagttgagagaagaaggcttcagatgatcaaacttctctgagctaaaggagcaagttcgaacccaatgcaaagaagttaaaaacgttgaaaaaagattagatgaatggctaactagaataaccagtgtagagaagtccttaaatgacctgatggagctgaaaaccatggcatgagaatgacgtgatgaatgcacaagcttcactagctgatttgatcaaacggaagaaagggtatcagtgattgaagatcaaatgaatgaaatgaagtgagaacagaagtttacagaaaaaaatagtaaaaagaaatgaagaaagcatccaagaaatatgggactatgtgaaaagaccaaatctacgtctgactggtgtacctgaaactgacggggagaatggaaccaagttggaaaacactctacaggatattatccaggagaacttccccaatctagcaaggyaggccaacattcagatccaggaaatacagagaatgctgcaaagatactcctcgagatgagcaactccaagacacataattgtcagattcaccaatgttgaaatgaaggaaaaaatattaagggcagccagagagaaaggttgggttacccacaaaagaaagcccatcagactaacagcggatctctcagcagaaactctacaaaccagaagagagtgggggccaattttcaacattcttaaagaaaagaattttcaacccagaatttcatatccagccaaaytaagcttcataagtgaaggagaaatkaaatcctttacagacaaacaaatgctgagagattttatcactactaggcctgacctacaagagctcctgaaggaagcactaaacatggaaaggaacaactggtaacagccactgcaaaaacatgccaaattgtaaagaccttcaaagctaggaagaaactgcatcaactaacgagcaaaataaccagctaacatcataatgaaaggatcaaattcacacataccaatattaaccttaaatgtcaatgggctaaacgctcctattaaaagacacagactgrcaaattggatagagagtcaagacccatcagtgtgctgtattcaggagacccatctcacatgcagagacacacattggctcaaaataaagggatggaggaagatctaccaagcaaatggaaaacaaaaaaaggcaggggttgcaatcctgatctctgatgaaacacactttaaaccaacaaacatcaaaagagacaaagaaggccattacataataaaaaagtgatcaattcaataagaagagctaactatcctaaatacatctgcacccaatacaggagcacccagattcataaagcaagtcctgagagacctacaaagagaattacactccaacacaataataatgggagactttaacaccccactgtcaacattagacagatcagtgagacagaaagttaacaaggatatccagtaattgaactcagctctgcaccaagcggacctaatagacatccacagaagtcttcaccccaaatcaacagaatatacattcttcgcagcaccacacctcacctattccaaaattaaccacatagttggaagtaaagcactcctcagcaaatgtaaaagaacagaaattataacaaactgtctcttagatcacagtgcaatcaaactagaactcaggattaataaactcactcaaaaccactcagctacatggaaactgaagaacctcctcctgaatgactactgggtacataatgaaatgaaggcagaaataaagatgttcttcaaaaccaatgagaacaaagacacaaaacaccagaatctctgggacacatttaaagcagtgtgtagagggaaatttatagcactaaatgcccacaagagaaagcaggaaagatcgaaatttgacaccctaatatcacaattaaaagaactataggagcaagagcgaacacattcaaaagctagcagaaggagagaaataactcagatcagagaaaaactgaaggagatagagacacaaaaaacccttcaaaatatcaacgaatccaggagctggttttttgaaaagatcaacaaaattgatagactactagcaagactaataaagaagaaaagagaagaatcaaatagacacaataaaaaatgataaagcggatatcaacaccaatcccacagaaatacaaactaccatcagagaatactataagcacctctatgcaaataaactagaaaatctagaagaaatggataaatttctggacacatacaccccctaagactaaaccaggaagaacatgaatccctgaatagaccaaaaacaggctctgaaattgaggcaataattaatagcctaccaaccaaaagaagtccaggagcagatggactcgcagccaaattctaccagaggtacaaggaggagctggtaccattacttctgaaactattccaatcgatagaaaaagagcgaatcctccctaactcattttatgaggccagcatcatcctaataccaaagcctggcagagacacaaccaaaaaagaattttagaccaatatccctgatgaacattgatgcaaaaatcctcaataaaatactggcaaaccgaatccagcagcacataaaaaagcttatccaccatgatcaagtgggcttcatccctgggatgcaaggctgcttcaacacacgcaaatcaataaacgtaatccagcatctaaacagaaccaaagacaaaaaacacatgattttctcaatagatgcagaaaagggcttcaacaatattcaacagcccttcatggtaaaaactctcaataaatcagatattgatggaatgtatctcaaaataataagaactatttataacaaactcacagccaatatcatactgaatgagaaaaaactggaagcattccctttggaaactggcacaagacagggatgacctctctcaccattcctattcaacatagtgttggaagttatggccagggcaatgaggcaagagaaaggaataaagggtattcaattaggaaaagaggaagtcaaattgtccctgtttgcagatgacaagattgtaaatctagaaatccccattgtctcaacccaaaatctccttaagctgataagcaacttcagcaaagtctcaggatacaacatcaatgtgcaaaaatcacaatcattcttatacacccataacagatagagaaccaaatcatgagtgagctcccattcacaattgcttcaaagagaataaaatacctaggaatccaacttacaagggatgtgaaggacctcttcaaggagaactacaaaccactgctcaacgaaataaaagaggatgcacataaatggaagaacattccatgcttatggataggaagaatcaatatcgtgaaaatggccatactgcccaaggtaatttatagattcaatgccattcccatcaacctacaaatgactttcttcacagaattggaaaaaactactttaaagttcatatgaaaccaaaaaagagcccgcattgccaagtcaaccctaagccaaaagaacaaagctggaggcatcacactacctgacttcaaactatactacaaggctacagtaaccaaaacagcatggtgctggtaccaaaacatagatacagaccaatggaacagaacagagcactcagaaataataccacacatctacaaccatctgatctttgacaaacctgacaaaaacaagaaatgaggaaaggattccctatttaacaggtggtgctgggaaaactggctagccatatgtagaaagctgaaactggatcccttccttacaccttatacaaaaattaattcaagttggattagagacttaaatgttagacctaaaatgatagaaagcttagaagaaaacctaggcaataccattcaagacataggcatgggcaaggacttcatgtctaaaacaccaaaagcaatggcaacaaaagccacaattgacaaatggaatctaattatactaaggcgcttctgcacagccaaagaaactaccatcagagtgaacaggcaacctacaaaatgggagaaaatttttgcaatctactcatctgacaaagggctaatatgcagaatctacaaagagctcaaacaaatttacaagaaagaaacaactccatcaacaagtgtcctgtagtttttttgttgttcktgtgttctttcatgtttttaatatcgtggagatactggatttgtacaatgatttagagaggtattcctmcactttgattttttggaatagcctcagtaggatgacaccagatcttttctgtacatctggcaaaacctgactgtgaatctgtctgttcctgttcttttgtttgttggaagatttgtattactgattagattagtgattagatctctttgttggaagatttgtattactgactagatttttttttttacttgtttgtggtctgttcaggttttctatttcttgctagttcaatcttgagaagttgtatgtttccaggaaactatcaattttctctagattttctagtttgtgtgcatagaattgtccatattagtccctgattgtctttggtatttctatggcataagttgtaatatcaccttcatcatttctgattgtgcttatttgaatcttctctgcttcttttttgttttttcattagtcctgctaggggtctgtcaagtttttttctaatgctttcaaagaactaaattttctttcattaatcctttttagctttttgtggtctcaatcctatttagttaatcctggccatgttatttcttttcttctgctagctttggatttggtttgttcatgtttttatatttccttaaggtgtgaattagtttgttaattttagagctctctctccttttcatgtaggcatttaatgctataaactttcgttttagcacttttttgctgtgttttagatgttttgttatattgtgtctgtttttatacacttcaattttttttaaatttctgccttaatttcattgttcacccaaaaattatttaagaataagttgtttagtttccatgtattagcatagttttgagagattttcttgttattgctttctaaatttattccactgtggtctgagaagagacttgatattattttacctttttgaatgcgttgagacttgctttctggccaagcatatgttcaattttggagaatgttccatgcacaagtgagcagaatgtatattctgtggttgttgtgtatgctatagtgtaaatgactactacgtccatttgatctataatccagttaaatcttgttgattttctgccttgattatctgtctagtgatatcagtggggtgttaaagtcccactattgatatgttgctatcaatctattttcttaggtctagaagtatattttttataaatctgratgttccagtgtctgttgcatatataatttaaataaataaatcttcttttattggagcttttcttaatatataatkaccttatttatattttagtaccattgttgatctaaagtctgttttatctgatatgaaagtggttattcctgcttgcttttgtttttcatttgcatggtgtatctttttccaccgttttactttgagtctcattgtgcctttggccagtaggtgggtctcttgtagactgcagatggttgggtcttattttgtgactctgtatcctttaagtggagtatttatgccatttacatgcaagattaatattgatatgtgaggttttcttcctattacaatagtgttagttattttggagtttccattgtgtaattgctttgtgtgatctgtgaactttgtacttatgtgtctttgtctgacagtgagtatcttccatttgttttcatgtttacaattcatttaagcattttttgtatgtccaatctagtggtgatttttttaaaattttacattaacttctgggatacacgtgtagaatatgcatctttgttacataggtatacatgtgccatggtggtttcctgcacctatccgcccatcatttaggctttaagccctgcatttattaggtatttgtccaaatgctctccctccccttgtcccccgcccccaacaggcctcagtgtgtgattttcccctccctgtgtccatgtgttctcattgttcaactcccacttatgagtgagaacatgtggtatttggttttatgttcctgtgttagtttgctgagaattatggctgccagcttcatccatgttcctgaaaaagacaagagcttgttcttttttatggctgcatagtattccatgatatatatgtgccatgttttctttacctagtctatcactgattgacatttgggttagttccaagtctttgctattgtaaataatgctgcaataaacatatgtgtgcatgtgtctttatagtagaatgatttataatccttcaggtatatatgcagtaatgggatttctgggtcaaatggtatttctggttctagatcattgaggaattgccacattgtcttccacaatcattgaactaatttaaaagtgtaaaagcatttctattcctccacaggcacaccagcatctgttgtttcctggtttgttaataatcgccattctaactggcgtgagatggtatctcattgtggttttgatttgtgtttttctaatgaccagtgataaggagcattttttcatatatctgctggccgtataaatgtcttcttttgagaagtgtctgttcatatccttcacccaatttttgatgggattttttgtatctttcttgaaaatttaaattccctgtagattgtggatattagacctttgtcagatcggtagcatgcaaatctttttttccattttgtaggttatctgttcactctgatgctaatttcttttgctgagaagaagctatttaatttgattagattgcatttgtcaacttcagcttttgttgcaattgctcttggtgttttattcatgaagtatttgcccatgcctatgtccagaatggtattgcctagggtttcttctgggtttttatggttttgggttttacatttaagcctttaattcatactaagttaatttttgtataaaatgtaaggaagggattcagtttctgttttctgcatatggctagccagttttttcagcatcatttattaaatagtgcgtctttccccattgcttgtttttgtcaggtttattgaagatcagatggttgtagctgtgtggtgttatttctgaggtctctgttctgttccattgatctatatatctgttttgataccagtgccatgctgttttggttactgtacccttgtagtatagttttaagtcaggtagcatgattcctccagctttgttctttttgcttaggattgccgtagctaaatgggctcttttctggttccatatgaaatttaaagtagttatttttaattctgtgaagaaagtcaatgatagcttgatgggaatagcattgaatctatgaattactttgggcaatatggccattttcaggatattgattcttcctatccatgagcttgaattgtttttccatttgtttatgtcctttcttatttccttgagcagtgttttgtagttctccttgaagaggtctttcacgtctaatggaagttgtattcctaggtattttattctctttgtagcaattgtgaatgggagttcaatcatgatttggctgtctgcttgtctattgtttgtgtataggaatgcttgggatttttgtacatcgattttgtatcctgagactttgctgaagttgcttatcagcaacttaaggagtttttgagctgagacaattaagttttctaaatatacaataacgtcatctgcaaacagagacaatttgacttcctctttttctacttgaataccctttatttatttttcttgcctgatttccctggccagaacttccaatactgtgttgaataggagtggtgagagagggcatccttgtcttctgctgggtttcaaagggaatgcttccagcttttacccattcagtatgatatcggctataagtttgtcataaatagytcttattattttgagatgtgttccatcaatacctagtttattgagagcttttagcatgaaagggtgttgaattttatcaaaggccctttctgcatctatcatgtggattttgtcactggttctgtttatctgatggattacgttttgattttcatatattgaaccagccttgcatcccagggatgaagccgacttgatcatggtttataagctttttgatgtgctgctgagtccgttttgccagtattttattgaggattttcacattgatgtacatcagagatggtggcctgaaattttccttttttgttgtgtctcttccaggttttgttatcaggaagatgctggcctcataagatgcattaaggaggaggccttcttattctattgtttggaatagtttcagaaggaatggtaccagctcctctttgtatatatggtagaatttgactgtgaatctgtctggtcctgggctttttaaattgatgttcttggacttttttttttttaattactgcctcaatttcagaatttgttattggtctattcagggtttctaattcttcctggtttagtcttcagagggtgtatgtgtccaggaatttatccatttcctctgtgttttctagtttatttgcatagaggtgtttacagtattctctgatggtaatttgtatttctgtggaatcagtggtgatatcgcctttatcattttttattatgtctatttgtttgttctctatttttttcattattagtctatatagtgatctatttattttgttaatcttttcaaaaaacctgttcctggagtcattgatttttttgaagggtttttcatgtctcaatctctttcagttctgctctgatcttagttatttgttttttaatttttaataatatgttatttatgttatagtattggcttaaaagacacaataatataattacactgctacatattcatgaaaaattatttcatcaacaaagcaggatattaagctgtaatgggtacagcttttaataatcatatatttacttagtagaaaaaaatctggactactataaactaaaacatttactgtggctgtttttgttttgatttatactttcttttgtttattgctatgttctaaattttctttttatatatattattatactttaagttctagggtgcatgtgcacaatgtgcaggtttgttacacatgtatacatttgccatgttggtgtgctgcacccattaactcgtcatttgcattaggtatatctcctaatgctatccctccccgctcccccaaccccacaacaggccccggtgtaagatgtttcccttcctgtgcccaagtgttctcattgttccattcccacctatgagtgagaacatgcagggtttggttttctgtccttccaatagtttgttgagaatgatggtttccagcttcatccgtgtccctacaaaggacatgaactcatccttttgatggctgcatagtattccatggtgtatgtgtgccacattttcttaatgcagtctatcattgttggacatttgggttggttccaagtctttgctactgtgaatagtgccacaataaacatacatgtgcgtgtgtctttacagcagcatgatttataatcctttgggtatatacccagtaatgggatggctgagtcaaatgctatttctagttctagatccatgaggaatcaccacactgtcttccacaatagtagaactagtttatagtcccaccaacagtgtgaaagtgttcctatttccccacatcctctccagcacctgttgtttcctgactttttaatgattgccattcgaactggtatgagatggtatctcattgtggttttgatatgcatttctctgatggccagtaatggtgagcattttttcatgtgttttttggcttcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgattgcagtttcttttgctaaagaagctctttagtttaattagatcccatttgtcaattttggcttttgttgtaattgcttttggtgttttagacatgatgtccttgcacatgcctatgtcctgaatggtaatgcctaggttttcttctagggtttttatggttttaggtgtaacgtttaagtctttaatccatcttgaattaatttttgtataaggtgtaaggaagggatccagtttcagttttctacatatggctagccagttttcccagcaccatttattaaatagggaatcctttccatatttcttgcttttctcaggtttgtcaaagatcagatagtggtagatatgtggcattatttctgaggactctgttctgttccattgatgtatatctctgttttggtaccaataccatgctgttttggttactgtagccttgtagtatagtttgaagtcaggtagcatgatgcctccagctttgttcttttggcttaggattgacttggcaatgtgggctcttttttggttccatatgaactttaaagtagtttttcccaattctgtgaagaaagacattggtagcttgatggggatggcaatgaatgtataaatgaccttgggcagtttggccattttcacgatattgattcttcctaccaatgagtatggattgttcttccatttttttgtatcctcttttatttcattgagcagtggtttgtagttctccttgaagaggtccttcacgtcccttgtaagttggattcttaggtattttattctctttgaagcaattgtgaatgggagttcactcatgatttggctctctgtttgtctgttattggtatataagaatgcttgtgatttttgtacgttgatttttgtatcttgagactttgctgaagttgcttatcagcttaaggagattttgggctgagacaatggggttttctagatatacaatcatgtcatctgcaaacagggacaatttgacttcctcgtttcctaattgaatgccctttttttccttcccctgcctaatttccctggccagaacttccaacactatgttgagtaggagtggtgagagagggcatccctgtcttgtgccagttttcaaagggaatgcttccagtttttgcctatttagtatattggctgtgggtttgtcatagatagctcttattattttgagatacgtcccatcaatacctaatttattgagagtttttagcatgaagaggtgttgaattttgtcaaaggccttttctgcatctattgagataatcatgtggtttttgtcttggttctgtttatttattgattttcgtatactgaaccagccttgcatcccagggatgaaacccacttgatcatggtggataagttttaattgatagaccactagcaagactaataaagaagaaaagagagaagaatcaaatagacgcawtaaaaaatgataaaggagatatcaccaccaatcccacaggaatacaaactaccatcagagaatactacaaacaccgctatgcaaataaactagaaaatctagaagaaatggataaattcctcgacacatacaccctcccaagactaaaccaggaagaagttgactctctgaatagaccaataacaggctctgaaattgtggcaataatcaatagcttaccaaccaaaaagagtcctggaccagatggwttcacagccgaattctaccagaggtacagggaggaactggtaccattccttctgaaactattcctatcaatagaaaaagagagaatccttcctaactcattttatggggccagcatcatcttgataccaaagccgggcaaagacacaaccaaaaaatagaattttagaccaatatcctcgatgaacattgatrcaaaaatccttaataaaacactggcaaaccgaatccagcagcacgtcgaaaaccttcaggtgctcttttaaggctggtttggtggtgacaaagtttctcagtatttgtttgtctttgaaagattttatttctccttcccttatgaagcttagtttgtttggatgtgaaattttggtttggaaacgattttctttaagaaagttgaatgtttgcccccactgtctttaggcttgtagggtttctgcagattaatccattattggtctgttcggcttccctttgtaggtaacctgacctttctttttggctgctgttaacattttttccttcatttcaatattggagaatctggcgattaggtgtcttggggttgctcttcttgaggagtatcttaatggtgttttctgtatttcctgaatttgaatgttggcctgtcttgctaggttggggaattttcctggataatatcctgaagtgtgctgtctaacttgattccattctccccatcaccctcagggaccccagtcgatcgtaggtttgttattttcacatagtcccatatttcttggaggctttgtttttttttccttttcactcttttttttttctaatcttgtaatcttgccttatttcagtaaggtgattttcaatctctgatatcctttcttccacttgatctatttggctattgttacttttgtatgcttcacgaagttctcatgctttttttcagctccatcatgtcatttatattcctctctaagttggttatttaagttagcatttcctgtaaccttttatcaaggtttttaggttccttgccttgggttagaacatgctcatttagctcagaggagtttgttattacctacatactgaagcctacttctgtcaatttgtcaatctcattctctatccagttttgtgcccttgctggagaggagttgcaatcttttggagaagaggctttctggtttttggaattttcagtgcttttgtgctgttttttttcctcatcttcatgtatttatttacctttgatctttaaagctgataaccttggatggggtttttgtgtggggttctttatgttgatgtcgatgttgttgctttctgtttattagtttttcttctaacagtcaggcctctcttctgcaggtctgctgcggttgctggacgtccaatccagaccctgttctcctgggtatcaccagtggaggctgtagaacagcaaatattgctgcctgctccttcctctggaagctttgtcccagaggggcaccaacctgatgccagctggagctgtcttgtatgaagtgtccttcgacycctgttgggaggtctctcccagtcggatgcacaaggtcagggacccagctgaggtggcattcggtcccttggcagagctggtgcactgtgctgggagaatccctcttgtcaggattagttgttctcttcagagccagcaggccagaatgatgaaatccgctgaagctgctcccacagctaccccttcccccagatgctctgtcccagggagatggtagttttgtctgtaagcacccgactggggctgttacctttccttcagggatgccctacccactgaggaagaatctagggattcagtctggccacagccactttgctgtgcccagcccagacctcccagcctcctcagtgctttcaggggaaaactgcctaccaaatcctcagtaatggtgaatgcccctccccccaccaagctcaattgtcccaggttaacctcagactgttgtgctggctgcatgaatttcaagccagtggttcttagcttgctggactccctggcagtgggacctgctgagcaacaacactaggctccctggcttcagacccctttccaggagagtgaacagttgtgtctcactcaggttccaggtgtcactggggttccaggtgccactgggatatgrcaaaaatatgcctgcagctatctcagtgtcaaaacagccacccagttttgtgcttgaaactcagggccccggtggtgtaggtacacaagggaatcttctgatctgcagattgtgaaaaccatgggaaaagcatagtaacctagctgggtagcgcagtccttcatagcttcctttggctgggagagggaggtcccccaacttcctgtacttcctgggtgaggcaatgccccaccctgcttctgctcaccctcctgtgggttggacccactgcctaaccagtccctacgagatgaactgggtacctcagttgaaaattcagaaatcatccaccttctgcgttggtctcaatgggagctgcagaccagatctgcttgtattcggccatcttggcttcattccctcaatttttttttttttttttttttgcttgtctgggaaatattttatttctccttcatttatgaaagagtttggcaggatataaaatttttggctgcaggtttttattttttaaaggagttaaaatagcccccagtctcttctgagttttgggatttttgcagagaagtccactcttagcctgattggttttgttttataggtgctttgatccttttctctacctatctttaatgttttcttctttattatttactttagatagtctgatcactatataccttcataatgtttattttaaataatatctcacaggtgttctctgagtttcttgtatgtggatatctttctagcaagattagcaaaatgttcctgaattatttcctcacgtatgttttcaaggttgtttatgtttttcttcctctctcttagaaatgccaatatgttataggttttgttgctttacataatcccatatttcacaaagactttgttccattttttaaaattatttttttctttatttttgtctgaccagtttagtttgagagactgatcttcaatctctgaaattctttcttctacttggtctagtctattattaaagtgttcaactttattttgaaattccttaagtgaatttttcatttccagaagtcctgtttgattttttaaaaaaatatatttatctcttccttcatatcctgaattgccctcatattttctttttggttggttttcagtcttgtcttggatcttgtggagcatcctgacaatccacagtttgaattctttatctgtcatttctgagtttccattttggttaaggtccattgctagaaagctagtttgactcttgttgatatcacaacattcagctttttcatggtgccagatttcttatgccgagttcttctcatctggaggtattgtcacttacttttgaaatttatttttgttcagatggtatttttctttccctattttttcttcctccctcctgagaatgttactgtgtagtattctgggtagagtccttggctctgctcctatttcctgtgcactgggggcaacttttttttttttttttttttttttttttttttgaracggrgtttcgctcttatttcccaggccagaatgcaatggcgcacaataaatctcagctcaccacaagctccacctcccgagttcaagcgattctcctgcctcagcctcccaagtagctgggattacaggcatgggcatgtgccaccacacccagctaattttgtatttttagtagagacgggatttctccatgttggtcaggctggtctcgaactcctgacctcaagtgatccacccgcctcggcctcccaaagtgctgggattacagacatgagccactgcgcccagccactggcaacttttttattgcgcttttcactttgacctgctggccagggggtagcacttaagggtaagacacagatgtggcacaagaagatgggtatttcatctctgttgtttcaggtaatgagctagatcgtggtgttccctatgccctgagcttgcttcttaactgtggctggggagacacacctgatctgatttggaccctttggcttgcccacaaatactccaatgatgactacaggcactagtcttgataggggtggctgggggaactcctggtacaaacacttaggcctctgctggaagtgagggggatgcactgccttcatgtcgtaaataggcaggaacacaatctgttcccttttcacgcccttgttgtagggctcatcatgtacacttcagatgcacgttgttgtctctccaggccacagtgtgtctgagagccagggagaatgcctctcttgcaactcyccatggaggtgtttttgaagcagaatatatttactcactcaacccaaatacagacagctttatggctcacatcttctttgacatattagtgttgctgcttcgtggaagkgagaggtctgcctttcagcccatgtggtgagtgtcatttgtggtggtgtaagctagttaggttagtctgacctcaggtgccaggaggactggataggtactagctgtgttagactgggctaggtagctcaccagtctccaggcccctagatggccaattggatgacatttacgagtcctgaaggggctggacctgggttgagccagcccagagttcagtgctgtctrtgtaatggggagagttgggttggtccctgggtcactggctgaactctcaggcaggtcaggcagaccagtcaggtggtgggaacctgagggtggataactggcctgtggttattgggctctccaagaggctctgggctgcagctgaaatattcagttgggggcaagccagccatgatgtggacctttcattgggtagggcaagtccccaaagttggaaaaatggaaagtgggagctgtgaggcacgtgttacacccacactttcctcctacagatgcagtgttggattttgttgtgggaggcatgcacaggtaggtgccaggcctccctactctctccctggcccagaggtgtcaggggcaaagttagtggcagtggtggctgcaaaatggttggcagcaatctgtgggatttgggctatcaaagaaatgccaagccatggccacagtcttcaagcaggggcaggggaaggtgcactggtgacctggagcctgcaaaccccatttggtgtgaagcagtataagtggggagttgtgtggcatgcagcaaacctgttgcttctttgtacttcagctgtggtatctgtgctgaaggctgcagaagtgcctagctttcccatttcctccctagcccaggggaaggagggatggcataacttctgttacttaaacattggttattttgatagcgtcccataattctcagaccttcttcattattttttcttatactttctttaactaccttacctttccttaaataattctacttataacattccttaactacttctgaattcattatcagtcatttcatagatctctatttattcagggtccataattagaggtttattagtttattttgtgattttaaaaaattatttgtaatttttgtgttcttgttttggtgcctatgtgtttgggtacatggccacctctttcagcctttgtaggtgttctttggcaatgataatctttcagtatttattctaacctgggatttttggtggaccaactgatagcaaccctggacagctgaccttgctcttgggttctctagctggggtgagctgctgcctatagtttgaggttgagtggaatggtgagctgtgctttgtagtctgatgagacaactagctgggttttaatttggcagtgctgatggctatcctttgcaatcacctctgatcagattgcattgcatgctgccttccccagtaaaacagtactgctgtttggaatctgtagtcagtcagggccatgtgctggtgctcttaggctcgaggaggtctctggggttactgttcagccacctgggacaagacacattaggtacttcctttcacagatattcatggatcagcacttgccttctggcctgaggaagccttaaagagaatattaagtgttagtgggattgtcatacagtcagtggggttgggtgggrccagatgctctacagttgcctccmagcctggaaaaggctcaaggagagaaatgacattacataaggaagctggctagggacttcagctaagcaaactcatgcactatggttcctgcagggcagtcctgttggctgttttctatcatttggcaccttcattgacaaaagtgaagagccactgccaaaatccatgtgctcatcattgtgaaccccaccctttttctttgtttctaacaaatctcaggtgccctagctctgctggtactcccaatgtttgtcatggaatgagacaagagtgagcttcctgtaaagcaccccacaatgatgaggaagctggatatatgtttacagctctcttttcccctacagaaacaagagcccaggggaatcttctttggcactgttacagcttgagagagggtgatgcgaaatgaaaccattcctcttaccctttgaatgcagctgttatctgttctgtggctggaggggctatctcccaaattcagggatattcatgaaagtattcttatctgcggatagttagtagttggatttatgtgacggggactggaactgcagaactcctcctattccgttatcttgctgacatcactctctttactttcctctcaatttacttttaataaaggaggtttcaagacagttcaatgaagaattaatagtcttttcatcaaatggttctaggacaactggatatctacgtgcaaaagaataaagttggagcctttccacacacccaccgtatacaaaaactaatgtaaaataaataggagacctaaatgtaaaagctaaaactctaatatttttataaggaaacatgagtacatcttcatgaccttgagataaaaggtttcctagatacagcttcaaaagcccaggcaataaaagaaagcatgataaattagaatttgccaaaattaaaaaaaaaaactatatttcaaaatataacaataaagtaaaaaggaaagacactgaccaggggagaatatttgcaaattatataacgcctggggatttatattccaaacatatgaaaaactcttacaactcaataataagacgataacccaacttaaaatgcacaatggatttcaatagatatttccctaaagaaaacatactaattgcccataagtgcgtgagagaatggtcaatataattactcattagggaaatgcatattaaaatcacaaggagttatcaatgcacattcactaaaatagttataaaccaaaaggataagggttaatgagcatgtggagtaactgggaccctcatacatttctggtaagactgttgtcamattggtgcagactctttggaaaacaatttggcattttcttaaaatgttaaatgtaaatttgtcataagactcaactatttcattcatytttatatgtatatatatgctcaagaaatgaaaataaatattcatacaaagacataaacaaatgtgtaattatattgctgatttttgcagcataattagtaatagccaaaagtattagtccaactgtccagtaactggtgaatagataatcaaaatttggtatatttattcaatggaatagtctttgtccataaaagaaccatttatataaaccttgaaaacattgtgcagagtggaagaaatcagacaaaaaatgttacatattatataattcaatttctagaaagtgttcagaataggaaatctatatggataaaaatttaattactggatactggggattgggggaatagagaaatggagatttctagattgtggtgatgcttgcacaattctgtaaatttattagcaatcattaaactgtacatttgaaacggggaatcttattttatataaattatgctgcaataaagttttataacagcatgaatgaggtaaataatgacaaatcacaactctagattagtgtgaaatgatattacaaaatgtttatagcttaaaagaaaatccatatatttaagaatatattattctactttataatttactctgatttttctgaaagtgctatggaaaacaaattagaaataacgtcatgtgaaagaactttaggctattattcacactttctgcattcagatytcaattacagcttttgctagccaagtgatcttggatatgttatctaacttctctattcttcagtcatttcatcagaaaaatagtgataattaatagcttctatattatgagcttgttgtgatgtcaaatatttaatacagataaagttcctaaatattattaagtcctaagtagatagtaaattataattatatattttcacctatttattattggtaaaataattgaaaaaatacgktttcaggaacaggtcttgatttctcacttattttgtttgttttcttcaggtgtcttcagtgccctgggtttgcctgtgacccaatgcccactgggactgaatgccaaaggactccctttaggcatccaggttgtggctggaccctttaatgatcatctgaccctggctgtggcccagtacttggagaaaacttttgggggctgggtctgtccaggaaagttttaggaggaccttctgcaaggttaatgtgtgtgtgtgtttgtgttcgtgtggtggtgtttctattaattgggtgaaaycaagcaccagcagacaagcagagaaacaactggggaatttattgactcatttagttattctttctacttttatttccttctctaactgttggtcttactaaaatggtaatatttgcttcttgcttttatgttactggaaaattaggacatgtaaatggataagtgcaataaagtttcctaaatgctggaatcgtgtctgttttgggtacagcagggaaattaaagaagggaatgtccagtgctaatgaggggatcttaagaaactttagagaagagatgttgctgaaactgacaaatggagagttacgtgttttcgaggcaggccattaagtaagggaattccagttagaagaagctacagtgaagaaggcaaggacatgctgctgtaagttagtatggctggcgggaaactggaggggggtatgtaagtaatgagaccatggtaaggaaagctcttccaatatcccccaaaaatgttttataattttgttcactaagagatcctagaagcaacaggtcctagaacaacattacacgtatgattatatatattatataatcatatatatgttatatatcatatatcatatatataatcatatatataatggatttagaaagtcattgttttgaaaccatcaaataatacttaattcatacatagctcatcaatggatcctaaaaccactggataaaagtttgacaaacagaatatttttagtctcaaaatatcttttcacttaccacttattaatttcaagagtggggaatattacctgtagagtgcagatatatggtagacaccatcataatcaaatagccaacattaatctgagcaacaaatctatgatgtccctgacaagaatgcatcacctgaatctaattgtaagaaataatcagaagaaaccaaatttataaacatcttacaaaattaagggcctacattattcaaatatgtcaaagaattaatgccagtgacaggctaaggaactgctccagaataaagatgaataaagacccatgataactaaattcaatgtgtgatctcaaattggaaaagtaagatttttaaaaaagatagtgttaagacaattggacaaatataaatgtaggatgttttgtagataatgtactgtggcaatttctgaatttcattttgtttttatttatttatttttttgttatactttaagttctgggatacatgtgcagaatgtacaggtttgtcacataggtatacatgtgccatggtggtttgctgcacccaccaacccgtcatctatattaggtatttctcctaatgctatccctccccccactccctgacaggtcccagtgtgtgacattcctctccctgtgttcatgtgttctcattgttcaactcccacttatgagtgagaacatgcagtattgggttttctgttcttgtgttagtttgctgagaatgatggtttccagcttcatccatgtccctgcaaaggggacgagctcatcctttttttatggctgcatagtattccatagtgtatatgtgtgtcacattttctttttcctgtctatcattgatgggcatttgggttggttccaagtctttgctattgtgaacagtgctgcaataaacatacacgtgcatgtgtctttatagtagcatgatttataatcctttgggtaaatggcatttctggttctagatccttgaggaatcaccagactgtcttccacaatggttgagctaatttacactcccacaaacagtgtaaaagcattcctagttctccacatcttctccagcacctgttgtttcctgactttttaaagatcgccaaactggcatgagatggtatctcattgtggttttgacttgcatttctctaatgaccagtgatgatgagatttttttcatatgttatttggccgtataaatgtcttcttttaagaagtgtctgttcatatccttagcccactttttgatgggaaagcttttttcttgtaaatttgtttaagttttttgtaaattatggatattagccctttgtcatatggatagattgcaaaaattttctcacattctgtagattgctggttcactctgttagtttcttttgctgtgcagaaagagagcacctgggggaaggggtagctgtgggtgcagcttcagcagacttaaaccttcctgcctgctggctctgaagaaagctgcagatctcccagcacagcgctcgagctctgctaagggacagactgcctcctcaagtgggtctctgaaccccattcctcctgactgggagacacctcccagcaggggtcaacagatacctcatacaggagagcttcagctggcatctggcaggtgccccttggggacaaactttgcagaggaaggaacaggcagcaatctttgctgttctgcaacctccattggtgatacaaaggcaaccagggtctggagtggacctccagcaaactccagcatgcctgtagcagaggagcctgactgtttttgcatctatatttattagaaatattgacctgtagtttcctttttttagcttctttgtctggtttcagtattgtagtaaccttggcatcataggatgagttaggaagaatccatcctcctcaattttttggaaaagtgcagtgttagttctttaaaagtttggaagaacttggtagtgacgccaactattcctagagttttctattttgggaggcatcttattactgatgtaatctcattattcattattagtctattcagattttatgaacatatatgtgccaaacactggaacacccagatgtataaagcacatattatatgtaagtcaaagaaaagatttcaatactctactagttgaggactttaacatactactctaagaattaaacacataatctaggcagaaatttaaaaaagaataattggatttaaaccgcactttagaccaaaggaacctcatagacatttatggaactttatatctaagaactactgagcataaattttttatcagcacgtagaacattctccagaattttacactgtaggttaagccacgaaaagatctcaacatattgaaaaaattaaaatcatataaagtatactataagaccaaatggaataaaactagagataaatagcatgagaaacattggaagccatataaatacacgtaaattaatcaacaggttctgaataaccatgggatcaacagagtaattaagatagaagtcaaaaaatttgttgaaacaaatcaaaatggaaacacaacataccaaaacttgtgagacacagcaagagcagtgctcagactaaactttatagcaataaatgcctatattaaaaaaaagtataaaagattacaaattagcaatctaacaatgcactgcaatgaactaagaaaacaagaacacaccaagcccaacattatgagaagaaaagaaataacatagaccagagcaggactaaattatgtagacagtaaaaaaaacagaggattcataaaacaaaaaagatggttgttcaaaaagataaacaagattgataaagtgctaactagagtaaccaacaaaagaaaagagaatgtccaaataaagaaaatgataaataagtgggagtgctatgcaattcttgcacttctacgaagaaatatatgagatggtaatttttaaagaaaagaggtttaattggctcattattctgtaggatttacatgaagcatggtgccagactctgctcaggttccagcaattctactattgggtatctacccaaaggaaaaaaataatatatcagtgggatacctgcattctcatgtttaatgaagcagtattcaaaaacacaatgatatggaatcaacctaagtgtgcaacaacaggtgaatgaataaaaaagtgtacaatatatacacaatgaaatactttttggccattaaaaacaaacaatgagatcatgttattttcagcaacaaggttgggactgaagaacgtatgaaatatgccaggcacaaaaacataaatattgcatgttctcacttacatatgggagctggaaaattttatcacatggagatatagagtggaaagatagataacagagactgagaaggatgattggggctgagggtggaggataaaaaatagtggattaagatgtacaaatcatagaaggaataaatttaatgcttgacagcagagaagtgtaactgtagtttaaaaaaaattgtacttgagtgacaccctaaataccctgactcgatcactacacattatatacatgtaacaaaatttcacatgtaacttataaatttttacaaataaaaaaattttaaaaataaatcttatcaagtatctcctcagcccacaattgaataaaactaggaatcaataacaagaggaaatttagaaactgtacagaaatatggaaattaagcaaaatgctcactgggcgtggtggctcatgcctgtaatcccagcactttgggaggccgaggttggtgcatcacttgaggtcaggagttcaagaccagactgatcaacatggtgaaaccccctctctactaaaaatacaaaaaagctagccgggcatggtggtgggtgactgtaatcccagctactcaggaggctgaggcaggagactcatttgaacccgggaggcagaagttgcagtgagccgagatcatggccactgcacttcagcctgggtgaggaaacaagactctgtctcaaaataaataaacaaacaaacaaaatgttcatgaatgaccattgggtcaaggaagaaataaaggagaaaatgcatttctggaaacaaatgaaaatcaaaatacaatgtaccaaaacctatgggatacagcaaaacagtgctaagaaggaagtttatagcaataaacacctacatcaaaaaagtagaaaaagactgggcacagtggctcacctggtaatcccagcactttgggaagctgaagtaggaggatttcttgagcccaagagtttgagactagcttgggaaaaaaaagcaagaccctgtctttacaaaaataaaaataagaaaattatctgggagtagtggtacacaactaaagtcccagctgcttggccggaagatgtgggaggatcacttgagcctgggaggtcaaagctgcagtaagccatgattgcacgactgcactccagcctgggcaacagagaaagatcttatctgaataaaataaaataaaataaaataaacaatctaacaatacacctcaaagaaatggaaaagcaagaaccaaaccccaaatgagtacaagaaacaaaataacaaatatcaaagcagaactaaatgaaatagagaccaaaaaatcaatacagagtgtcagtaaaacaaaaagttgattctctttgtttatctttttgattgataaacaaaattgataaaccactagctagaatacccaagaaaatacccaaaggaacaaaatcagaaatgaaaaaggagacatcataacagatgccacagaagcacaaaggattatcagagactattataaactaacaaactggaatgcctagaataaatggacaaatctctggacacatacaccttctgaggtcttattcagagtattatatcacttcacatgaatcctatcctactataggttacctggattttccaggtgataggaggatgtctgtgacatcaagaatggcagtctcatctaaaattatgtaacacaagcaatgtatagtcagaatggaatgctcatctaccttatataacataaataatatatagtcagagtgaataaaagggaaatggttttggagtcaggtttggagccagacctaggtatgattcttgccttgctgcttattagcttagttgcctaaccaatctcagcctgttttgtcatttatagaagggaggatttgacactcatgcctcattattatttatagaaggaaggaagggagaaaatgacacccaaaaaaagcctcattcattattgatcatcacaaaaggttatgattgaaattgtcaatttttctcccctactagactgtaatcttttaagtactctgaaacatctttattttcaccaaactcacaatacagtatttcacatggtaagtgtcagtttacctcaacagttcttgttgactagtactaaattaggcctcattctagtatattttcctca

SEQ ID NO: 12259 - DNA, 35174 bp, Homo sapiens
gatgaaggctgtgctgagcccattctgtgagggaggaagatgaaactcagagcggaggcctcgtgctgggtgacacagctaaaaagagactcaggcccagggcttttgattcagcatctgccccctcagttcccagccatgcatcactagaacactattctcaccgatggagaaggacaattcctcagctacccccacaatttaggaagaagtccccaaggtgaaccagctccctcagccctgaatctgccctcagaaggtggccttctgcccagagcgaggatggaggggtgcaggcagagaaccatttttttggtggaggtccacgggacagagcccagaactcaatgtccatccatcttgggcgtgtcctccccagcagcccaggctgactggaccggcgcaggaactcctgcatgctcagagggagccctgattcttagaactgtcttctcatagcagtcttcttaggagtatgttgctgtggtttgtgattctgcccctgggtgctgctgcatgggaggagccagctctctccctgccccacagatcatggaaggcagcgaccataggctcactgatgctcctgcaggctccctacacccatccattaggatggcccacatgtgccagccaggaatgggggacacagccatgaagccgacagataggctcctgcacctctggaacttgtgctttagcggggcagacagatcccacagaagtgtatgtgtaggagttctgaggatgacaaaaaggatgaggcaatagaaggtgactgtgaccttgtgagacaggcactgtccccagtctatcactctatttttgtttctttgggtttttttgaagcagggtctcgttctgtcactcaggctggagtgcagtggtgcaatcatagcttactgcagccttgatctcctgggctccaagcaagccccctgcttcagcctcctgagtaactaggactccagacacacacaaacaccacacccggctaattttcaaaatgtttatttttagtacagacggggtcttactatgtggcccaggctggtgtcaagctcctgggctcaagtgatccttctgctttgaccttccaaagtgctgggattgcatgtgtgagccaccatgcctagttcactgtccccactctaaagcagacagcccaagtgggggcaaagttgagaagcaaacacacactgtactccaaagcctctgaaaatccctccttgtgtccttcctaagaaggtcccagagtctctgtgtcatccctgaagctgaagtcagtccattctgggagcagagtccagctgtgtcctgtgtttggggctaagaagaatgtgagattcctgctgagtgtgagctgagcaaggttgtagtaaggagggcagtgatgtgatgcattgtttaaggggtgcagctgccagatgtgagtgggtgagggcagatgtgaggggcatcagccagctatgtgtgggggtggtcagacctggttggggaggcacaatggaaacaataggggagcaggccaggtgggtatgcgaaagtgagacagagtggcaggatgaaccgggagggggatcagatgtgaggggctggagaatagatgaccccgagcctcagtctttaggagggtggctgtccctgggaaatggatgatgcggtctgtggaggaaatgcgctttctatttagggaggctgtttaggagtagctgacgacatgctcagcacctggatgggtggaaataaacagagacatgaagcaataatttatgccgtgtcctctgtcaacctagccaccacctcctcctccctgggctccaggaagttgctcagagttgtggcgctgggaggagactgcgggagctatgctggtgaagcgatgctgtcatctgagcttgtgctttacacacactgggcttttttttttttttttttttttgagacagagtcttgctctgtcaccctaggctgaagtgcagtggcgcaatcacagctcactgcagcctcgacctcccaggctcaagcaatgcatccacctcactctcttgagtagctaggaccacaagggcatggcaccacatctggctaatttttagaaatttttttgtagagacggggtctcactatgttgcccgggctggtctcaaactcctgggctcaagtgatcctcctgcctcagcctcccgaagtgttgggattataggcacaagccatcatgcccagccccctccaggcctttgtaccttctgtgtcctcacctggagtacctgccccctgaactacccattgaactctttatttagtggcccacctcctctaagaagtgctacctcctctaagaaggcccccctcatatccagtctgtggttcctaaattgcagctaatgactaccccatgagctcacacattagagttggaaatctactttcaaatgaccccactttgtgtctaaagcactctgaccttcttctacccccaccccagtcgcacatcagtgagcttcagggaatctctggaattgaatacaaagtcatgtgcaaaatcagatgtgcaaatgtatggataaacaaaatacagtatacccataaacgaaatattattcagccacgaaaaggaatggagtcactgatacgtgttaagtgaaaaaaaaaaaaacagacagaaaaggccaaatattgtatgattccattgatatgaagtatcaagaataggcaaatcagtaaagacagaaaggagcttagcgattgttaggggatgggggtcggggctggggaatgactggtagagggtttcctttggggatgatgaaaacattctggatgtaggtagtgtaggtagtggtgatggtggcactacattgtgtgtgtactaaatgtcactcagttgaatatattaaaatggtgacttttatgttatgtgtattttacaacagttttaaaaaaagtcaaatgcacgtttctcaggagaagattcctaggtttgattggcttctcaaaaggtgaagcagctctgatctggtctggaccccttcatgtcatgatgcagatggtgatactgggacacagacagggggtgagacctgtccaaggtcactcaggggctggtggcagagcccagccaggttgcatgcctgcctgaccacatactcccctacctgcttcttcccttgtcctttggtcaccaaaccctcccgtcacaatccccaagcctctgtcctgctcccaaacatgccacccacaagctgtgtaacttcccaaagttaaaaggccttcttcctgaaactgggtgcacggattagagtttcatgagcgtttgtcttttgctctagagtggactctgagctcctagagggcaagaggaaatgtttcttattttcctccatatcttacagagcttctgggacagccacggaggtgagccattcctgtctcccttcaagaaagaacttgccattcaccctcaaggagggcagttagctgacaacttctaacaaacattctttgcccagaggacatgctgggttggccaagactttgttagatctgcagcacagtctgaggctctcccagccctttcctgcttcctctccctcaccggccttgccactaccccctctctccgcaataaacctcttgcggtcctatgttcatctcagtgcttgcttcctggaggacccacatggcacagcacctagcctgctggatcataagtgctcagtcgcgaagtaaacggaactggggattctctagagggtagagggaagccagagcctgggcctcggagagcaggagaggggctgtccgtggaggatgcctcagtcataaggagagcaaggtctagagcagtgtgaagaaggggccatggccctggagcaggacccagcaacgggcaacacacagggaactcagggattcaccagcactgctggcatcgtctctagctcctccgctgtctggggcagctcttgcaaactcagaaatgtcccaggagacagggttcaaagagccctggccttggactttagaaaaccaggttcaatttgtgcttcccgctagtcaggtgacattacacccttctctctggagctcagtttctccgtttgtaaaatgggcttataatgtgtcccctcccttcaaccccagcatgattttgagaattgactgagaagatactacagtttatggagggcaccctgtttcgtagtttaaatgcacactcaggccaggtgaggtggctcatgcttgtaatcccaacactttgagaggccaaggcgggaggatcgcttaagcccacgagttcaagaccagcctgaacaacatagcaagaccctgtctctacaaaaaatttaataattagctgggtgcagtggcacatgcctgtagtcccagctactcggaaggctaaggcagcaggatcatttaagctcaggagtttgaagctgcagtgagctatgattgtgccactgcactccaacctgggcaacagagtgagatactcgctaagaaaaagaaatacatacatattcatttaaccctggcagtggccttgtgagagcagcattatgacctccattttatgtatgtatatatgtatgtatggatgtatgagatggggatctcactttgttgcccaggctggagtacagtggtgcaatcagagctcactgcagcctggacctcctgggctcaagcaatcttcctgccttagcctccagagtagctaagactacaggtgtgggccaccaaagccagctaattaaaaaaaaatttttttaggctaggcacggtggctcacgcctgtaatcctagcactttgggaggccgaggcgggcagatcacgaggtcaggagttcgagaccagcctgaccaactggtgaaaccccatctctactaaaaatacaaaacttagccaggcatggtggcactcgtctgtaatcccagctactcaggaggctgaggcaggagaatcgcttgaacctgggaggcagaggttgcagtgagccgagatggcaccactacactccagcttgggcacagagcaagactccgtctcaaaaaaaaaaaaaaaaaaatttttttttttttttagaatggagtctccctacgttgctcaggtcaattttgaactcctggcctcaaccaatcctcctgcctcagccttctaaagcactaggattgtaggcctgaaccactgtgcccagcagagaaaaccggctctctaggtcaaggcattggctcaagaacacacagctaacaagccgacatagctgggattagaacccaattgtctggctctagaaccccttcactatttgaggtacaatttactgcctgactactagtgctaaactttgggttgggggcagggcctgaggcagctcctgctctcatacattctgagagccagtttgacaataggcaactacacaaaaaaccgaaataatcccagaatgcstcagggctccaggggaaggcgaaaaaagcgggtgcgtttataaacttaaaataatcagaggcagcatctccaaggactgtgagaatgccccaagtcagggcaaaagttttggctggtttgggaagtgatgaaaggccaaagtggctgcagcgagcgtggacccgggaggtctccaggcgcgttggtgcgagttggggacggcaggcagggacacctaaaacctacggtacgccacgaaggggtttcagcacgtcctgaaaggcccgatccccccccagaaccgctgtgaggggggcagagggaggtccctcgacaggatgtggccttagtcgaggaaggcgggaagcaggggctggcacccccgacgccccacccgccccccgtggcctagcagcagggcggggcgaggcgggtcatgcacccctaccagccagccactcccacccagccctcggctcccgcaactcgcgggggtcctcgcccgggtcccccgccccgccccgcccggctggtgacgtcacggcgctcgtcggcgccgcctgtggcgtcacaggccgggcccgcagggctttctaggggtccgtcgctcttgaagccgccggcggcgggcgcgtgcgcggcccgatgaagaaggaggtttccaagccgtctccgcccaagttgatcggtggatgcgcgcccccgcgcggggcaccggttgctgtggacgcagtggcggccgttggctggcgggtgcggcgcagcctcggtgtctctgggccggcggtgcagggcaacgtttcatggtgccgggcggcaccatgaagtctctaaagaaggattcccgcctcagaataactccgaccagattattagaggcctcagagaatgtcaaaggttggcgctggctgccttgggcgctcgggagaacccgagaggggaagcggtccccggaaagagttcaggacacggggcctggaggatggggatggcaccagggatggaggaaagatcacggggaagtggggtactgggcataggacccttagggatggggggcaaggcaggaagagcctacagcgcactgggccttggggatggggacataggaagtgggagactgacagaggggcctcagggaccactggctggggagatggccttgcgctacctctaaccacatcttagggtggcatgcaggaggcaggatccccggactggatgaagtgcagaagagccaggaaagagtttaagggtagaagggccaggaattggggtccttgggaagaggaaagaatgaagtgttgaaaccagccaccttgatgggattatttggtagaggagggtcggggagcggggcaggcgtcacttaggattcctgctggaaaaacccagaagaaaggccttgcttggctagttctctttttgactgccttttcctaccacgtgcactttccagctggatgacacttatccagctcctttagcctggaaagaatcgctagatatgactgcttcctaccctctacagctttcttctggttgcacctgggagagccacagggcgtctgatagcggactgacttccatggacatgttctcacttgcaacccacccccttttgatcttttttggctgtttccatttatttatttttaaatttaatttttagctttttttttctgtgtgtgtgtgtgtgtgtgtgtgtgtgtgtgtgtgtttgtaaacagggctctcgctgtgttgccccagctagtgtcaaattcttggcctcaagcgatcctcctgcctcggcctcacagactgctaggattccaggcatggaccactgcgcccagcctatttttgtttactgagagctgattttgtgtggtactgtggctcaccagaagggtatcggtattaactgtgtgaccctggtcctcaagaaactcagtctaatgaacacctggaggagtaacctgacaaaggtagaaatacaaatgctgtgatgtaggtgcccatcgggcttaagggggctcagagcacctgagccagaccagggatggttgtaggggtacgtcttctgaagaaggtgacatctatggcagrcaagaaaaaaaaggagaggtttgcttctctaggtctaggaagcagcatgagtttatggaactgtaaatgtgggaaccagaagaggctgcacaggtgggtaggtcaggggccagaccatgaaagggctttatgtactaggtcagaaagcctggatgtgctcttgcaggccctggggagacccagcctcagagttgtgaaagctcattgtgaggagaggggaccctcagaaaactaacaggagcttagtcgcttttcagtatggctttatgtttcttcacgtataaaagtccaacgttgagccgggcatggtggtgcacatctgcagtctcagctgctcaggaggctgtggcaggaggattgttccaggccaggagtttatgatcacacctgtgaatagccactgcattccagactgggcaacacagtgagacccccattattaaaaaaataaaagtccaatgctgttttatgacatactatatatatatatgtatgtattttatatatattatgtatatgtgtatatatrtgtgtgtgtgtgtgtgtgtgtgtrtatatatatatatatatatatatatatatatatatatatgtattttgagacagggcctcgctctgtcacccgggatggagtgcrgyggtacagtcataggtcactatagtcttgaacttctgggctcaagtgaacctcctgcctcagcctcccaagttgctagtattacaggtgcacaccaccatgcctggcaaattttttttttttttttttttgtagagacaagttgcccaggctggtcttaaactcctgggctcaagcgatcctcccaccttggcctcccaaagtgctgggattacaggcatgagccaccgtgcctggcccgtgacatactttttaatagttgagagagagggaatatctggtctcctttcacaagggcagtcaagggctttcctagccactgcctcctgctcacatagtttctgggagatcgtatcagatttgaactgctgtaaacaaatcaaggaaagatttttcactgcatatttatttttaataagcagaaaatttagtttgttaattaacccttgagttaagaacatgcaccagagtgaggagggaaaaaaaaatgaagtgtttagcatgcaagatatctttttaaaaatatctcaggggagcctctaatgttgtagagcagtactctcccccagcccccatacaaggcagctaatgacccagtgtcattttgtaaccttgtgcgatgtttctccaaagtctctgactcataagcaaaaaggaaagcaaaaatagtgacttaaacctgtttctcgggacctgagagcccttttgagtcctagtaccctcccttcctgctatgcaccacctccccaccgctgtcttgttgctaagaaaccaagaaccctcctagcaatattagattcccctccccaaccaattaaagctctgccctagtagggacagcccctccatggttcccccagcccaaccctaaggtcagaatttcccaaagactttaatcaacactaaaaacgaataatacttagataaaacaagaagcagaagaaatagagtccgggtttcttctccctccatagtttccccgctccgtatctcgcttcctacccccacctgagcaccttgcttccagccctctggtccagctccgacaagagactgactaccccgtgcaagcggggtggtctcttttacccctcactgtcagcatcaagggagaaatgtcagctgggtggctcactaggagccctatcagcttgggattccagaccaaagaaccagaaagagctgggcctgtataggctcagtagtcagacatacctcagccctgtggagtcttcctgcaggtcctaaaatgatccctggggctcttccttccctggtctccccagcttgcctctgcctctccggtccatctggctctcttcatctgatgaatcattctgaaatgcacctgtcatcaactcactcccctgaaccaaagatcagatgcctgagccatgctttacaaagctgtcatgccctggtttccctctcatccccaacatcaccacctctccacctccccagcaagttttcttttttttttttttttgagacggagtcttgctctgtcgcccaggctctggagtgcagtggtgcaaactcggctcactgcaagctctgcctcccgtgttcacgccattctcctgcctcagcctcccgagtagctgggactacaggtgcccgccaccacgcctggctaatatttttgtatttttagtagagacggggtttcactgtgttagccaggatggtctcgatctcctgacttcgtgatccacctgcctcggcctcccaaagtgctgggattacaggcgtgagccaccgcgcccggccccccagcaagttttctgtgttatcgtgccactcacgtgccatgctcagccctgccccttgctttgcttggactttgacttcacctggagcatcttggtttgccgctgtacctgtgcaaagcttgcctctcctttgcagcctgcctcagcctgtggagccacctctgcagctgttcctctgaacacttcttcagagccctgaactgtgtaatccacatggatctgttccttttttgatgtctaaccaaacctattgcctgtaccgcaaatgtaggaactcctctagctatgattggtgtgtgttcctgtcacatttttcagtacctcaagagaaggagccatatcttaaccttttataccatctttgtagtttatagcacatagaaggggcttggtaagcactctckaggagcaatttaactttaagatacatatatatccctgggcgcactggctcatgcctctaatcccagcactttgggaggccgaggtgggcagatcacctgaggtcaggagtttgagaccagcctggccaacatggtgaaaccctgtctctacaaaacatacaaaaaatagttgggcggccgggtgcggtggctcatgcctgtaatcccaggactttgggaggctgaggcaggtggatcatatgaggccaggagttcaagaccagcctagccaacatggtgaaacccagcctctactaaaaatacaaaaagttagccaggcatgttggtgcatgcctgtaatcccaactacttgggaggctgaggcaggagaatcgcttgaacctgggaggcagagattgcagtgagccgagatcacgccattatactctagcctgggcaacaagagtgaaactccatctcaaaaaaaaaaaaaaaaaaaaaagctgggcatggtggcgcatgcctgtattcccagctactcgggaggccgaggcaggagaatcacttgagcccgggaggcggaggttgcagtgagctgagatcgcaccactgcactccagcctgggggacagagtgagactccatctcaagaaaaaaaaaaagatgtatatatcattttaatgaatattttaataactagaacataccactccctgactgtatgcagtaacagagcatttattggactacattaaagataactttctcagaataaccttagaccagagttttactatttcaatctaaagcaaacatgaaagattagcttctctatcactgaagggatgggagctttggcccccaaaaatcttcggcagtgttgaaagtttctattgacacgtggtaattgtgcacccaccagtaaaaagcacacatctggagacgtttaatcacttggaaagatgtcaacccagccaaggttatggataaaggaagcaaatgtcctagaaagtacagataataccaaaatatttacaaaaacagaccttcagctgatctcagttctcataggctgccacccactttggtgagtttgtgtagaagggagargggaggtagaaatcaaagcccaaggctgcatccccacacatggcggcagatgagactggaactcggggttcagccggcagccctgcatgtgtgtttgtgtgcacagagccatgcatttaacagacagatacttccaaacctctgctgaccccattacagaaacagactgtggatgataggctgaatttattattttttctaatagaaaaacaaaaattatttttaaggataggttctcctgtgttgcccaggctggttttgaactcctggcctcaagcaatcctcccatctcggcctctcamagtgttgggattacaagcgtaagccactgcacctggccaacaggctgaatttagaactatgtttggaatgattttggtgtgagtttttttggccaccaactctatggaaatttcctaaaaaaagttggattttgttaaccaaaacacctgcctttatgttttcgtgatattgcctcttaaagattacggtgctgtaagaagcagtggataaaaccaaattttgttttaaactccctaaaggcctcaggacttaggttttcttttgattgttttatgtagggccttatatcaaaccattctgaaccagagggaaaatgacagggttgaccagccagagaaatgagatgtgtttgatcctgttaagccacctctgtgaaaggaaggcagggagtgtgtcctcgttggagagtgacctgtgacccccttctgccccgggtgttgtcaatgtcatgctgtggctgccacaacggactcttaaatacattcatacactcatcctcagtcatgcaggtttttttttttcttagagacagggtcttgttctgtcacccaggctggagtgcagtggcacaatcttggctcactgcagccttcacttcctgggctcaggttatccttcccctcagcctcccaagtggttgggactacaggcatgtactaccatgcctggttaattttttgattttttttatagagcccagactggtcttgaactcctgggctcaagcgatctgcctgccttggcctcccaagatcttgcaactcttaatccattccttggcatgccattgcccatggggtaagccttcacatggctcactgagctcttcacgatatggcggctgctgctgtctctgggctctgcctcttccctcccacctcaccacactccagctattcaaaaacacatgctttgagttccagggatgtgctccattctttgccactatgcctctttatgttattttctttggaatgcctgttccccagggccctttcctttctccaacttcttcagctctatttaaacatcccttccttaggaagccctccctgactcccccacctcccacgcccgccgactcagggctggttgttcccccccaccatgttcctgtagttactctggctcagtctgtttcacggtcttgtttcccattgggcatgtgctctttaaagacaagctctggcatgtatccctagaacctagcacagtgcctggcatgtagaagctgcttaaacaatctttattaaatgaatatgcaataaatggccagtggtgaatgytctgcttcccccacagagattctgcactttaaccagtgtcttgtgaaaccctgtgccttcacccagaagcatggatcagtgccagcactggaggaggctggcaaaacatctagttcagttgtcccaaaccactgtgcatcagaatcacctagggagttgaaaaaagtacagctccctaggccctggctccatgcagtagtcaggaagctgtattcataaaactcccccaaagattctgaggcagacattggactaataacttgggaaccactgatttagtccaactgactctttctacacatggaaagcctgaggcctagagaggttaagtgatgcgtacccaagactgtccagcttataaatagcatagcctgaaatggaacatcttttttgtatattaaaaataatcttttttgtacagatggagtctcaactatgttgcccaggctagtcttgaactcctgggcccaagcaatcctcctgccttggcttctcaaagtgttgggattacaagcttgcaccacggcacccggaatgaaacatctttttgttttgttttgttttgtttttgagacagagtctcactctgttgcccaggttagagtgcagtcacacgatctcagctcactgcaacctctacctcccgggctcaagtgattctcctgcctcagccgcccragtagctgggactgcaggcatgggccaccacacctggctaatttttgtatttttagtagggacggggtttcaccatgttggccaggttggtcttgaactcctggcctcaagtgatcctcctgtgtcagcctcctaaagtgctgggattacaggcatgagccaccacacctggcctgaaacgaaacatcttctgatctcaattctggctacagaagtcttagtcactgtggtgagccaggggctgtgggtagggggaccctccagagagaactcccattgccccagcaaagtgctacccaggccaccttggcagcctctgctatctatccagctggtcagctctgccccccaccatggagtctagtatatatttttacttttatttttgtatgtatatattgatatatacagaaggagctctttaaggacttaataactttctgcttctcttcagaaaagaagcgggcaaagggacctgaacaacccacacccacaattcaggaagagcctgaacctgttagcaatgtcctacaaggagatgacattcttgccttggccattaagaaggaagacttgaaggaggtgaggatgaagcccaagcttcccttaccatagaaacgtttccctgccggcagcctgagtggtctagaacaccagccatgtccctactcatggggagtgtctaactccatggaaaaacccactgaacacagattcttttcactttaccaccttaaggaattcactgtgttgtctgttttaacatttctgagattcatatagaaccacaggggaaatgagatgatgaggtatcttgcttcccatagaggtaggtgccatcattcccatttcacagaccggaggatgagtttaaggagccaaggtacagctctgggtaaagctgctaaaccctaaccccatgctttacctgggagagtcagccatctctcacccaaactgtctggaggcataagatgttcttttttttccctccaggatattactaagtcacatatctgttacacaggcatttccttgacagaacatatggacagagctgaagaaacagatctgtcagccttcaggaactccaccyagaactagaacagaagagatgggtggtgctcttcctcctgccaccacaggtggaattctcctttgttttatttctttttagcaacacattcctcgccttactgaaaaggaagataaacgtgtcatcacccagaaatttatcatccgtaaactcaaacccatggatcctaggaggaaggtctgccaccttgtagcacgtcctgcgaatcctgatgaagccacaaagcctctggactactccggtacacccagtctcagccctggcttcactgtctttcaactcatgggtcagcctcaagagaaacccagtctccatcagaaagttgccctcttgaaagttgtccacccacagcttctttcccctttcttcttttatcctcccaggtcccggtgacagcttcgatggcagtgaccagatcctgccccaccacatcttggggagtctccaggattttaagagaattgcacttgctcgagggaacacccaggtttgtttgcacagaactacccggatgagagcagtcactgaagtcattttggtctcccacctgacacagtcaagcagggctggggttaaagagacagtctagtctgtaggttttgagtctgagttgataagggaccctctcccagaatagttggacacttcaggcagctgaagctggcttcagtgaagtcagggatttactgtaaggattccagagattgcctcatggaacccaaaggcgggagtacctgggtctgggtagactgcacccaaaaaggcatcaggactcagggcccacatgcctcatttccctctgctctgtgcactgtcttgattttcccttctctggagactggcctgccctcctcagtccacrtggtggaggaaggtggcttcccactgcttcctgggccacgggaagattctgtatctttccagccttcccatcatgcagtgcttcacctgtctcttccccttgcttccctggttccaggctgactctgattggtcaggcgctaaggggcctggggccctgtaagaatgcttccatttacacatgggtgaaggtggcaatcaacatcagttgtgaggacaaatacactagatgttgaccccaatcttgaaacagaagttccctttgtgggggagagtggactgacagctgctttcagggccccctggttctgggatttattttctgtcactggctactctggagtcctgaagaggagggactctcagcgcagtgggataacagcacgggtttaggcctcgggaaatgtgtgctcagccctgcccagagccttcttactgccctccacatacctatgttgtacttttcagctggctgagcggatacctacctcaccctgtctgatgaccctcatctctgctgaaggagagtcaaagcaaaaagccccaaaagaagasaagagacctccctgggccccacctcctcagcacaactttctgaaaaactggcagcgtaacacagccctgcggaagaagcagcaggaagccctcagcggtgagcagagcagacagggctcccgcccggcctccatctggcagcaaggctctgctgggttgtttgctctcctccagagcctggccttgggctgaccacatttgtgctttcactcccaagagtgtctcactctgaagcttcagtggatcctgaaatcagccctgtgagggaggctgcccgatgcagactgccaaggcccctgtttgttctggttcggcagagtggcggcaatcttgcctctctctctagaacacctaaagaagccagtgagtgagctgctcatgcacaccggggagacctacagacggatccaggaggagcgggagctcattgactgcacacttccaacccggcgtgataggaaagtgaggccacctgtcctaagtgcccgggggcaggggggtccatggaggagggggcgggggcaggtgtctggacacagggatgctggtctcaggtggcacagctggggagaaaaaacctatccattgcaaaacatcattaggccctcaaggcctttactaaattatatgattagtcagtaaagttattcagcctgtggtgaccacacaggtagcaagttattagagtagtcttagtgtttgtctcctaggagcttagactgagtggagcctacaccctaaagagagaggttgaagagtcccccacctttttttctggtagaccagtgcagtacctgtaccaacccacaccatctgkctgggggcaggtaaagatgacaacagggtgtccagaaaacacggcagtggatgcttctgttatgcaatcacggcagcaatgaattccccagaggaagcatctgtagcctgtggtggtgctcttgtcttcccacatctccaccagcatctggctgaggtgtcctggtaatctgactcacctttccttccttgccagagctgggagaacagtgggttctggagtcgactggaatacttgggagatgagatgacaggtctggtcrtgaccaagacaaaaactcagcgtggcctcatggagcccatcactcayatcaggaagccccactccatccgggtggagacaggtgaggcgcagggctgtaagccagctagcatcttgtgcctggcccggaggcagggtagtgtggaagtggccagcatagctctacagtgaaacaggcccagggcctgtttctctgtggttctctggggtcttaggcaagtcccagagtcttcctgaagtccggctccctcttccttttcttcagtaaaacggtgagagagctaggaaactggagtgcagccatagagctgccgtccagtgtggagccttgagccacatgccgctggtgagcgcctggatcgtggctgccctgccttgagaagtgctgtcactgtcaactggacactggctttagtgtgaaaacaatatattttattaatcatttttatattgattacatgtcaaaatgacaatatttttgatatactgaattaaataaactatattactaaaatgagggcgggcacagtggctcatgcctataatcccagcactttgggaggctacggcggatagatcacttgaggtcagaagttcaaaaccagcctggccaacatggtgaaaccctgtctctactaaaaatgcaaaaattagctgggcatggtggtgcgcgcctagaatcccagctacttgggaggctgaggcaggagaattgcttgaatctgggaggtggaggttgcagtgagccaagatcatgccattgcactccagcctgggcaacaagagcaaaactctgtcttaaaataaataaataaataaataaacaaacaaacaaactatattactaaaatgaatcccacctgtttcttttttcctttttcagtgtggcatctagaaaactttcagtgacacgtgtggcttgtgcttgtggtttgcattctgtttctcttaagcagcactgctttagagcctgccaggctgcctgggttcaggtcccagctgtgtcgtgttagtgaaccccagagtggttgaacccctctggcctgtagtttcctcatctgtaaaatatgcacagggttgtgatagggctaaatgagatatgaartgtattaagaggttctggctcattgttaagcactcaataaaaggtagctgctgttattatttttattataatccaaagatttggctatttggaagctaattttkcaggagtcttgtgtagggctgctgaggaggtataggacaggagaacgggagtctagctgccacagggaagctgtatttttagtccttcctagaaatggtgttgggataggcactctcagagcccttgagaagtgggtgagcaaggggacatggcagcagcctgtgctgagggtccttggacctcatgctaggattaccagcccagagggacgcttcataccgctacacctgggatcggagtctgtttctgatctaccgacrcaaggagctgcagagaatcatggaagagctggatttcagccagcaggttggtatggcctccatgccccagtcagaagccccttggggcgatgcctgtcttcagtcagctcatcttacctttctccatctctcggaggatattgatggcctggaggtggtgggcaaagggtggcccttctcggctgttactgtggaagactacacagtgtttgaaagaagtcagggaagctcctctgaagacacarcatacttgtgagtgcagcctgaaccctggggagagaggctgaagagttctccagcacctaccagtattaaagagcgggcttccctccctgagatcagggtgcctctagcctagcttctgtccagtggttgccacccactccttgaacccattccagcacctgtgctggctttcctattgccatctgctcctttccaataaccaactcctaatggggatttcccagacattcccttgctggtcaactgagggctctctagaccctcccactgctatgcatcttgaatgcctctggcatggagagtctatgtatttctgtgtactgtgagtggctctggcaagagggcttaaagagtctgtgtgtttctaagaatctcccatctacagcaatgggtcaggaggaagctgcgcgggagtggagytgatcatactccattgcagggtagagctggttgtgtttctaggcttcctggtgaccgtttctgtggggttccacatggcatgactgtggcagcctaagagaaaataagtcattggcttttcttacagaggcacattggccagttcctctgatgtctccatgcctattctcggcccttctctgctgttctgtgggaagccagcttgctggatcagaggcagtaatccacaggacaaggtaaaacwgcctccaccacacctgctgggagagcctccctcaggggtgcagccctgaggtgactggcagttaccagcagcctgcacagtctcctgtttgggtttttatctggtcgtgcattcagcacgtctgaaaatggtgacagcaacactgacttgagcaagaataaaatcacaaggctgcgagtgtcataagccacttggggcttataccyagcccccaagcatgtaaacaagcaaactcaagtaggtatggctctaagaaggttccaaaatattcttcagatgctaaggaatagaagtgttcattggatataaaatatattttatctggccaggcgcagaggctcacgcctgtaatcccagcactttgggaggctgacgtgggtggatcacctgacatcaggagttcaagaccagccctggccagcatggtgaaaccycatctctactaaaaatacaaaatagcagggcgtggtggtgggcacctgtaatccctgctacttggaaagctgaggcaggagaatcgcttgaacccgggaggcgggggttgcagtgagctgagatcacgccattgcactccaacctaggtgacaagagcgaaactctgtctcaaaaaaaaaaaaaaaaaaaaaaaaaaaawatatatatatatatatatatatatatatawgttttatcttctcttcttgctattgagggtaacctcagagacaaccacgctggagtaggataccactctgtgtgacagtggccaagccctggaggcctgggacacgagacttgcagtgctaaagccagaaaagtcctgggcagaccagatgagttgttcactctaggccagggtttgcagcaaagacatttcttgtccctcctccttccagaggcaggttgggattgctgctcacttgacctttgaaaccctagaaggcgagaaaacctcctcagaactgactgtggtcaataatggcaccgtggccatttggtatgactggcgacggcagcaccagccggacactttccaagaccttaagaaaaacaggatgcagcgattttactttgacaaccgggaaggtactcgggagaagccaccctatgtgctagctcctgtctggggctggttttgtcctccgtgagacatcaaagtttagttatggcccagctcctgtaagtttgagccctgcttccctgccttgtccctctcattccttctgtgaaatgtgtggcctgactactcatgtctgttgagagactgatggaacttgagaacctggggaggtgagccaccagggagcagaagcgttctaggggctcagttatctaggtgcacaggcctggggctaggatrgccagctgtctctgtttgcctgggactttagcactcaaattcccacattccaggaaacctctcagccctgggcaaactgggatggttggccagccacctggcctgggactcagttaactgcatgtaggagcatgtaggcctggggctcagccagctcctgcatgttgaaaacctcgggtctctgtccctctcaggtgtgattctgcctggagaaattaaaacatttaccttcttcttcaagtctttgactgctggggtcttcagggaattttgggagtttcgaacccatcctactctattaggaggtgctatactgcaggtcaatctccacgcggtctccctgacccaggacgtttttgaggatgagaggaaagtactggaggtaagggacccaggaccatgkcccctgtggacatcaggtagggtatcctggtgttcttcctggcagtgactgaagggatcatatttctcccagcctaagaggagaattggatttttagcaaacaggtaactactcttgctccacaaacacttcccagggcttgtgatttaaaagatgggtgcrctggctaggcaggcatggagcagcttgcagcaatgccatgcatggccccactsagttagaaagaaattagactgagccttaagaggcagactgtaaagtacaatgtgtggccctatgtactggtctgtgttttgttcatcgctgtctggtactacacagtggagttgcatttaagcgacaagacttcaaaaccagggagaataattaattaatacatagcagcatgagtctgcccaccgtcccactcaatcagctgacaactcgagtgagtgtgaggtgggagcttggaatctgtcgtccgcagtsagtttcacagtgtggccatttgagccgtgcatcctgggatttggtggaaagctgtgcttttttattcattgtggcccccaatcacaaggccggctccttcatgtggggctcagccagtggtgatcaaaggtaattttgacaatgtcatgcttgctttactcattgactgtacaacccatgtctcacacaaggcgcccctcccgtgtttctgtgacactcactgaagcctgatgaaggttcaccaccatcctcagaagcacccccactatgtgccctgccccttcttcctaatctggtgacatgctaactgtgtgaccaccaggccccaggcagcagcagctgtcactggaactggccctcctctggatccttttcatccatttttagggaacaaggatgtctggagagactcagaggttttcaggtcttagaacaggcgtgtgtgtgtgtgtgtgtgtgtgtgwgwgwgwgagagagagagagagagagagagacaatggcaggaactcagaccctaggaaggcacaaagtcctgggggctccaacttcctgaaggatgcattggttttgatagcctgggctgccatcctctgccaccttcccttttgcagagcaagctgactgcccatgaggcagtcaccgtcgttcgcgaagtgctgcaggagctgctgatgggggtcttgaccccggagcgcacaccatcacctgtggatgcctatctcaccgaggaagacttgttccggcacagaaatcctccggtgaggcccagcgccagcccctgccccmtcatgtgtgccctgcgtcaagggtccccaacccgcaggccgcacagcggcaggtgagcagtgggtgagccagcattactgcctgagctctgcctcctgtcagatcagcggtggcattagattctcataggagcacgaatcccattgtgaactgcgcatgcgagggatggaaattgtacactccttatgagaatctaactaatgcctgatgatctraggtggaagtttcatcctgaaaccattccccaactccctgccatccgtggaaaaattgtcttccacgaaaccagtccctggtgccaaaaaggttggggactgctgccctaggtgacagtaatagcaaactcttttatgtgccaagctctgttctgcgcatcttccatgagtaactcacctctcttcacagcagtcctatgagatgggtactayttatttttgtttatttttttaagaaatagcgtgtcatactgtcacactccaggccagagtacagtgtcccactcatagctcattgtgacctcaaactccccggctcaggtgatcctcccacctcagcctcctaagtagctaggactacaggcatacatcaccatgctcagctaatttctctctttttttttttttttttttttggtagagataggatcactctatgtcatacaggccggtcttgaactcctgagttcaagtgatcttcctaccgtggcttcccaaagcactgggattgcaggcttgagccactgtgcctggcccttgtactatttatgtccttatttacattgaagaaactggggcctgcaccccagcctccccctcacatgccttcccatcctctgctgcagctgcattatgagcaccaagtggtgcaaagcctgcaccaactgtggcgccagtacatgaccctgcccgccaaggctgaggaggccaggccaggggacaaggagcacgtcagccccatagccacagagaaggcctctgtgaatgctgagctgttaccacgctttaggagccccatctccgaaactcaagtgccccggcctgagaacgaggccctcagggaatccgggtcccagaaggccagagtggggaccaagagtcctcagtggaagagcatcatggaggagatcctggtggaggaaagcccagatgtggacagcaccaagagcccctgggagccggatggccttcccctgctggagtggaacctctgcttggaggacttcagaaaggtgcttccaagaccctggaaggcaatggtagagaatattcctgcctcgaaccaacaagggaggacccagcagcccctcttgctctatgggcaaagaaacaaaacctgagagcccagagaaagtgatctcttgggttatctatctatctatttatttatttatttatttatttatttatttttgagacgaagttttgctcttgttgcccaggtgggagtgcaatagcacaatctcggcccactgcaacctccacctcccaggttcaagcgattctcctgcctcagcctcccaagcagctgagattactggcatgtgccaccacacctggctaattttttttttgatggaatcttgctgtgttgcccaggctggagtgcagtggtgcaattttggctcactgcaacctctgcctcccgggttcaagtgattctcctgcctcagccttcccaagcagctgggactacaggcatgcgccaccacatccagctagtttttgtatttttgtagagacggggtttcgctatgttggccaggctggtctcaaactcctgacctcgtgatccacccaccttggcctcccaaagtgctggtgttacaggcgtgagccaccacgccaggccaattttgtatttttagtagagacggggtttcaccatgttggtcaagctggtctcgaacacctgacctcaggtgatccrcccgcctcagcctcccaaagtgctgggattataggcgtgagccactgtgcccagctgggttacctgtttttgtctggggtgcccaagctgctatattccaggaggggggcctactctctgaccctggcaaatcttggagaaggggttcataggtacagatttctgaggggggtccctggctcccaccaaaggcacccagacagctctccatagctgcatcccctcctggttcctggtcccctgccacccatccccacatcaccatgcccttcactagaggacacagccttggtgtcctggtgcagaatggtgcccatgaccctgccaggcagtgatggtgctccctgatgagaaccacagagaggatgcgttgatgaggctcaacaaagcagccctggagctgtgccagaagccaaggccattgcagtccaacctcctgcaccagatgtggtaggtgccctgccaggagagctgccccatctccttccctttgtggcatctgcaggggtcctgggcaggcagtcctgggactccaggggtctgagcttccgttgagctcaggttgctagagcatgccgcaaacattccacgttctggaaccctgcagtgcctactgctcactggagagcagtcacagcagatcaaacaccttatcttttttttcttcccctttttgccttgttccttctcagtgagcaggggaatggaaaaaggagaagccagagggcaggaagaagasggggggcagattccaataaaagcttcatttctctgttgtcaccctcccctgtacctgtttggaacttgcttgtataggcgtggggtccttttcaaggccctcaggacaagccccaggagccttatgctggaagtctcatgcaaggttcagcccctccagtgcgactggacccaagtctggccctggcctcaagccctctgaagtaggactgaattcatgcaggcctcstaaccctagtcctgggccatttttttcttggttgccacccaaggcaagccagaaccccctccaagcacttgccctggcggggaacagtgaggatgctggctgttcaggggtgtggcatttccacagcagctcrtggcaccagggtctttgaagggagggacccaagcctctgcaggttcaaggacaaatgaggagtgatggcatttctccactgtgtcttgccctctagtttgcagctgtggcgagatgtgattgacagcctggtgggccattccatgtggctgaggtctgtgctgggcctgcctgagaaggagaccatctatttgaatgtgcctgaagagcaaggtcagatcttgtgcaaccaaccacacctctgcatagccctcctcatctctctgaatggacaagcagcagtgcctgggccagtcatactcctttggtggaagctctgctaggttgagcccatggagtaggccccttacccctttctgtcsgctgccaggatgtggtacccagaagctaccttagtgaccaccttgstttagtaatcccagcaaagttaaatgacttatccatggccattcatggcatggcagagctgggaccagaacataggcaccacagtcctgtttcatgaagccacgcgcctaccagggctcaaggctattgccctttgcttttccacctcccctcaagcctcctcacgtacctgcagcatccactaggctgttgggggcctgccatattttcttccacccacctcccttagatcaaaaatcacctcctatcatggaagtgaaggtacctgtggggaaagctgggaaggaggagcggaaaggagcagcccaggaaaagaagcaactggggatcaaagacaaagaagacaagaaaggagccaagctgctcgrgaaagaggcatgctggggcgtggtctgggccaggtggggctggggaggggattggaggggctgcggaggtgggggctgtggaggtgggcatgtgcccaggctctcccagtgagctactrttgaggacatccttggcctacctctggagctcctgaaggctatgtgtgtctccctcccccagcaggaccgtcccaacagcaagaagcacaaggcaaaggatgacaagaaagtcataaaatctgcaagtcaggacaggttttctttggaagaccctacccctgacatcatcctctcttctcaagaacccatagaccccctggtcatggggaaatacacccagagsctgcacagtgaggtgaagggaagygcccagcagccattcccctgcctcccacctgccttaytcattccrttcagtctgcagacaataagtgcccactccatcatggtggaagcagagctgcttcaggaagggcatcctcgtgtgtgagacaggcctcatgaataaggaatgcgcctagcatgttaggtgatgagtacaatgggagagaagatagaccaggcagggaatggaggcacagaggcctcagtgaggaggtgacaacccacaaagatttgaagggaggggaagggtggccaagtagacgtccagtaaagagtgctccaggcatggggagcaactgccataggagggaggggccagaagggagagggcagtagtggggagcaggtcataggggtgggggatggtttgcaggctattgtgaagacttgggatttttcggagtgaaatgagaagtcacgcaaggttttgaatagaaacgcaatagggtctgataggctttagaaggtggctctggccgccctttggagaacagactctaggggaacagagaggaaggaagcccttctctttcttactccccgttaggtgcatcctggcagatgcgttccttgggagaacaccatgcagggtgcattcccatcaactgtaagagtttgaaggactagagagacttcatcctaatccgttcttaagtagcaggtccttagaaattcacccaggttttccgttttgtttgttactgttgttgtttgttttggaggggaggtccacaaagccattttcaatatgtcagtatgtctattggcgacgtcttgccttcctctaatgtggatagctggggagctgggattacatcatgtattgtggtcacactctggatctcatttgatcaaaagttccatttgccactggtgacatcactaagatatcagatggttgatggggtctagaaagtaattaaagggctctgaggacccatgggggtcaacgtcaacccttccatggctctttgatattaagaatcaacttgcagaccaggtgcggtggctcgtgcctgtaatcccagcactttgrgaggccaaggtgggcagattgcctgagctcaggagttcaagaccagcctgggcaacatggtaagatcccgtttctactaaaaattcaaaaaattagccaggcatggtgacactcacctgtagtcccagctacttgggtggctgaggcacaataatcgcttgaacccgggaagtggaggttgcagtgagccgagatcacgccatttcactccagcttgggtgacaagagtgagactcttacctccaaaaaaaaaaaaaaaaaaaaaaaagaatcaacttgctggccagtggctcacacctgtaatcctagcacgttggaaggctgaggcaggtggattgcttgagcccaggagttcgacatcagcctagacaacacagggagaccccatctctgcagaaaaaaaaaagaatcaacttgtctgggcttgtatgatccaaccccattggaggggtcagtcccagagacctttcagtctgtggatacaggaaggaaaattggcctccaggaggccagagtagaactggggctgagcccaggcccaccccaaacggctaaatgggcaccgctccatgggctccctggagttgccccttgaacaacttagctctagtatctccatatgtcaaaggtaccagcgcagggccacctccccagactggtttgaaaagtaaaactgcaaaagcaggtggattgcttgagcccaggagttcgagactagcctgggcaatgtggtgaaacccyatctctacaaaaaatagaaaaaagtagccaggtctggtggtgcacgcctgtagtcccagctacttgggaggctgagatgggagaatcacctgagccagggaagtcaaggctgcagtgagccatgatcacaccactggactccagcctgggtgacagagtgagatcctgtcaaaaaaaaaaaaaaatctgcaaaaccaaaaattatttcacaagaactttgaacttgtgaaattctttcacaaacaactggtttctttcccctctccagctattctctcacagcatagttcatatataggtgcttcccacagagtaaactctgcctgtgatgttgtcccgttcttccaggtccgtgggctgctggacaccctggtgacygacctgatggtcctggctgatgagctcagccccataaagaatgtcgaggaggctttgcgcctctgcaggtgactctcgggcccaagcaaccttctggaaaaygggttaataaataaatcaataaagaaccttcaagtttctactacttccgtgtgcctctgtgtcttgcatgatggatcttggctaggtcagctcctgatccaggtcctcccatgttccacctgccctcagattccctcctgccagctgccagagccctcctgcaggaggacagacagacatagctggggaagtgatgtgtgggatgccaagcagaggagcaggttggtagcaagacaaggagtcaggtgacaggacagtgtgtcacctctggtagtccctgcctctggcttccttggcccacactttcagggtcgtgcttcctggagccaggtcttcccgaagtgtcatcaccaagtatgacaaagtgtgagataaggagtagaactagacccatgggacctggctccctgccatctcccctcttcagctgggtcccagggccccaattcagtccctgaagatcatgctcaccacacctcttcagctctagaggccacatcaccttgttatttcggggtctagtctgccttatccccctcctcatctcaaactatctggccttgagccatctttctgccttaaaaacagctgctgatcttcatgctacctcccttgctcaggggaacatgaaacaggctagaaatggctctcagaaaaaaaggtattgtcagctcaaactcaggcccctcattgtcttctgtcagtcataaccatttggggctgggctccctgtgtgaacagcactccaggctcccagagtttgaagaacaactttggtttttgggtgggtgggcatccttaagtgggcctcaggcatcctccagctgagatgcaggagggggaggatggacagaaggatctgactccgtgtgggaaaggcagggagggggctgtgctggagtcctgatgctctcctccccaagaagacgagaagacgggggctccaccaaagagccagccccagggaatatccctgccctctcctttaatgtcctcccggcccagaggaggaaggggaggggtgtggtgggggtgttggagcccccctcctttcctgttgaagaggcaggggaagggttaactcaaagcagaggggatcaggtcgccagcactggctccagatgtgcacttcctgggggcggccaacaggcaggccccccacctctcaatgcaccacttgcctggccagcaggaaggggttaacctgccctgcgcttcctcctgtgtcctgttactgctgaggcagacctgccgggccagctgagcaactttcctcggagtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccsctgctgcacaggtcggagggtcaccgcagaggctactcgggctggggctggggccgagggagcccgcactggaggtaagcttcctccytggccccctccctggcagtggcggcatggaaggcgggggttggtggggagcaaacagtggttctggggcttagtctcttttccaggtgcgagggagaaggctgagctgtagaggacctaaaggcttctttcctgccacccctccctccctgccgcccccaaaaagggactcagggccccctccccaaccatcctgggacttagcatctttggtggcatcttagcatctttggtggcattccccacagactccttctgcacatctctgctgtttcctcttcttcagcccctcatgcacacctctagcctcagggcagtcccccctcccccatcttctgtgctcccgggatgcagctattacagtggccagaagcttagagttcaagctcaccccctgtcccttacagcatcaagaagggcactgtcattccccactgctcaggctggatctgacttggaggcaggggctggagcccaccttagcagaggacgggaagagggtgtgggctgggctggtgggtgcacagactttacgcaaactcatgcacgtgtgactggacagatctgggttctctccgtctctccgaaacccttgctggggatgagcgatctgcatttttcggtcctgacttttgggaaactctccagatccccccatcctgcaggccctgagaagagcagcccctccctactgcgcagttctccttgggaccctgtatgcaggagagagctgatactccgtgccccgtggcccatcccaccgcctgctggccctgctcccatcccctcagcttcctccctcctctgccctctctgtcatctctgaattctcaggccctgccctctctgtgcccttccctccacctgacagggtctggctcaaggtcactgcagtaattccatacccagctgcccagggctgctgctgctaccgccaccgccttatcggccgctgggtttctgttacactcccttttatttctgggcatatcgtgttcgataaaaccctttgcttgtaacactgctggcagcgctcccagctgctccctcccgcgttcccgcgttccttcctttcctcctcccttctctgcgcttgggcaggcttcttcctttcctcctcccttctctgcgcttgggcaggcttcttcctttcctcctcccttctctgtgcttgggcagcctcaccttgtcccctcaaactccagagaaggaaaatcaaggtgcctccccatgtttctggccccgcccttccccccagcccctgcaggggtgtgcagagaatgcccaccttctgtgagaaaggtccaggcagggccgctgggcccacaccgagagtcccctcccagaggctggtgcccccacacaggccaggccggagggccagggcagccaggtccaggtagggctctggtgcagtcacagtgcccgactggttctgctagttccagcggccagccggtaggggcgtgtgctgggcgggctttggtgcacattatttcccatcttgactctgccacccccagccacgggttggggaggtgaaggcaggtctgagtcactagcaagggggagggcaggagttaaacaagttgtggccgtggcattcccacagaaggcccacgacccgctggaaggaaagagatagcaracaaaaggtaggctgcgctgtgggccaggcactctccacctcgcccactcccacggtatcttattctctgggcccccaacaaaacctgccaaggcatgttttcaaagcgtggggctgctttgaactgagcccagcactggcggggctggggtggaaggagcgtggaatcgggtgcgagaggacagtctccttcagattcctgcttctggcagcctggggaccagttggggcacgggctgggatggagggtggagccgaaaggtgtttggtgggtgggggacagttcacgggtgaagtggaggctctgcaggcccagacagtgtgtgtgtgcatgcacacaccagtgctagtgtgggaggaatggtggtggtcagggaattcctcttttggtttctgaaagggcctttgggaggaccttgggcctggagttgtattcagcagatagcctggacctgtggctactggggggaattgggctggcccagctcttctccctgctggggtaccagaggtccactatgtgtccagcgttttggggctttggagaacccagactgttcctactctcagggagcttccattctagctgagaaggtgggactgagacagtaaagcaatccgatgaaataatgaccaaactgggtaacactgacaataagaattggattagtcttctggagtcctggatggtagtccaggctctgccacttacgtgccatatgatgcaggcaggtcccatcccctctctggcctcaacacttccatgtgtacgtgggggtggcatgcaggagtgttggcagtggccagaactctgaggggcagtcttcctcaaacgatacttgctctcttgccttctggcccaggtcatagcatttcttctgagccgccctcccctgacttgctggttcactcctccttactcttcccttgtgatcttggatctcagctctgtcaccacctcctctaggaagtctcccctgattttcctggcttgggtcttcctgtgcggctctgcactcccacactggactgtgattttctgtaccctctcaactgaacgtgggtggaccaaggcgtgtgttctgtgcctggcatggtgcctggctcagaaaaggcctccgggaaataggtgttgaatgcatcaaactacaaaaattaacaatatgagaaaagtgagctgaggagctaggaaggataggtcttaagctagatctcagcagaaacagaggcagtggccgagcagaagcaaggcaagcgggcattcctggaatcctgttagcgttcccccatgaggccatgcactcttaggtggggcttcctggggtcatcttggttccccatgcagcagctctgtgatctcggacaagtcacttaatattacagggtctcgctctgttgcccagtggcctgaccatggctcactgcagcctccaactactggcctcaagtgatcctcttgccttggcctcctgaagtcctggaattacaggcgtgagccactgcaccgggcccatttaatactctgagccccacctttcccatctgtggatggaggtaatgataatagcatctttggggtgtggctgtgaagatagatagatgagcatgcaaagctccaagtgcctgctgaattgtaagtgaaataagaacgtgtgccgctgaaggctgtccctggaggcagggacactctggccaggcctcatttagttggtcagtggctgagtgacccatgaggtaggcctctgcccctgagttcctggccctctcttcctcagccccatgtggaacccaaggatgcagctgctctgctaacacggcagcccatccttcragactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcrtcaacgtgcgcgagaaggtcaagcaggtgatggccctgctcaaggatgaggagcggctgcggcaggagcgaacccacgccctcaagaccaagragcgcatggcactggagggcatcggcattggcagtgggcagctgggcttcagccrccgctacggcgaggactacagccgctcccggggctccccgtcctcctacaactgtgagtaagccccggtgtgtggctgggatggggaggtggcccgacttccattcctggctctgcaatccaagccatggttcataatacctacctccgaggggtgttatgaagattcagacataaggaatgtaacacgcaaggcgcaacacccggcacataggaggtgctcaacaagttagctcagataataacgtcgttatagattcattatcattcgttagctgcctgataggatggcgcgatagtggaagcatgggtttggagtcagatagcattctatattctgcttcctccaagctgtgtgacctgggcaaccagttctctgaacctcagtttcctcatctgtacagtggggataagctcacctacctccattgtttgatctgagaatgaaatgagaccagg

SEQ ID NO: 12260 - DNA, 183334 bp, Homo sapiens
tttaccctggtgtcttcagtggtttttaactcccaatctgcccctatccccttggctgcctacactttccttttctggggagcaatcagctagtcatgggtatttttcatgaagagtcctgagctttcctccaaccacgcagggcctttaaaagcagtccccaccccacaaaacaaagacctggatgataatgatttaatggcccctccatcccagtaatttactttgccttcccctaaaaaacttaaaatggccaatattgatggcatacatttactaatgtttaaatatctatcatatggtgttcaattaaagtgtttaaagcttttttgggtaccattacgagttgcttcatttttatcttcttccaattttaaaagaatcaccaaggattattcttctagcctatgctttctcaccagagacaaatgtccacttttacagctttattctggtaatgcaaataattttatttataataaataataatacatttatttacagaaggcattacattaaatttcattgtataaaagtttcacagtatacttcttgcatatgatatatttcatcccctctactacaaaactaagataaaaatcaagccacctcagaaaacaaataagagagaaaaacaaaaacagaataaaaaacttgtttgtatatgtcaataagaactgtgaaaatattctgtgcttataagaagcccaaattccctggtatctttctaagatcctttccaatctggtctcagcttcactcacttttcttaacttctattccagtctcttcatctattttcatgttacctctgcatagaatgcccattacctttttctctacctataaaatcccctgcccactccctgcaaggttaaatttcagtgccatcatctatttgaaagccttgactttatttattctctattatagggatcagatgcaattagatcattctatgtatgttgtctctacgtagcctgtgaatattcctgaggttagggcctagcacttcaacatctctgattccccaggatctaagagacttcctcctgcagagaagtaactttgtaagtgtttcagtgcattacatgagcacagatgctgcagagaacaaacattagtaattactatcattgtatagattatgatctaggagagaagayaaaaaatggtcacattattgtaaaataagctatgtaagtgttattatctcagagccaaataatagactcccttcccttgatgcacttattttgtattaaagacaaatggtatttccccacacatgtgtttagtgacccagtcctaccacaagaaatgccagtctccttggtttgaaatactaattaatcattttttgttgtaattctgggattttagagcccacttactttatttaactttttacaaattggttaaaagaaaataattaaatcaacctgttcaaatgatcctagaattgcataacagcttaaatataattaagtcatatttcaaattaagggacccagcaatgcagctaaaatgttactgctcatcagtggttgttattctgagtcatagaatgccacgaattgaacattcctgccagggcaccaccctggtccaccctcccctgctgcagccctggtgtgtcactcatgttgaagtctgccagtaagtccaaggaagtttcctatagtgttgagaactgttcctcaccaggattctgaagtcaagtattttgtttttttgttttttcttaagtaccagttgcccaaatgtctttggacaaggtttctggcacaggcttgttcaggaaatagggagggagaaacacctattttatattttaagtgaaaaaacacacaggaatattacgtaataacaaaaaacaaatggttggctcatggtgaagtttaagttccatatcactgtgactttattttggtcagagaggaagcaatcataggttctcaaggtatatcaacaacaactattaggataatttcactagactgtttaatttaataggcttaaaatgaaatatgccaatgttacaattgagcacaaaactacttattttctcttcctagttacaagtgaaagaaattaatgaacagcaggtttgcagtggaataacaactgttgtatccatttttgcctctgcagaacatagccctggagcccaatatatgccagaaaattaaaaattattgaactagactaagttttccatatgagttagctttgtgagttagccccactgttttggggtatattcccctaagtgcttacatactaaaacttaaaaatccaaatcttcataaaatctttgtaaaaacggaagcagttctgtacacttccacctacccctaacacctgagagtggaggggatggggttggggtaaaaccacactttgatgctaccttaaaatgtatttaaaatctcatatttgacttttaaaaagaaaacatgatttaaaaatatttcttataaaaatctgttattttagcaaacaacaatttttaaattatttatttttgagtaaaatcagcaccacccccactacccaggtgggagtaccttatttatcctgtagctttgagaacctataatcttactgctaaagaaccctggcatacattagacacggagttctagaacctcttctattcccccaacctcttagcggaatgttcttctcttgtaaaaaaattaaaaaaaaaaaaaaaaaaaaaaaacctctgacggccagccaatttgaaaagcaaattcatgtgaacgttataatgggttctgatgtcttcatgcatacccattttatagaactatcttcaagataattccctaatccaaggtaaatatttttaaagcgaggattccagaaataataataggagttgatggagatatttttaggcggacattaaagttcctcttctgatggccatcaaatttcaccacttcctacagggtctaccacacgcagagcctgccctgtttacatggtctgtttaataccaattcttctatttacagagaagaatgattcatactaaccgagcacttactttaatccaggcattgtgctaaatgctcagaggctcggttcatttaatccccacagcaattctcagaccagaagtagtacagtattttcattcccactttacatttgagaaaactgaggcttagataaacttgatgacgtttcccaaatcacacagctactatattgtggttccaggacttgagtccaagcagcgtaactccagaaccttacttactctagttactttactcagtatattagattaactccaagaagaatactttggttttaagtatatgtttttctttttgagattattggttaataatctcaattactcttgcctcatttcatagacatccactttccaaattcttaatcagttcagtctctaatctttcagtgcagccatccccaaccgttttggcagagagaccggtttcatagaaggcattttttccacagaccaggggtaggggraacggtttcaagatgattcaaacacattacattcattgtgcactttattcccattataattatgttataatatataatgaagtaattataaaactcaccataatgtagaatcagtgggagccctcagcctgttttcctgcaactagacgttttcatctggggatgatgggagacagtgacagatcatcaggcattagattctcataagaagcgtgtgcagttcacaataaggttcatgctcctactcatgcttccaaacccttaaagagatctgatcaaatcaagtctcatttaaaatagaaaagtatgtagtataaagtctagagctgaaacatttgtcatcaagtgtctcatatcaataactagtttgtgactctgggcaagtttctgtcttctctaaatctttactcaatgacatgtctttctgtcagtcagaataaaattggttaagaaaataaccggcttgacatttatttgtatttgggtttattgaagttcagaaaataagcactgattctaaaattaattctctaaccatagttatctctcagtctctacatttgtattgactagacatataaaagattcataaatatgtaaacatgtaaacataaaatttgtaacttgtgaaaattaattgtaacaatatcactgttagtgatggttatcaccaataatttgtaagtcctagaggaaataaaaatattaaaattgaaattatgtattagcccccagaagaaaggtaaatttcccagtaattgtaaacttgaacatattatatgttaaccctactttatttcaatattttacaatttctttttgttttttctaatgaaatatattgcaatttgctaaaatgccatatatgtatttgcatatgtatgtatatgctgtacatatatatgtacacatacatacatacacatgattgtgtatatatagacacactattatatgtttttgaaaactaagcaatttggagaaatatcattgggaaagtacttactatgatttttaaatgtctacgaattaatcaatatctattggttactgttcaaagcacagagagtcatactgagaggcataagacataactgatactaccaacagggaaacgagatatacacaggaaatgaattccttggcagggtatgagagcattgaacacaaacaaaggaacttaagtaaagtccaatgggattgaactgtgacccaacataatacaatttttctagagactcatttgtgtaaatttgaagacagaactgagaaatgacattataaaaactaaaaacgggagaacgagatttttaatgtatttactaaatagtgaatcagttcagatacataatagaaaaggaatttcttgattaatgggtcaacatactgagatctgatggccttcaacctccttgggtctgcccaccccatttttgacgctccttaaacttcttcaacttttgtcttctccagcttttagttgctgtgatcctctatctggcagtgtatccagtgaaccctgtgggcttcttccttcctgtccctcgtgttacctgttctgtgctacctgtgttgygttctgctcaacgaaccctcctttgggtggcactcttgtcctgcctagccctagttctgctagagatgctcaattagttgttgagttgaagaattgaattgaactgtttccctcagattcctctaaacacaaatccacttattctttctgtctttgaaattctcaaaaccgctaagacacagctattttgaaaatagccagcattggttgaagctagggtgaatatggcttttgactcagagaggttgttcaactcaccaggaaagggaagcattgcaagttcctaagcacttctggactcttaatgcattttcactcgtgaaagtttcaagcaagaaaaaaataaagtagtgccccgagttctttattagattcaattaccagcgtacaaacatcctaattcacttaaacaaaatagcccacacacattccatttccaaggaggctgcttttcttcctctcttcccttctcgctctccctcttactgtttttcctccgtcttgcttctccttttctccccttatcctagttatctcaaagaaaagcttatctgcaaccaccctttaaccacgaattaccataaacgaagcacccccccccacccccccataagcgaaagcaaagccctcagtggagcctgtcggggtggtggggacgccccctttcgtgcaaaacgacttcacggtgaatttcaagtgtccgcaggggatggaaggggggattccagatcctcgcattttcacagacggcctaatccctctgcgcaatggacccgggaaagctgcctcccgttaagggcgcccaggcactgtcaaagcgccctccctgcccgggccgggagaagtaaggggtgtgaaggcggagccactgggctggcaacaccctcccgaaggtccagcccttacccgccttcctaccaccttaggggatttggcccggagaacgagatcaccctctcaatgaaaggcagatgtccctttaaggtttgcttctacagcccgtggactttagcctaaacacggacccgcgaagctggctttatttgtccatgtctcggacagagcctgggaagctgccagtgagatttcagagaccaagagcgcgaaggggcgggcgatgtggcaatccgtctgggatgtgaaaagcgtggagcgcatttagaggmattcgacgaaaacacaggaaatcactcctctcccgctcctgggcgccgctgccactggggcagaggactgggaaccgcggcagcgggataagtggcccagccagagagcgcagctcccgcgcccggtcctgccctgcgaaccagcgcggccccctggcgctgaggctgctccggccatggcccctcggccccgcgcccgcccaggggtcgctgtcgcctgctgctggctcctcactggtgagcgactcgcttttctctgagcatctcctgctcgcgggcttggggcttrgagcggggagggaggtcctcagagccatgggccagataggaagagagagcgcccatccactttcsggcattccaggtactcaggccaggctacggggcaggcaggagtttcgcgttctggttttgatatgaattagttttmgtgtctctccaaagtccttcaccctaggagtaggagtgaggcagcactgaaaaccttasaaggtagaattcacttttaaaattaaagttgtttttacaatacacattgtatattaggactttgctgaatatttcctcccctccacccttttttatggcatgggatgggagggtgatgcttatagggcgcctgatacatatgcaaaattcctaccctcgggttgttccagagtggacattattgaattttcttgctgtctactatttaggcttttttcccatgcagaacaagaaaaggcagggatgcaagacgaaactgccacttgttccaaaatgatgtttctatgtcagcacccaagaggagggatattttgaaacgtagaaaggaatggtgaacattttytctgtaaatatcacagggcagtctacttttaagatgcaaaatatagtattgttatttgtacataaatgtgtatttttaaggaggggacttaaaaacatagtggaaatgcaaagttgtatccaatttagaaaaagcttgaaatatagcattttgtaagattttcccaataatgaactcatggtcagatcttttttaccagttactgattggggtgggggaaagttgaaatggtgaaaaatggaagaaggtggggggaaagtgtatcgatagaatctctgtgtgaaagaaaatcaccttattaatgggttaattaacagctggctttaacatatcattgatattcaattgttcagtgtttttactgctggcatggttattagtactagttaatttagcatttttaccactaaaaacagggtagagccagctagtttagacctgccttagatggccaagcattgttaagttttatgaagatgatttagaagttgattatcagcaagcagagcttttttcagaagggaggtaatgtaaagagagttaataattagctactggcytttcatccaaacatttcccactactcaggaaatgtccaataatccaaacagtggtaactgctgaacagcattatagccggtgagtggtttaacttaccagctactgccactactttttacacatatttgacctatgattcttctccaactcaaatttttttagattgtattttgttgtttttgtgcaaaatctgaatacagtagtttactatccaagttgtactttttcattctaccaaataagcagtctctagagtagaaatgatgaaatgaggtttgcgtatcctctaaaaagacaagagtgaaacttgaagtaacagagaagtttaacaagttacaatttcatatatatgttggtgaaatatacattggtgaatccaggaagagacttaaaatatttagaaaccttgtgtgcactatatttatgcccatttcgcaacacatgagggatctgaaattggactgctttcccatcagtcattatattctgtaggctcttctttagcaatctctttcagatttggaaacttctcatcaattcagagtccgtttgtaacctggggactcatcaccatwcttatccatgcacactactgtagagcttatctttctgtcttcaatttgaacccaacttccagtctaccctcctaatacatcatttttactatatctgtttttagtcaaaaatctttggtggttctttgttgcctttaagataaaatccaaaattctcaactgactgccctaatccaacaccctctctctatctcctactactcctatgtcagtttcttattgctgttgtaacaacttgccatagatcaccagcttaaaacaacataaatttactattgtacagttctgtaggtcagaagtatcactgggctagaatcaagatgtcaccagggctgcatttcttctggaggttctaggggaaaatcagtttccctgttttcaccagcctctggccaccacctgcattcttggcctgtggcccctttctccatcttcaaccgarsagggtagaatcttcagatcttcccccatgactctgctttatcatcacatctccttctcagactctgaccctactaccttcctaaggatccttgtaattacaatgtgcctaccagaataatctcctcatctcaagatctttaatttaattacatcttccaagtcccttttaccatctaagataacatattcacaggttccaggcattaggtcatggatatctttgggagaccattattctgcctaccacaacccataagcataaactgtccattatagccaatcacttttctttactttctccataatcctcatgttcattttgccactgaagatatgaccttgttttatacatcgagaaaagaattccacctttccatcctaccaccctctgacatctaaataaactctctacagccttccaaactgggtttacatcagaacaacaagccaccagcatcccaataaacttcctatttgatttagactgtcttatattagctccttacaacgtttactaaaatgattcatcaaaaagatgtccttatgtccaaaggattgttattttatgtatgtcaaagtctcagcataaactgatgtcacatataaaggatttaactgaagacagtttcataaagtgacagtttagrgaggccttaaaggaacaagaaaagagggtggagcatctagygcaagcaacagtagggaaaaaagaacctgaagcaaggtgagaagaaaaaccatgaccattcctaggcctgaggaggtggcagtgttagtttgattatgaactctagttatgggagggtggccattagactggagttgtggtcataaaaaggaatgcagctagtgacaaaattgaagcccagcagagaaggagtaaggaaaataaatatacctcctttcctcccaccctctgatgtcttgctcagccttcccattggccatccccaaatggcaagatccaaccttycagagaacaaagggcaagacaatcaataacagaatagctagcacaacttaaccccgaaatgtattatgtgcaaggcactgtgccaagggctttgcatgtattatttcattttaatctaaaaaattaagtttactaattgatcacaagcagtcacagatttctttgttcttttttcactccctcagcttcagttgattagccttgaaaaaaagaaaagaaaaaattaaaactttataactattatcaatattttagagatgaggaaatcaaaatatagtattaagaagttaatttcatttgtccaaagttgaagaactaatgacaaatctactcaattcatatctctgacctcaaattaaatgctctaaaataatatgctatattggctgcctaaagataagttcattctctcttgctcactcctctaaatgtgaaatccaaacatagttgtctaaaagacttggataaagacctaattaatgatacaagtcaatcttttatttccatgatttttaggtgtacagcattaagtgtaactcaagtaagactactatttctcgttattaagaatataaatatagaattagccctaattaaactatatgtctctcttccctagaaacattttggttggcctagaagcaagggtcttcttttcacaggcaagatttcctattcaaaatgaaatccagtgaggagatgggagatggctgaatatggggaggaagtcagccacttattcaaaacaaagaatgactcccaatggcagacaatgtattgtcaggaattgctgaagatggtgaaaattgtcttactcattgtgatgtttgtaaaggcagcaatgaattcacgggatttttgtttgtttagtaaacaggcaatgagagtaaccatgagacacatatatatgctatactagtttaactatttctcttccctcctgtcataacacttacccagctattttgaagcatgagctcttgggccacagcttatcactgatgttctgacttcagtagatagatgctcctctaacatgttcctccacttccaacccaataaacttcccactagatttagaacttgctgaatttccacatcttaacatattttagtagaataaagtagctcatgtttaaaatatatttagaaaagttggggactaaaatgctattctttacctacacttctcttctgttgtgtgaaatacaaaatagtgtactcaaattcatgttaagaaactgagatgaaagatattttgaaactgttgccacagtgctaaagtcagaatagattgcctattcagagcagtctgtgactggagaattgtattcgccctcaaagcaagtacagtagagtatcaagagatgcaaatgactgcatatatttctatcttcaagattattgagcttctttcagctcctttattatgccagctactctaaagtctccttggggactttgcataagtagttactcccactgctactgatctcaatccctgaataaacgtcatttccaagagataccctgaagtagattggaccctaccttaggacatgtgtatcccagcacctttgcttctattatataatgcaccacggtattataattaactatctaattgcctgtctttccagcttgctgtatgctctgtgagggtaggatctttaaccataacacctagaaataataggcactttttaattgaatgaatcgcaaaagaaytgactattgacaaactcagaaaatacttaagggatcagattgtccctttattatatacctctgccttattttattatacctctgcctgaaatatttctgtctatccaaatttataaataatggaatggaagacaccatcagttgaaagatgcaccattattttatgtaccactaaaaaagacaagccactcccaatccaattataattgctagattgttagatagttcctagtttcagagatgtcaaaattgggaaaatgtgcgtctgaaaattacaatcaataatatacagtgtatggtactttttaccatggtacttttctatttgtttggacacttaaaaattgtgtcataagattttgaagaggctagtatgtgaaccccatctagatacagagatataacattgttcctctcagttctcttcaagtgccaagtttatatctgatttaggggataattgctcctctggcaccaacagcctcaccagatcccaaaaacagagctccctccaaatgctctatctttagaagagagcttcaggagaaaggtgacaataaagtaatcatataatgttccagttgcacaggattaatgactctagctttggcaaactcttaactttttgtcatgttggtggtaagctccagggttgtgtatataggaagaagactaattttaatcaaaactttcctatgatttaaaaggaagataaaaaagtcaactaagttttaaaaggaaattaaaatgcatatgctggttggtgttaggaattcactttatgtgttaaaaaaaatcaattttatccaaacaggagatccctattaacaagataagtaagagatctgaaatgagaaatcattgtaattcaaatatgcaaaggagtggatacacatactctttttgtatgaattatatgagatctcctaaaataaatgcaaattcttaaatttaaatatagcacytaagtcactttaaaacatcaatagttaagatggtttatatattttgttacaaatcatatatccttactacaaattaaatgtactttcaaaattattttattaattagacttttattttaccaaatactaaagtctagaaatacatgggtactggccaatccttaaaaatatctgtgtaacacattttacttataatatttttggtgaaatgatcttatgccgtataagaatacatgcaaatagaaatacacacacacacacacacacacacacacacacacamttctgttcataggattttgtttatttggtaggaggttttgtattattttgtgacaactgcaagtaagcactttccatcatgagaaatttagatagtgagtgagtacaagttccttaaaaaaaaaaacaaataaaacaaacaaaaaaaaccactttcccttttacccttttgtctatattagctaactaatcctcccagtcatccacttagctttgctggtggaggtcacatgggaacctttgcacaatctgaggtttgcacattctctctaaataaacaattgcgtttatcactagatattcataattggagctctggcttcttattttgtaaagttcactttccaaaccatgtataataaaactaattgccattatgtgttattctaaaatattttaagaacttttcctggggaagatgtattttaaattaccattttcttacctaagcacggctatctcaaatattgaaataggcttatacaaacttaccttaagagtaaccttctttttaagtttttagtaacattataaaacagaatgtgatttcctaattttagaatgtcagttacagacaagttaaaaactctgaattaaagaaaaattaataaccattaatttttgcatactaaaaatatgagtatgtgccacttgttatgctgtgttccaggagaacaaagacaaataaaaggtagtaagtctctgcctttactggtggaagaggtagtagacatggaaagacacaatggtgggagaggctcccaaggtgctttataaggaataacaaaaagattaggtttgtgttgcaggaaagtaagccttccaaaataaaatacaagatgaaaacaagaaaatttatacagccccgactgtttaagggtcacaagctaagcagagggtattaaaacaagatttccatctttcaggagcccataattccatttcatgtcatacaaaccatttcttttatattattataataggaaagatagtaattcaactcaccaatgaggtccatgaaccattttattcagtagagctgaataacataaataacataaataaatgtaccccaaagattatccatcagtcaactctaccaaaccagttatttttccaaggctgaataattatgatcatgttaaaatgagctcttgtcccttgttttgtctgatccagttttctagcttcaagccaggcatttttagagctctataatttattaatatcaagtatcataatatcactaggacctcataaggatggtcaaatgagagrgcaggacaaataatcttatttatcatttagaatgaaaaataattagctttattgcggtctgggacttatttcaagttggtagaatccatccaggaaagaccatatttgaggtctgccaattcttggtccacaaacaagaaactttgaatcagtctttcacctctgaaatgggtcttagaaaaatcagatttgaaagatagcacgcaaaattgaaaacaaatatgttaggatgagattataggtgttgtttaaacacttaaaaaatattactgcagcataatttttagttagaaatttaattattgaattcaattccctcaattcttcagtgaaataaattgggttccagagagactgagtactgccaaaagttacagtaaaaacaattgaagagtaagagctacaatccaggatgcttgacttctagcccagttctcttcttgagacactggaagtgtctcaagagcaacaaattaaaaacttttggaggtaacaatacttttttccccttctggagagattaatataaataagacattgtagggaaaatagatataattaaagttactgatataaagatttatactgatataaagttactgatataaagttttctattttaaacagccaatacataagtataaaattagtatttaaagcaaaagagctaaaagccctggtatttttctcaatactttgctcatttggaaaaaaatgaaaataaatatataactacagcagtttctgaactaccattattaagtgaaatacagtcaataacaatataagtaagtgccttaagaaatgtcttgaaatgtctgtaataatgttaaaatagctgccatactttacatttgactcacctagcttatcattaatatatgagtgcctactatgtgcaaaggacctttaaaaggacaaaggagtataaagataaatccttccagagttcaacaaaaaagatacatgtttaaattaacatggattcaagtttacatggtttcaagtttgagataacatttaagctggactttaaagataggcagcactaaaggaagcagggatgaaaggaagtgacattttaaacagagaagttagtatgagttaaggtagcaaacgagaaagttcctagcatatgtagggaacaaaggttactttcaaggtggaatatagggtgccctgaggggaaaagtgggaagtaaatttgtaaggccagtgcaaattgggattgtagacgttaattcatagggaatgggaatccaaaatgaatcaaaataaaaatayaatgattggtctagaaatactaagccataaacaaaatctgggtgaaaacatctaatagtcaactacaggcttaaattactaaggaaaaaaaaaagttcccaactattgcagttgtttcacatacaacagtaattctatgaaagattttatagtatactgaattatggaggcacactgatattttttaaaatggcccaaagtggtttgcctcataacttaaaaaaaaatttttttaaccatggatttaagagtcaataagggtttttcacaggtttctaatgtacagataaatatatgtatatttttctaaagtagaacattagatctttctctaagagtatgatgatgacctaggctggacagaaggaaaaaaaaaaactatgtagaagagaaaagtataataattttaagaggtgataaaagagcaggaaagggactagtgcctttcaaatcctctaggttggttcccaagctgtgagtttttgtttagctggtaaaggtgacagttgaggggaagtgacagtggataatagcacataatttgcagtgaaggagatgattacaaacattcataatataggatggtggtagtagaaagagagggtatggagttatgcaggcctgaatttcaatgctagtcatgtgatcttgaaaacatttcttaacttccccatagttgattttcttctataaaattaggataacaaatatttaccttacaggggagaattagagcataggaaagaacttgataaacattcaatacgtgatagctcttcaataaaaaccttttgttaagatcccactgtgtgcttaccmctgtgattctgtggcttttaatctttggcagactatgggaaagataaattgtacttagaaagatgatcaaggagcacttcaaagccccagttcaaaattatctcctcattctctctctctttctctctcacaaatacacacacaagcacactttcaccctaccaattaggaattttaagttaacaagatactttttttaaaatacagtgtcctttggataggcaaatcaccttcacacttgagtgtgattagttctttgcttagtgaaaagttgctgggttctcctggaattggaagaaggcaatgtgaattaggaacttcttgagggtactcagtatgataggaaggtgggaagaaggaggaagtaaggggagacatagagagcgagaaacaaagagaaaagaggccacaaatattaataagtagtggttcttatttggactttccccttggaggggacctttccgtcccctgataatctcttaggaagataattgacacttaagtttaaattgtgaagcctgtcagttgagaaaaatgttgagacaagtctcaatcattttaggacgtttatttgccaaaattaaggacgtgcgcggggaagacaggtctatgcctttctgggaagatgattttgagggctccaaatttaaaggggaaagggtgggatactgagaaatacagttttcatgtgagagggtagcagggggaaaatagtcattcatgcctctgtctggcttagtcaatctgaatctgcatttttacgtaagataacatagacaaatggggcaggggaacaatcagatatgcatttgtgtcaggagggcagaggggtgactgtacctgaaaacagaagctatctatttacattgccatggtaaattttmatagaaacactttatggtaaagatcttggcgctcactgagaatttccttgtgggcaaaatatgagcgaggtgtgtagcttttcatctggtagccatctcatttaaaaaccaagaggcaaggcagttttgcgtgacccagttcccagcttaacttttccctttggcttaatgagtttggggatccgagatttattttccttccacacgcctatgccaaactcagattccttcctttcatccctgtttcatctgttcaggctggttagttcccctttycaatccacacagagaaagacagaaaagmcagtgagaagctatgtgtgcaggacttctctgccctccactccatctaagctctcaagaaacttttagattcttttgttttttctattcatcggtctcttaaagaggcaatcccacttctccatttccacttcctaataaagaatgctaagtaacttaaggattttctttaaattatgtagctattcaatcagggtcagtcctagttaatagtttttccccacttcccatagcctcggcttttagcttagctttggcagtgaagatctggccctaagctcttgcgacccaacccccaacctaaacatttcacaggctactgggctgcggaaagctgaggctgccaactttggagcctaggattcccaggacatcaggtcaagcaactgagaggtccacccaggggtaaattccacacatagtttcttctctcttgggaccagcgctttaacatctgggtgaatcagatcgtgcagacacggtaactaggcgcagaaaacagctggacacgttgctgggagcccagacagaacgtgaccagtagttctcagaaaccgcttctaaataccagctccaacaggcttgtagcgtccgagtgcggataaggcaagagcaaaaacgagcatagtttgggccgttggggccaaatctgcacttctgagagctacttttactgctaagctttgaaattggatttacccagagggaagcgttgcagtggcagccgcaggcaggtaaractagtatttgcactcacacactccccggattcttcacagacagggatggaagagaaaacttaggaagttgaagtttggcattaaaataaaggactcgccaccactctgtgcaccttcttgagggagttcattcgtccggagcgcctcacagcttagtrcgcctgcgcacgcgcgaactgcggccccgcctctcctttggggacgggagacgtgcgtcgggtcgcgggacgggggctgcgcatgcgccttcatttmgtcagcccrctgttgcgtgctgccagcgggaactgtgtaggggtagattttcgctgcagtgttccccgagcctgttagacgcagcgcgccgggagactgagagaggaaaggatagaggaagtgctgccctaggctgcatgagtcgaagcaagcgtgtttccttcccgccaggcaagtgcccttagaaaccgggccccgcccccttcctggcctgcattcccatcccctctcccggggcggaggtgaggacctccttggttcctttggttctgtcagtgagccccttccttggccatgaagctcgtgaggaagaacatcgagaaggacaatgcgggccaggtgaccctggtccccgaggagcctgaggacatgtggcacacttacaacctcgtgcaggtgggcgacagcctgcgcgcctccaccatccgcaaggtacagacagagtcctccacgggcagcgtgggcagcaaccgggtccgcactaccctcactctctgcgtggaggccatcgacttcgactctcaagcctgccagctgcgggttaaggggaccaacatccaagagaatgagtatgtcaagatgggggcttaccacaccatcgagctggagcccaaccgccagttcaccctggccaagaagcagtgggatagtgtggtactggagcgcatcgagcaggcctgtgacccagcctggagcgctgatgtggcggctgtggtcatgcaggaaggcctcgcccatatctgcttagtcactcccagcatgaccctcactcgggccaaggtggaggtgaacatccctaggaaaaggaaaggcaattgctctcagcatgaccgggccttggagcggttctatgaacaggtggtccaggctatccagcgccacatacactttgatgttgtaaagtgcatcctggtggccagcccaggatttgtgagggagcagttctgcgactacmtgtttcaacaagcagtgaagaccgacaacaaactgctcctggaaaaccggtccaaatttcttcaggtaaaacaatcttacccagggataattaagaatgggcagagggattggtataaactactcctaaagttttagaactgggaaaaataagaagagaaagtctttacttagctgggattttcatgagataatgaaataaaaagagaatgttaaatgtctagcaaatttatggagtaaacttcgctgaaacatatgaagccttactagcgcttttggctttaagcctttgtgrgctgattaatgggtgttctaggagattattttgcctaacttttgtaattgtgattctaggtacatgcctcctccggacacaagtactccctgaaagaggccctttgtgaccctactgtggctagccgcctttcagacactaaagctgctggggaagtcaaagccttggatgacttctataaaatgttacagcatgaaccggatcgagctttctatggactcaagcaggtggagaaggccaatgaagccatggcaattgacacattgctcatcagcgatgagctcttcaggcatcaggatgtagccacacggagccggtatgtgaggctggtggacagtgtgaaagagaatgcaggcaccgttaggatattctctagtcttcacgtttctggggaacagctcagccagttgactggggtagctgccattctccgcttccctgttcccgaactttctgaccaagagggtgattccagttctgaagaggattaatgattgaaacttaaaattgagacaatcttgtgtttcctaaacwgttacagtacatttctcagcatccttgtgacagaaagctgcaagaakggcactttttgattcatacagggatttcttatgtctttggctacactagatattttgtgattggcaagacatgtatttaaacaataaactaaaaggaaataatctccacgtactaccatcttgattaaattgtgtaattttttataggaattatgagttatctgtagtacttggaaacagaaaatgtgtgtatttaaagacgatgcctatgcagtatattgtttgggatagattgcaaaatttcacactgcatgctttgaaacagttttccttagaaaaagcttttgctatcttatcctgtttacattatttctttattttaattctgcttggtgttcttgcattgcatttaatgatcccttttctccccacctccacacactacattttttttagatttaaatagttttactattttaaatgattgccgtacaattagtagacttgaagacaagttttaaatatttttcttcaaaggcttgttaaaccaatcatgtwaaaaggaaattcttggttttggtttgttgttgttagcattagtcatatttgatttagagggtaacttaaatcagttatttttagctttttagaactttgatctgctagggattgtcaaaataatctccttgaggcatctttatttttaaaatgagattaaagtatgtkatttgcttgttatgtggctaattagtggcaaagctggaagtcattcccagtctggactttagttctttgcgccaaaacatgctatattatttatttatttttttgcttgtcaaagttatacttaattctgttttatatttgtatgtggcattaatttgggtttgcacatttttattggactattttagttgtgaagaagcctgttctaaagtttaagtcacatgactagtatgtggcagttgacttaaactccaatactctttactatcattgacttaaactctgatactctttactataattatggaattgtgcaaatacctcygagtttaaaatattatttttattatttttggtgcacattcctaaaagttaaggaaggagcctcagtaatggaattgcttcttgaccttttgcaaacytcaatttagcaaaataattaggaacgatctaatagtgatgatacagtttttaactgctggatcagcgacgcctatttcaagtagtgatactaactaaactttcgccggtctttcctgtgtctgtgggccttcctcctggtgtgacagacttggggatttcttgtaaacttcctaactagtctgaacctttttatttcttattgggaactgacacttccctatactttaaaactcacatatktatatttttgtacatctatctcctaattcaaaagtaattgagattgtcatttcattataattccgtgagtatctttaaattactatcaaatatgttactaaataatttaataagaatatagaaatgaagccactgagatccttaaagttgaaacctgattgttattatattttcagtaaggatttggagatttttggacatttttactctcataatctatgcagtactgaaatgaggtctaataaatataaccaatacatgttaggccataggttcttaaatttagctacctgttcacctcaacttgagagctcttaaaaccctcagtgtccaggttgcagcccagactagttaaataacgttttatccctagaaatgttttttttaaagctacccagatgattccaataggcgtcaaggctaatagccactgattcaggccttgctattcaaaagtatggtccgtaaaccagcagcatccctgagagcttgttggaaactagaattcagggatcttttgtagacctactgagacaggcgctacctgtaccaacatctctagatgattcctgtgcataataaaatctgataaacaaaggcaataggttattcttcctgtgctggtaaatctctggcaggggtccccagtcaggaaaaagatttgagtattaaggtctttcaaaaaagttaactggccatactcaactgtctataaaacckctataaatttctgtttttatgtctatgaattattaaataaaatttaactcatttttaagaaattacattttctgttatcaagaatacaattcttactagatcataggtgaaaatgtcaataatgataggagcaaattaaaaattcagataattatttttgacttttctagaagacataattatctctggaaagcatatacagtagtctaattccaactgctactcattaagtattggatatgtgataaaaactctatcgataactccaatgtaccttctctaatgtactgtaaatttccatttcctatcatgtgcttgcaaacaaagatttcctatgccactaaactcaataagtgagaagcttgcacattatttcattttgctatagctacgatacatatcaaatgacagctactcctggtccctcatttgtatgttaaattccttgttaattttatgacaagattgttgatcttggatttcactttcattaccgtcttagaaacaaattggatttttctgctcccagatgccactagagtagctttgtaaagctcatttttcttatctttacttagtttctgtctctaactttagtttcctttttcagcttccctgactaattstcttaacctccaattatctttaacagaagttactaattctgcaattcatrtattctggaactggaattatctktgttcctaagcaaccaagtatacatatgaaacggtctgtacattaatgcctcataatagcagctcttatttgggaaagggttatagtacatttaaaccatgtggttttccaagcaagttaagactgsctatttgtgtttagtgtcagaatatgttgaattagaagttgaagagtttctaaagtgattttaagggcttgaggagagatgaacccttttgcttagagccagaacttagatatggggtgtaaatatttatattacactaatcattaagagtaatatatttaattttatccatttttttagtgccttttttgaaccartcactgggctagatgtggggaggacaaacatgtaagcaaatcactgttagaagtaacttgtacaaagtgtgtaaaaggacacagtggtgaaaggggtgacttttaggagaaacttyatagagcaaggaccagtaagtttacctaaaaggggaagaagaaatatggagaaattaagtgggaagatggggaggggaagtgtgctaatcacctaagaacctccgtgctacaagaaggagtttgggtttgaccattaggagaaacaattacaaagctgaagcagcatgctaaactgcatttcacaaataccactttggcagcatcaaggatcgattkgaggaggcaagactggaggcaggaagactggttaaaaaaatgcatattaggaagataygagagaaaaatgataatggccttatcaaaggcarcaataatgttccttgcaataggaatgaacagaagtcaacaggaaatattaagagatgggatcaaaaggacatgactgcagattgctgtttagagttatggaaaaaagtagaatccaaaggtaaatctcagatttcttgagtggtgggagagatgatgacacaaaatgtaactttaaaaatggtaattaaaaaaaaatgttttatgcagtggtggttaaatttactaaaagattttttcaggattcccatagtgcaggaattagcaagctatatctcattcaggccaatcagttactgctagcggaccccatggccttgtgctccccatcttaacatagtatctctgatttgtctcacyagacaaatcagagatacacttccccttttattccgtgaggaaccacaagagtctgaactgtggcatcaattttgcagttggatttacatctttcttaatgatttgaaaataatttgtttcaaaaattgattttgaccagcacacaattttgctggtatatcatgtttaagtaaatgaattctccagcagtgaagcacaactaaagtgaagagctgaagagcaacttaagaaagaacaattaattccaataaagttggtaaaatgctcagtaaaataattttcttccaatggatgtcagcatatttaaactttgtggtgtgattcagtttatatactctaagagattcagtattttagaaaagtgctcttcaagattttcctaatgtattatatgtatctctcatgaattgaattgatttagaaatttagtgtaaaagtgttacacacagccaacatgatttataaaggatctaggatgcaattataatatttttgtgaatcaattatgcctttttaggaaaagatttagaagttaaaaatgcagctaatgaagctgttagaaaataaaacctgtattagtagtcttggatttaacaaggagaacaatcaggagttgctaaatatggtcatcaagtagtaaacttcacgtagaaataaaaaaattgaccaagttcagtaaagagatatttatttaggttaaaaataccattcaaaaacattgggagaaggtatttattaatggagataccttcttcagtggcgatgataaagtctcattcattgtttttctttatatagtaagaattagtcctttttaggaagtgtgtgatatatatcaccatctgtattctcatccacatgttacactattatttctaaatttccaagaataatctgtaaaataactattttgcagtatttaatatctctattttcagtaacatgttattatattgtgttgagataaataacactgattaataaattggaatattatgaatgttttaatttaaattgagaaaygaatgagtttctgtaaggacaaacacctttgtgtgtagtattatagttgcatacaaatttgaggctacagtgtttgctttttacaatgaatattttaactctataataattgacattgatatgggaaggtcttaaattttcagatttcagtgctaaggatgataacatttatgataaattgtggagacttggatatcagtcttcttttaaatttcctttctttatttcctaaaattgcctacattaaaaccccattctttagaatgttagttcaatggaagtgcctgttttctataatgtcagagatttaaggaatttaaagcttatttctatttgggtgccacatttgttttcaaaacacccaatactgaggcaagagcagtatttgccaagtagcaaatwcaagagcaaaatgttttggcagtcatattgcctggctttgcccagggttggtaccactgtccccactccaggaatggacaacctgttataacaaaagtaactgtgtgyttattaagtgtcaggtcttatggtaagtgctttaaaatgcattagtctttcaagaacccagtcagaagggttttgtcattactattttctgatgcaaaaaaaatgaaattaaagaagattaaataatttatccaaaataacagttagtgggtgtgatgaggtgctccctcagctatcaccctaaaaaatctaagaatgccagttcttctcagctttcagtttggagtaggcaaacatgtatctaaaaawaaaaataaattatttgatgacactaaattttatataatcagccaaagtttatgcaatcatttttaatgtttttattctattattttgtcatctyatgaaaaatcaggaactcaattctgtggtcctctaatctacctggatcatagtggagaattagaaagcagagaaaatgtggcaaatctatgtattaaagcaatcccctcaagcaytatccagcattcatttattgttatttcacacctagtttcagcaagctttttttgttgcttaattttaaacctacaattaagtcatgcactattacaataaacttttttttaatgactcaccttaagtagctagaactatgctacccctgggtatgcaaggatgaattaagacagttttccctgcctttaatctagaaattagatatcagcaggagatgaccacaagtggccaagttgacagaattgacagcagttaaaagtgacagctgatagtgggagtggattctgaaacactgtcaaaagaaaaaaagcctagagtattatagagtatttcactgggacttgaggatgttactgaggacaataccagtacctggtattcacactgaggaaaagattaaattacattcagtgtattctgttaaagaagtcaaataaatgtaatgtctttcaatgattttcatccaaaaatagtggtactttaaaaaatctttagctgtcatacctagaatgactgttccagataaccagagttttactatgccttaatagtctcagtaataaaactcaaataattgttgaaggatgaattwttgttaaggaaaaaaatcccaatagattttagttgtacaatttattcagagataggaggtccttctgagttcaagtctacgttccagaagttttatgtctggaatttttcatcaagtcctagtgtaaacattgactagaactttttgtttgacaccattgtgaaaaattgctctgtggatagaaaacattttaatcttgtgtttcagctcatttgatctgatgaccataatttatagtttatttttcctccccaagtgtgttgttgactrtggtataattctttttttctttttctttctttctttctttttttttttttttttttttttgtttgatgagtttgaagaggaagcttaaaatacatttcagtacatggctctgaatcacttaaaatcataagaggttaaagctgtaaggaactttatatatcatcggacctagttccttcatgttacagatttaagccagcccagagagggttggtaacttgctcaaacacaataggagtttttcacagggtccacattcctgtttgatatatctgattccaatgtcacctactttttgtcacctattcatattgagtcatttggggtagaggaacaaggaacaatgcaggattcaaaaatgccttaaaccctccttatttatcaaattatcatcttgtggcaaggcagtttttctctgagcagcattgctgagactcaaactcagttttgaagtcttgttcattccttggaggagtatttatatttccctatagggaactcttcctgcctttcttcttctgagaaccatttcatttttctgaaaatcatgtactaagtacctactatgtgacagggactctaatagcccccagtgatcagaagtaaagaaagatcacagtctcttccttgcaaaaaaacacagtctacaatggggaacgaatggtaaagcagtagtaatagcagtgcaatctggcacaggaacatgggagctcagagggctaactcagcctggctttagtgaggaggtattcccagagtttaaactggcaagttccagaagcccacactgatcttccattagtttctagagagatcaggtgaagggacctgagmgcattcctcttttaaggcctctcaactttactttttttttttttttttttggagacaagagtcttgctctataccccaggctggagtgcagtggcctgatcttggctcactgcccctctgcctcctgggttcaagcaattctcgtgcctcaccctccccagtagctggggattacaggtgcgtgccaccacacccagctarttgtcatatttttagtagagayggggtttcaccatgttggccaggttggtctcaaactcytgacctcaagtgatctgcccatcttgtcctccccaagtgggattacaggmgtgagtcactgcacctggcctcaacttcactttggtaatatttttcttctacagagtggtctctgtaatccctgatctctctaaatgttaaatatttactgtggagtcaacaaacctgagaggagacatcatggagaaggagattccattacctcctacyctcataagaaaatgaaaatcaaatacagaccagggaccatgactgaaaggactctgaaagattgtggaacctttgtataatagtatccatgtttttgttgtctcctctgcatttcttacatgactaagcactgactggttaaaccagaaaaggaagcttagcttctttcgtttttaggacagcaaagatggggatggtgacaggggagtttgagacattctgtccctttccatagccattcctggaagaaagaatgtccaggattaactggttggtggyrcagccacctcagggaaagggaaactgacccctggggactgaagtcaggaataaagaagtgacaaggagctagctggggcctggggaaggccctggggctggacactagaaagacccaccggggtcttttctatttttwtattcaacattttatctttcgttgtaaaactcaggaaaacacctttaacaaacaaaaataacttctctcttaagttgttcattktactaaatggccaacatggattggatatggtagaaggaaagaacattttctgcagaagggagaaaaaaaccacaatctattttatgaggaggaatgaactctgggaatagttctctgaccctttgtgtgtcagtgtgttctcagcctgaactggaagaaaatgggatrgcatgtggaatgtgggaaagtgygaagactgatgcaaaattcactatctgcctcattaaatrcactagtaggttttcaagagaatgagtctgttatcaccacagtaaatttctcactctgggcctaactccttatctaaaacttaatagagcttaataagtgttcaaatttttcctgtctttctgggaatcattttcacctttatctctgatcctgtactttccctaggtcagagtaaaatataatgggaaacgggcaagtaggtaggaaatgtggagaaggtcaaggcctttttataatggttcattgtaaatttaaaattcttagatatgtatttcatacagattcacatatgttcttctggatgaattagaaattttaattgtgaggatcaataaagtagcgcaaccagctttcacatytgtatgaaatttaggactttgcaaaggatgttgcacaccaaaaattacaaaataattcaacgattatttgctacagttaccaaagattataatattaacatttgcaagaacattgcatttgtgaataaccaagtatgatacaaggaagaaatcatccatgtcattctcagaggatatggtgtaagaactggcccatgactcatgacaccaggccctgccactaggttgtgtgacttgaggaaataatttcatctttttgagagttggtttcttcatctgcagaatgagcaaagaagggtggctcttgacttcataatctctcttgcagatatctgattctacttggtgcagtaacaataattgcttgttatttttgcgatcatgtctttccagtaaaataaatctttagtgactctcaggtttaaaaagaatcttttttgcaccctattttaaaagctgccagatttggggtttggctgactactaaggagagcagcctgctagaaggagcaaattccagagctgagggtcatttatttggaatgctttgcyaaacactcccctattttyaaagttgttgggggactttaaacttgaatatagggtggtaggacaattgtttgaaccactctgtaaatacrtgcatgaaaatcttgaggtttacaaatattttttaatagtttgccacatttcaatggcatgtcaagttgcagggtcctgccacttttcttcttgttattttcctcttctatcaactttgctcactctcccaaagaaataggcaatgagaaaaaacaggtcttaatttttactggaatgctctttccatttggctagaggtttctcaaaccaggcggcaccaatcacctagggagttttaaaatcatggtgatgcctgagccctacctcaactaagtcagaatatttgggaaaggagcccaggcatctgtacattttaaaagctcctcaggtgcttcttatctgcagccaggttaaaccaggagtgtcatcactgagtaggactattagctttaatgtgtcctgtgaccacaataccaatcagctctctggttaagaaaagagatgaacatagacattctgaaaaggcaactttataaagttgaggggaatgtatttctttagctttaatgcctcactgtgggatttgtctatacatttatgtatttttaaattactatcataaattcacaattagtaccaaaaccgatcaatttgtgaatatttattgatgccatttacatgcatatgtgttgctaaatacaatgggagggggcctacagaaaggtagagaacccagatcccacccacttcttgaagcttataatcattttggggtgcaaggattgtgtaaaacaagacacaaaaatcacacatgttacagaaattaaaagctaatatcactgagaacaggaagacattacaattggctagaatcacctcaggagatggtacttggatctgggcaccctttgaatgtttttcacttatccggtaggtaaggacattagctctggactagraaatcttggatctcccacaggtgagctctgtgaccttgagcaagtaatgttacctttatgattctcaaacttagctttgtgagcttcaatttgtaaaatggaaaaaatgataaaactgctctcatagagttgcaaggaataaatgatatgatgtaagcaaaatacctgaaaattcctaagagcgcaatttaagttcattttgttccttcttatsgcttttttttttttttttttttttttttttgccaaatacaccacttgggcaacagatcagccatggaaatatgatgcagaagatctgcctcatgcctgttcctaacataaatctctctctaccaaagctgtctgtcagagattgtgttcaaaccagaacaagtggacccactcagtccagagttaccctcaacatgaaacaggctacccagctggttctctgtctttataatatttttatttctttaaatttgatgaaagacccacttttgtgagttttacacacaaatgaagaggagtacagaagagcacatttcaattgtaatgttcatgccaggaatagtaacctcttcaaggataccactgagtgcacacagaatgctgggaggtcctgactctgcttatggaaaccacagaaactcatccctgaaactggttctatagcagccatgaccctcattaaacttccaatcaagtaaaattaatattagctattaggttagatgttaggtattgtctttgcctccatttaatcatcttacttcctatggtacctgttaattatgatttgaatctccttaactgctcagcctgggtgtttcagccatatataagtcataaacagactacaattatcttactatttctcagttacttgcaaacaacaggaaccaagtctgataatacaagaaatgaagaaattttctggaagaaggcaaagaggctcagataggaacaaagaggggaggcacagtcagaaccctgctatagaaatcacctgtgtaaggcaatgcagctgatggaatagccacccccagacaaccatcaccaatacactggggcttctgagagactcaaccagagcttctgagaataatctctgagtgtgaaaatcagattggctattgaaaggtcacrtgcccacattctatgaaccaggagcaggataacggactattctatatgcctacatctcctcctctcattcacatctcctatgtaccttccccarccaggaggaatttgtggattctaggtagccaaaacaaaagaaaatattcactaaccattttaaagaagttgaagtaagagaactaacatttaccaaataccttgcaaagccagccattgcattggtattaggggaactggtagactgtgctgttattagtaccttgcagtcagactggcattgttcaaatcccagctcagccacttgctggaagaaacaatggtcatgctgagcctggactggcaggactccagatcctgatgacatatcactgttttatgtagccctgttggactgatttcacttctttttagtctcaggatttaattcacaatgagttgttttttggtttgtttgtttgattttgagacagagtctcgctctgtcacccaggctggagtgcagtggcgcgatctcagctcactgcaacctcagcatcctgggttcaagcgattcttgttccttagcctcccaagtggctgggaccacaggcatgcaacccctcacccagctaatttttgtataggcgggttttcgccatgttgaccaggctggtctcaaacttctaacctcaggtgatctgcctacyccaggctcccaaagtgctgggattacaggtgtgagcactgtgcgagcccacaatgagtttttaacacttactgttcctcatcagagatgccaatttgttaggaaaacaaagtgcatccctttcaggcttcatatctgcttagaaaaaagcacaatcctataaattacstaatcatataaattagttgagtaatacaaaattatttttccttttatctgacttttttttctgaataaattaccttaaacctggcttcagtttgctcataagytcctgatatttgaacaggtatctgcccaacaatcagagagaattagtcctctgcaccttctgagaggtattaaaaaaaaagggggggaaagaaaaagaatcagtccaattggtagattttaaatggctcatttaaatactacaagtttatcagtctctaaattttcagcctaggaaaatttcarccaggaatttgatattagtcctgatgcatcacgraagtacggaaactcagtttctacagacccagggcttcctggggttacctcaggccacttatatctcttatctgtgcttttccttagctgacatttggttctagaatgaaatggaagtcaggaaagaggaaaatgatgatgtacttccccactcccaacacacacttgtctttagcctaaacattgttttccaatccagctgtcaaacttcaagtatggaagaggaggagaaaaatcagctagcaaatatatccagatttcctgctgggcaccaartgctaagcagggtaggccaaaaacatttaatcaaaaaaacaagatccaccacggtttttactctcctaaagtaaaatataaatttggaggtgagccaaagttaaaaatataaaaatatagccagtgtttctctcctactttcctagggttgctaggttttgggagcctgggatrggggaaaacagtagaggagacatacttattataaaacattcaaaatagtgaatgggacatacttattctaaaaatttacttgctgtttatctgaaattcaaatgtaactgagtatctagcaaccctacatcctgatattcaactttcctactcccctggycatgactggcttgggcaggagagatctttgcctgggtagatgttgggaggagcctggtgaatgtattccttcccaggattggtcttggctctagttctggagcctctgttggaagaatggagaagggctccattccaaaaaatggaatagggatctccttccctatgtttggaaaacactggtctaaggctttcaacaatagccttgaatatcaatgaatgtctacttagcaatcatcttttccagatgattcttatgtcttaaaataatgttacttcaagaaggtrcctaattgtaagacatmcttacagtaatagtagttgggttgtgatgcaatttgataatgtgagattctcttagaaaataaaattagtaataaataactacagctgagtttataatcttaataaattaaggtagcttaatttaaaatgtataactaaacaaaaactaagtcacaaaaactccttgatgacatgaataacatacagcagggagacagtagtaagtagtggctaaggggaaaggctgtggaattacaccacctgagtctaatatctaacactgattattgaggtgacttactgaagtttcctcacctgcaaactaagttacaacctattgtgtttttttaattgattgagattattaacactttttataatgcctggtccagagtaatgctccaaacattttacctattttatatgctaaatttaaacttaatctttttgggacttaatatatatccatgcacatcgagcatattttaaattcagaaaggaaaccaatatgccagcagaaataaaacaaatattcttgttttcaaataaagatcatttctttatgagaaagatgaaaattaacgatcttttagagatagttcaatgttagccactcacagtcacaggtttaaaccgtgaagttagtgtttatttttatgaatctaaaaacaattgttcccagccatggcatgaagtcttcmtattgccccaacccacataaacacactagaaattttcattcttagggagggatagggaggctgggggctactgaatggacattttgttagttaagagctcactcacaggctgaaggagtgtggaataggtccaccattagctattctggccatacctctcttagagattggggtcctggttaccaacgaaggaccatgtggccatatccagagggttggagcaggtctcagggcccattgcctggcacacctcctcccagaattcctgaggtataaccttctcaggaagatagcagagctcttttctaacactccrctatttctggagagtagtgagtatattcccctccaggccttttcacttttattcagaaacacagggaaaataataaaagtctgtctgtattatgactagctacaacaggtgggggttttctttgcagtaatattttcaagtggtatcacctagcagctggattcctttgccttaacagaattggcmccctaaaagcaaaagagatggaagcactgggagtgataaactttgtcagtttagaatcaatttagatcagtttaaaaccattcaaacttgacacattcaaaagctttcaatgctatccactaagaaatcatatttgaggaatttttttccattaaacatttagtctggcttaaatmtagtaagatgctaatcttttcgaaacttgtttttctttctttttgtaaaagtcagttgagtttaatataacaaaagggctgaataccagaggtagagaaggaagtgtcccaggcttggtttcaagacaactaggtcctggattctacaactaagtgattttgtgaccttgagcattactagccattgtgagcctcatttataaaggagggataaagattaaaattatgaaatctttctgtaagtaattggcacacagaatagacgttcaataaatgttaactctgtagcctaggagtgatctggttacaagctttgttaaaactccttctttaaggaaatgtaaaaataaattggtactgtcaaagcttttatgcccaggccatgtagagattatcttccttccaaagaaactaaaatggattgagaagacaaatatcattccaaggaaaggctagaagtctgcaaaattatacaattgtactttagtgcaccaaagattaaaaataatgcagtcagaataacatttatttcatctaccagaatsttaccctatttcttgcctttgattagtttaagaataggaaactaagatagtacagacttataaagatataacgtatttataaatatgtatctttgcatatgcaaattataatatacatattttaaaagtttgcttcagtgaaatttagagcatgagcagacaacctatttttggtgaagagtcagagataataaagtttttagcttttgctggccacacaagctctgtagtgactacttgactctatcatggtatggcaaaagcaggtctcagggccacagacaatagtaaataataggatatgattgcgttcccataaaactttatttacataagcaggtagtgggcaggatttggtctgtaggacacagtttgttgaaccctggcctagagcatgatatagagtatgcttacaaactgggcmtaattaagataactattctagaggaaaaagaatgtatatgcttagattaactcagcaattacataaacacaactgtagtacatacatctattcttttarcatcaaggcttgctgagttgaaaaaaaaatggtatggttctctaactatattctgttgagttgctggtgtgtaaatcacattgtaactggccactattactttttggagttctaacatatgcttatttgcacattagggtttactgtttttctgtgatagacaaatactgaaatttgattcagatccattacacaaatggccaagacaggatattctgtgaatttcctgggaagtatatwcaagtatcacttacctgacagcatctgagccattgtgttataaggaatttcctgcagggattgaattagttaggcttagccctcagtggttttgtaactatttcccgcattcaccttaaacaatgccttttagaagtggtttttgggtgattctttttctccaggaagagattayaaataatgaaatgattagaccattagagaatttaaatcagtagagaatgctaatttctttttttgtcatagtaacagagcaagccaacttaatcagtgccctgacaaagcatccagcaccaacacatacattagaaaggtatctarttcctcaccattttggtattctaattttataaatttyaattctattccattttgagagtatctagggatcagaacctttatggaagactaataactaggtaaacactattacctagcttaagagaccctaaaatgtcagtgacttcataccacaatggtttattttgctcatgtatctcattcctgtgtgagttagatgaccccaatccctcctgtactatgcccttgggaacacacatctctatggttacagtcaaaggagagagttgtagatagaaaacggcacacttccaagtctttgctattgtgaatagtgccgcaataaacacacgtgtgcatgtgtctttatagcagcatgatttataatcctttgggtatatacccagtaatgggatggtggggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgatcgccattctaactggtgtcagatggtatctcattgtggttttgatttgcatttctctgatggccagtgatgatgagcattttttcatgtgtcttttggctgcataaatgtcttcttttgagaagtgtctgttcatatcctctgcccactttttgatggagttgtttgcttttttcttgtaaatttgtttgtgttcattatagattctggatattagccctttgtcagatgagtagattgcaaatattttctcccattctgtaggttgcctattcactctgatggtagtttcttttgctgtgcagaagttctttagtttaattagatcccatttgtcaatgttggcttttgttgccattgctttcggtgttttagacatgaagtccttgcccatgcctatgtcctgaatggtawtgcctaggttttcttctagggtttttatggttttagatctgacatttaagtctttaatccatcttgaattaatttttgtataaggtgtaaggaagggatccrgtttcagctttctacatatggctagccagttttcccagcaccatttattaaatagggaatcctttccccattgcttgtttttctcaggtttgtcaaagatcagatggttagatatgtggcattatttctgaggcctctgttctgttccattggtctatatctctgttttggtaccagtaccatgctgttttggttactgtagccttgtagtataatttgaagtcaggtagywtgatgcctccagctttgttcttttggcttaggattgacttggcaatgcaggctcttttttggttccatatgaactttaatgtggcacatatacaccatggaatactatgcagtcataaaaaatgatgagttcatgtcctttgtagggacatggatgaagctggaaaccatcattctcagcaaactatcgcaaggacaaaaaaccaaacaccacatgttctcactcataggtgggaattaaacaatgagaacacttggacacaggaaggggaacatcacacatcagggcctgttgtggggtggggggaggggggagggatagcattaggagatacacctaatgctaaatgacgagttaatgggtgcagcacaccaacatggcacatgtatacatatgtaacaaacctgcacgttgtgcacatgtaccctaaaacttaaagtataataaaaaaaaaaaaagaaaaagaaaatggcacacttgctcttgactcccttggccggaggtggaggtaatacattgttagttctgatccttgttcattgatgagaaccagcccacatggcttccacctactgctagggactctgggacatacagacaagcacataattatttggtgatatttggtgagccctaactgccgcagaaaaacttttgaagcatttagttctctcccgagaccagaaatcaatcaggtaaacatgaataagaaatttatagtattatctcagtttttttttattggctttaacaagagcatatgctgggaggatatttgctatattctgctagtttccccaatttaaggttgtctgttttgattaaaaccccttagcccagtggaaagatgaaactctcatctatttagtccttaatatctctatcactaaatggataggtttcatgtactcttcagtattgatagcctactttctaagtgtgtgtgtgtatgtgcatgtgtttctgccattacagtcattgtatgaaacaattatgtattctgacaacagctagcacagatttatctatttaataaatgttggttgattaatagataaaggcacgtttatatataccagcaaatacgaagacttggattcagtaaagtttgataccattcaatagcattaagattaaggatgactgtgayggcctttagtttgcatttttagactgcttaatttgggtcaatgtttctcaaagttatctccagtggtctaaactgttaaatctgttccraagtctaggaacctatgtcagtcaaaaaagtatgtttttagacagctctcctcaccccattccgtgtgaagatggccccactgatattcataaaaaataagaatattccctcccaatgaatgttgctataaggaaatttgctcatacagaattggtaaatggaaaaatgatgtcactataatacataagtcactataattcagttttccctagcaccttaatgtttatactaccaatgccaccacttgaatgccaaatacactaagagttggacacagtaagcatatactcatacagtattgtaaggaattcccattctccttgtattcttcctctttgcctagttttgctgtgtgtgatttcttggaagggcttatataattggccccaaacttagttcattttgcccttgtccccacaactattcagccttaacattttcttacttcattccactgtaatcatttatttagtatagaatttattaggaatctaaatgcctttaaaawtaygctagtatttttatttgagttgtttcgactttatgttttagctaaaaaggtgtatggactttgagttgactgccccaactctgtttttatcataagctgtatgatttttatgtgtgattttgtagaaaacacaagattgcttttaggaatgaatatatcacattataatagaaatatctgttttcttgcaacwtaaattgcatatattttatgaatggaagaatgtcaacaacaaaattggcaatgggactatttgagaatttgccatgtggaggccgtttcctgaccttttatcctttatatgctagagtgctttagagtttccaaatggtgttcatatgtrgaattttatgtcaatccttgaacaatactacaaggatcattattaacatttctacttgatagacttggaaatcaaggctcagaggagacaaatgttttgcctacagtagattggtgacaacattctggctataattagttactctaytcaaataaacatatttgagcttcgattttacttagggcactggggatacaaagataattaaaatgaaactcagtcctcatccaaccagttgcctctcttcttcctcccactgattcagggacacttccgtttggactgggcagagctagacaatctcaaactcatagaggcatctgcattgctagtttcctagaagagctggaggctgagtatccggactgctctgcataggggatatgggacacttaggtggctcctggccaagtggcccaagcctgttgctgactggaagtctgtcacttggctctcctccctcgccagttcgtattgtagcctctacccttgacactgtctcacccagtggaaacacagctgcaagagctgcagaaggcctattacttctaatctttctgcttcgtatgatcggtaattacaccccagggacacataatgaagatggttcatcactgctttttatgtgcttcatagtgtgagatagtggactgggaacttgaatcagagcaagaaaattgttttctgctctrggtttggtcacttaaactagccacagtatattaggcaaaatatttcaactgcttgggcatcagtgttctcatcatttgaggacactgtctcattagatggtcgaatagggacttttccagctatagccttctgagattcctcaaggacacatcgagtttgtattgcatggtcaaaagagggctccaaggaaccaggtctaacaagctttaaggtgagtgagttctctcaatggtgccccgactttcctgacatccttctgaatcttagacaagcctcggagagagatactcatggaatgaccaaaatggtagcaccagatctgtatgaggtatttaatcattttattttattttaatttttagacagagttttgctctgttgcccaggctggagtgcagtggtacgatattggctcactgcaacctccgcctcccgggttcaagcaattctcctgcctcagcctcccgagtagctgggattataggcttgcgccaccatgcccagctaatttttgtattttttagtagagatggggttttgctctgttgaccaggctggtctcaaactcctggccttaagtgatccacccacctcagtctcccaaagtgctgggattgcaggtgtgagccatggcacctatccaaatcattttaaatggygatgattatgtccaataagtccatcttattctcttgggcatctcaaccttttcctgccttaggaaaatggaggtcctctaactcctaagatcttgtcacatgatcctgctgtaggcagaacccacaccagttaaatgtttatttacttgatcaatgtttagcctgtggttggcttttaaatatcccaacggagactgagaaagcagtgcagagagtgctaaaatacagacaaaggaaaagaaagaattggaaactaggagaaaacaaggaaaaaagaaggggaaagtgctttcagcatttcttttcaacttcctctacatgcttagaaaacagaattgacttttgtatgtctgtggtagctttacaaataaattaaacatattatcaacgtttgccaatttattttacaagtatacggaatatcattagcacattctggtgatagtatgtcagatatttaaagagctctagcttgaagaaaatgggccttactttaagagtgctatatttgttttatgttctcatacttaatgatctgggacctaattttcttcagccctgattatgctttgtttcatgacctttaatatatatatatagtaatcattaaatcaaataattataagtcacttaccaaaggaattaaatatggaaaatgcatttgaatatgtacatgattcatccacattttaatatctatccttacttctgtttccttttgtctcccattaatgataaaatagctgagaagattgttctctcttttctttctttttttttttttttttagacggaatcttgctctgttgcccaggctggagcggaatggcatgatcccagcctatggtgacctctgcctcccgagttcaagagattctcctgcctcaggctcccgagtagctaggattaaaagcatgtgccaccacgccctgctaatttttgtatttttagtagagatggggtttcacatgttgctcaggctggtcttgaacttctgacctaaagtgatccgcctgccttggcctcccaaagtgctaggattacaagcatgagccactgtgcccggccagattgttctctcttaatgggctgataagtaaccaagtaaaacatattgtacttttaccccatgctagaggcagcaagcccaagctgcagaatgcccaattacacaatcctctattagccaccaaagagaagatacttttaaatttgtattacattatttaaatagaaaaaataaagacagaagatcctttaaaaagcaaactggataaatagtacttcagaattctatatattatttgttacaactgcatgtaaacctataattacctcaaaatgaaaagtttartttttaaacaaagcctattattgtatgattaaggtggataattgagctgcttcttatttttattatagtaaaatatacataaaataaaatgtattattttaactgctttaaaattgtaattcagtggcattaagtacatttacaaggttgtgcaatattgtgaaccactgtctgtttcagaacttttgttactacatccagtggaaattctgtatctgttactcttattcctcccttccctctgctcctgggaactacagatctgttttctgttcctattaacatgccgctttaaataatatttcatataaatgaaatcagacaataaaaaggtattttgtgtctggcttctttcacttagtgtgatgttttcaagattcattcatgtcatagtatgtatcagtataggcccatcttgttttaatgcacttcactttattgtgcttcatagatactgcgtttttcacagattgaaggtttgtggcccactcttcacttgaacaagtaacagcaagtgctcattttgtgtctctatgtcacattttggtaattctcgcaatttcaaaatttttccttattattatatctgttatggggccttgtgatcagtggtgccaggaactgtgcctatataagatggaaattttgataagtgtgtgtgttctgacagctccactgaccagctgtttccttctctctctcccttttcttgggcctctctattgcctgaggcacaaaagtattgaaattagtctaaaataggcagggcacagtggctcatgcccgtaatcccagcactttggraggccaacacaggcagatcacaaggtcaggagatcgagaccattctggtcaacatggtgaaaccccgtctctactgaaaatgcaaaaattagctgggcgtggtggcgcctgcctgtaatcccagctacttgggaggctgaggcaggagaatcgcttgaaccagggagtcagaggttgcagtcagctgagatcatgctactgcactccagcctgggtaacagagtgagactctgtcaaagaaaaaaaaaaaaaaaggaaagaagttagtctaaaataaccttacagtggcctctaagtgttcaagtgaaaggaagtcacacatctctcactttaaatgaaaagctagaaatgactgcgcttagtgaggaaagcatattgaaagccaagataggccaaagctaggcctcttggtccagttagctgagtcatgaatgtaaaggagaagttcttgaagaaaattaagtgctactccagtgaacacatgaatgataagaaagcaaagcagccttaktgctgatatatagaaagttgagtggtctgggaaggtcaaactagccacaacagtcacttaagccaaagcctaatccaaagcaagatcctaactctcttcarttctatgaaggctgagagaggggtggaagctgcagaagaaaagttggaagctagcagaggttggttcatgaggtttaaggaaataaaccatctgcataacataaaagtgcaaggtgaagcagcaagtgctgatgtagaagctgcagcaagttatccagaagatctagctaagataatttggtaaaagtagctacactgaacaacagatttttagtgtaaatgaaacagccttctagtgcaagaaggtgccatctaggactttcatagctagagagaagtcagtctggattcaaagcttcaaaggacaggctaactcttcttaggggctaatgtagctggtaactttaaggtgaagccaaagcttattccaaaaatcctagggcccttaagcactatgctaaatctacctacactctataaatggaacaacaaaacctgaatgacagcatatctgtttacagcatagttaactgcatattttaagcccattgttgagatttactgctgagaaaaagagattcctttcaaaatattactgctcattggtgatatacccagtcacccaagagctccagtggagatgtacagagataaatgttgtttcaatgacttstgwtacaagattcattstgtacccatctatcaaaaagtaattttgactttcacgtctcattatttaagaaatacatttcataagactatagctgtcatagatagtgattcctctgatggatctaggaaaagtaaattgaaaacctcctggaaaggatttaccattatagatgccattaagaacttttttttttttttttttttggtttatgggaggaggtcaaaagatcaacattaacaggagtttagtagaaactgatttccaaccctcatggatgactttaaggaattcaagacttcagtggagatagtaactgcagatacggtgggaatagcaagagaactggaattagaaatagagcctgaaaatgtgactgaattgctgtgatctcatgataaaactttagtggatgagttgtttctcatgggtgagtagagaaagtggtgtcttgagatgaaatcaattcctgaaatcaactcctggtgaagatgctgtcaacattgttaaaatgacaacaaagaatttagaatattccataaacttagacgataaagcaatgtcaggatttgaggattgactctaattttgaaagaagtttttctgtgggtaaagtgtgrtacaaaagatgctcaacagcattaatcattagatattcaaccgtgggtaaaattgcatgctacagagaaatattttgtaaaatgaagagtcaattgatgtggcaaacttcatggttttattctattctgagaaattgccagagccactgcagccttcagcaaccaccaccctgcccagtcagcaaccatcaccattgaggcaraccctccacctgcaaaaagattatgactcactgaaggctcagatgattgttagcgtttttaatcaataaattattttaagactaaggtatgcatattgtttttgtagaaataatgctttgtgtacttaatagattacattgtagttcaaacacaacttttatatgcactggaagaccaaaaaatttgcatcacttgctttattgcagtggtctggaaccaaacccgcagtatctctgtgatgtgcctgtacttcattcctttttcatagctgaataatattctattgtatggatataccacatttcatgtatctatttagcagttgatggacatttgagtcatttccacctttttggctattgtgaatattactgctatgaacaattgtgaacaagttttctctgaacatatgttttcaattctttgggggtgatatacctaggaatagaattgttgacttgtagggcaactctatgtgtaactttttgaagaactgccaaactgttttccatagcaacattaccactttacattcccaccaacaatatatgagagttccaattactacacatccttgtcaatccttattttctgtttttgtgttttttttattatggccattctactggctgtgaagtgatatcccattggggttttaatttacctttccctaataattaatgctgttgagcatcttattatgtgcttattggccatttgtgtaacttatttggagaaatctctattaatatttactcattttttaattgggttgcttgcctttttgttgttgagttgcttcttattttaaaagaaatcagactcaagaggactttagttgcatgggaaatattctaggtctgggtgatggtttcatggatgtgttcactttgtgataatttgtgcacttatatatttctcaaaaatgagcatgtgtttcctttcttgaatgtattagtttcctagagctactgtaccaaattagtacaaacattagtggcttaaaacaatatattgtctcacatttctggaggccagaagtccaaaaccaagatgttggcagagccatactccttctgaagcctctatgggagaatcattccctgccttttccagtttctgatggttcctggcaatccttagcattgcatggcttcttgacacttgatactaatctctaactttgtcttcacatggtcttctttctccctcatgtttctgtttytgtatmtaggtatcttaaatactcctctcctttctcttataagattaccagtcattgaattttggccccaccataaaaaacaggatgatctcatttagacmtccttaacttaaatacttctgtaaagaacctatttccaaataaggtcacatttacagataccgataccggggattaggacttagacaaatttgtgtgggggaacacaattcagcccactataatgaacatatattaggcttcagtttttaaaagatggctttaaaaaacaaaatggaaaacaattttactggtcagatgtggtggctyatgcctataatcccagcactttgggaggccgaggtgggtagatcacttcaggccaggagttcaagatgagtttggtcaacatagtgaaacctgtctttaccaaaaaaaagtaataatgataataaacatttaacaaaaagraaaaagaaaactactttagaaaaatgtgrtagtctaggtttctgagtcaaaatatctgtaggttaaggaggaaaaaaaattcacgggatgctcaccaccataaaagttagaaattcttaatttttgaaaaatgatctcactrtttaaaaagcacagttagatggaaaaggggacttatataaaaaagactttcaaaggatatttatctgttgtgggtttttttttcattttttggagaggaagctaatgaaaacagttcaatactcatttatgtagagaatatctttcaagacattaaaaagcatatttttagtattgccaaatacagagatttctattaaaatttccagaagacatttttttgtgtgtgttcacactgttacccatggcacattcctggttttttgtttttgtttctgtccttaagtgatcaataatattggtatttggtcattttgaacattgtgatccttacctttggacttgttaacaactggctgaggattcaaggcataaaaggaatattatgcttactattgagcctcagcacctttgtattttaatatgacatgtggctgatgatcaaccttgctgggtctcatttcatatatcagttaaataaatatatgaatraagtaatattttcttcccaagagtgatatttgattcaatagattaaaagttatttgagtccctaaacataaaaaagccagtagggtatagtagctctgtggcaagcaattttagtatcagaacacatgaatttaaaactttggacaatggccttattcagaacactaaaagcttagaagcctactctttagattgtagtgctattttggaggcatatcttttttctttttttctctcagtttttcttttttggatagtattccctgttaagaaacagatgatgaggctttaattcagtacattctcaaattgttcccactacaaaacttatttcaaagataaactttggaagttttcataggtaggactgtaagaatgttttaaataaatcctaatcattttaccagagagtataccttaaaacaaatttttctggctttatttgacaggttttttwaaaaaaataacttagtcatttttaagttgattgtagttcatccagaaagttactccatgttggtaaaaggttaaaaattaagagagtccaatttttgaaaattttcacaaagttctttttatacttttaaattagtcaaaggccaagtatttcataaagtgttgatgtaaattgtgttactgatctttgatcataatgtggaatagtagttgcactcaagatatgaaggaaaaatatgttacagggtttggctttgaaataactgacatacagcagaggcactcaccctaacatactttccatctatacgccaggcagggctgtcagtttgtggaaaggmaaactgggacctccctcagctctgccctcctaataagaccatcctgacacaaagcagcaattattctttgatgacatcaccaccgtcttgcccttatttttatgtgcataatggaagatttcaactttaaatctgacctagccatgaaagtcagtgtgagtcctgcatcatgttttcatcctgctatgtttttactttctggtagtgcttttaacacagagagtttccaacttgaaatatagagaccttttaggaagttttttacataggaatcacctgtctaatcaactacaagaggtcacacttttttttttcctttgagatggagtctcctctgttgcctagactgatgggcaataacgaaatcttggctcactgcaacctctgcctcctgggttcaagcgattctcatgcctcagtctcccgagtagctgggattacagacgtgcaccaccacacctcggctaatttttgtatttttagtagagatggggtttcaccatgttggccaggctggtctcgaactcctgacctcaagtgatctgcccacctcagcctcccaaagtgctgggattacaggagtgagccactgcacccagccagaaagtcacacagagggttacccaaactaagtctcaagatacctgtttctaatgacttttagatagcatagacctctttattgattaaataggaaagagaaaagaaaaaaaaaactctagaatttttaggattcataaaattggcatcacaataacagtaatcacttatggctcctaagaattttttctttttttttttwaaccttaaagattagttaatttaattacatcttaaatacatctcgcaagtgactacaaattctttgagggcagagacaatatattttttttaccttttaatcccttaaagaccttctacctttcctttcacatggtggacttttattaatgtccgctgaatgaatataacatattcataatatagtcatgtctatacattgattaacatatttgttatcaactgcagagtaggcccagtctttctcttttactctctgtccttttaagaattttaagagctttttggggaaaataaagtaagaagaaaacaatgagtcatgtctttgtagccatctagatttcttagctctgttgcctcattcttcctcctcattcttcccccagccacggtggagaaataaagttgtctggggkctcattactggactacccaatctcagttcccttctgtactttagaactctctccttccctcatcttgatttcactaggccacactataaccctgcttcctggagagaatcagacccatgtragctcttgagcctcctgttccatggatctctccaccaagacaagagcctactccaggctgccaacctgagattagagagttcatactctgattggtccccatagaattaatcaacggtggccaagagtgtaggtaactagatggctcattcagatctgatactcattcctggacttgtcagctgtggcctgggtggcagagtcacttaaaaacattgcagcatcttcagaaatctttggttggagtagaatagatgccaaaaaaggtagttgttggcttctgatgaaatggaagggtcaaattaaataatagctgaggtctcatcccttctacccataagattctatgatttatcactaaaacaatcacatattaggaggtcataaataattctacacaagttcttctaatctccatattttcttacacctatggtcaaatacatctctcttgcaagaattatataaccaaatattacatacactatgttagaataaagaatgaacactatcactagaaacttggaagcagatttaaatactgaaaaatattataggtatcgaaaagaccctttttattctggcagaaatatataaatctgtgtgtgtgtgtgtgtgtgtctgtgtgtstgtgtgtgtgtgtgtgtgkgtgtgtcttctggtgctatttctcaaaagagtttttttttttggtagattttttttggttacttttttatttcattttgttaagccatcaaaagctttgagattgggctgggcatgatggctcatacctgtaatcccagcactttgggaagccaaggtgtgtagatcatttgagttcaagagctcgagaccagcctggccaacatggtgaaaacccatctctactaaaaatacaaaaattagctgggcatggtggtacacacttttaatcccagctacttgggaggctgatgtgggaggatcacttgaacccaggatgtggaggctgcagtgagccaagatagtgccactgcactccaacctgagtgatggaccgagactctgtctcaaaaaaaaaaaaatgctttgaaattagcctttacctgtgtgtactacaatttaaaaggccatctttgaaaagacagtaaaacagacttttactatgaaaagctaccatctggaacccttagtaaactgactgttgtctcataaagartacaaccaagcctaatgcaacttaattgttcacacagttwtgtaagatgtacttcttctataactctacaggacttaaaagaactcataatactatatgattgtattatgggttccataaaacattatgacaatgtattttctggaaaaatgtttcctagtgaacatgcataccccagacattttacctttctcttaaattattccatctgattttactaccttgctcttgctagagttaagagttttctgaaagyttattcagtgttaactaatgttacttttcctgggccatttttgttggtattgagttttttctttatgtgatcataaagttatagtttagaacaaggttattttgttgcaagagtctatttaggtgtaatattttttaagcaaattgaagttgttctgataaatgtttatctaaattaaaatataactccataaactatgatgtggccatttaaaggggaggtatattaactttgtggaattgtgccattaaagacaaagaaaaagaaaaaagaaaagcagttggctggatgaagtagtatagaattgcaaacttacatgagataataattagaatcaataagacacctaatggaaaaagaatattcatatgatatattcattcattcaacaaattttattaaacacatcatctaccaatgaatctatgaagatcaggtactttagcaatatagaacaatgtacaataacayrtaacataagacagtccatgtgaaggcagttcattcctggtgtggtggctctattgtcagcataaccctgtgttactttcatctttctgcttcagcacctagcacatcacttctgttcaagttcacttcatagtccaacagggcagttgaagcctgtcttagtctgcttagttgccatagcagaataccatagactgggtggctaatataacagaaatgtattctccctctgctctagaagctagaaggccaaaatcaagttgctttcagcttgatttttgatgaggcttcccttcctgtcttgtaaatggccatcttcttgccgtatcctcacacggccttatctctgtgtacatagtggagagagacagagagaaagggggtggagagagagagagggagagagagacagagagagaaaaagaaggaaggaaggaaaaagagagagaaagaagaaagggagaggaagaaagagaaagaaagagaaagagagagagaaagagagaagaaagaaagaaagagagaagaaagaaagaaagagagagagagaagaaagagagagaaagaagaaagaaagggagagaaagaaagacrgaaagaaagaaaaagaaagagaaagaaagaaagaaagagaaagaaagaaggggaaggaaggaaggggaaggaaggaaggagagaaagagagagagagatctggtatccctttcttttattataaggacaatggtcctatcagattagggccccagtggttgtgatttcatttaaccttaattacttccctaaaggccctatttccaaatgctgtcactttagcggttagggcttcaacatatgaatctcaggggacacaattcactctattgagtgaacgctaactattatacaagagttcataactgagagaaggacaaagaagaaaggtagaagaaggataaaagagaaagtagaaggacgtaaaaggcattctgagttgaatcagttctgcacaggggatttctgggatatcccatacaatacttccacttactttttttgggccagtatttagtcgtacagctatgctatctacctgttgtcttctggctgtgtacactgctgccccaagtaaagattttattactaatgaaaaaaacggatattaagagctaataagccttcttaatcatatccagaactgtgctaggcgttgagaatgagaatataagttcttatttttaagtactctaaggaattcccagtctaacaggagactagtacatgtaaaccagttacctttaatataaagcgatacatcctatgggataaatgtgtacaagttctgcaaaaacagaggaagaatgattatcaacgggggagttggggagagttcaccaggctaagaattgaagaaaggaatttccagaagtggggaaaactttagcagaagttcgaytgagaatacaagatgtttcagggaactgcgcatattgaagggtggccattacttgacattctgagccagagtagtaatgagattggaaaggtcaaatgagccctcattttaatgggtctaaaatggtgcttaaaaagtgggacagcatttattgggtgatgaatttatagatgtgtgtgtgtatatattttgatacaagaaacccttctgaagaaattagttattagattccattgatgtcacaaggtgttctttttgttgttgttattggttcgkttgttctaatttctgcccttttcaagattcaaatcacaacttaaaagcaaggagttgcaagaatatatggaatggtgagaaatgattgatgttagaaagctttcgaaaattgcaatacrtaaggaaaattgtccaatgcacattcttatttatctgcatttatctttctatatcctgttgaactttgccgataattgtagaaacaccttggcatttctttcttccatctttatattttcttgatatcattagaaatagatgttcagtctacctcttgcatgctgaccaatcctaaattgggcgatgacctatttattttgcatcttccctgaatgcttaatcttcatgaactagaaatggccagtagaaagtcagtaagtgttacttaatttacttccgtatttattaaatttctcccagagtaaggaattatgagttcctggagcagcacatgtgtctctttcttacagaaaatttcagttccatggtgaggattatttgcacatctctgaagaggcaatggtccatccagacaaaatagcacagagccagtacataaaataagaaagtggactgtggacaagtcctgacaaaattatggaaagaggaactagtgaaaattctagcaagtcagtatcttttctggccagtacatttgtgtaagcaaattgaactttaatcataatatagtgccaatttgatttccaaaatctttgtctttttttggtcccgccttggaagttgaatctcagtcatgtacaccagaatatgaatgcgagatgacagctcccataacaaatcacccttggccagatttccgccacttggttgttcattttgcctacctctgaaattagcaaatctctgcctttgtctacttgtgccttctcagatctgctgctcctggcccattccttgatctcaatgtggctgaaagtattaagattttagagcatgtataaagataataaaggtcattcaatcaagctcttctattttgtgcattttttgcttctctaagaagcaagaatggcactgtgatttcattgttgaaatagttaagaaaataggggacaattttgataaaattagaaaatcttagagaagtatcctgttactacgtcttcaaatgtataatgataattatacaggaaaatttaaaggcatttttatcataaaatgcttcaagcaaacgagaaaattatgaggaataatatatcaaatagcaatgtgccctctacccagctttgcaaaatctaaacatttttctgtaattgtttatttttcataagaaataaaactttattaggatttttgagaaagtccagtaaagaccaaacctcttcctcacttgagatcagaaccaattgggaaatgacaaagaatcagactgatgaatcagcatggctgatgaattaaattcccactactgaaccgtagaggaggctgtctacactccagcgccagccgagagcctgacactggacgaacaaagcaaagcattttcttaacgtaggcaggctcagttctaaaagaaaatgagaaagagaggatggggctggccacacagtgtctccttccagactcaccaatcarttagtgtgaaggaagggcaggttgagaaatagccgagaagtattacaaccggtgaggcactcaccccatggaaggaaaygtcagaagtggaaagttagcatttccctctaaaaacatataaagttaaagccatgtttttattcccttttagaccctattttttcctccccttctcccatgcaaatgtaacctctaccctgaattttaagatccttatatataacaaatacttagtcactagtgttgtgattctaagtatcagaatgcttccatttaagggaaatattggctgccggttcttggggatattgactataacatctgcagttacttcagtttcaagatactcttgtagactaatggaaagaatgtaaaagatgatgctactagatagaaatagagtttggatcgaaggatgttactgcccaactaatgttctaagtgctgaaagatcatcctggtcttagcaacagcaattataactaagaaaacaaagtttagagttatctcaaaacagaaaagaaagcatcaaaaagttatctctttcctctgaaacaaaaataagcattctagtgacccttgccttctgaaatatttcaacattccaagctactgagacttttcttattttcttataaacaaactttaatgccctttaaaatactttctgatttcttttctaagcgttttcaggtgaataacaagttacattcgtttggcttattttctcttcataaaatggacaagtttttagttgagcagaggaaccgaaaaacttctgaatgaaggaaatatttggtagtgaatgatataatggaaaattgctataataagtagctgggaagaagcaaggaagggagagaaattatacagaatcattttagtttaagtggcagtgtatgattagaagcagtactgagacattgagaaaaatagtctattacataccataggaaaatcaacaatggcatctctgaatatggaattgctagttaaagctactaggtgactctaggatggacaattttttttaataggtttttggttttggttgaggtacactgtcagagtgtgcacagtatttcattttgttagttagcttcatgaagaccttaatttattaatgttaatgattgaccacttgtgtgttaaaccagaaagtatttagtcagttgaattccatcacaaaagaaatgttatgaatccgtatattttgcctcctgtttctgagaaatatggcaaataaaaaaagagaggtcaaactaaatctaatacctctttaagtcccacagcaaaataaaacataggtaggcctcattttatgttttgattatgtcttgaaaaccttgtatacaagttaaaacatttgtaaaagtctaggcatgcttcatttttgaaataatgtggtagataacttaaaatgccagtaattatwttccagtctaaataatcacaacattgagtcaggtgtggtgactcacgcctgtaatcccagcacttcaggaggccgaggcaggcggatcactcgagcccaggagttcaaaaccagtctgggcaacgtgacgagcacttttctatacaaaaaatacaaaaattaaccaggcatggtggcatgtgcctctggtcttagctacttgggaggctgaggtggaasaatcacttgagctggcgaggccgaggctgcagtgagccatgattgcaccactgcatcctaggctgggtgactgagtgagaccctgcctcaaaacaaaaacaacaactacaacaacaacaacaaagtcacaacataatttaatagattttttcatatgttggaatttcactaagtgaagaatacctgttatatgttatatgttataggtgataccgtaaggcatatgaatgatcatatttctaaaaaactttttactttggctcctaaatttcaataatctaaataaatactttgaggtatatttgaatatgttttttgttttcattcatttctattttatttttatttacatctgaatgtgttttcacgaaacaattttagctccaaactccaaattgcactattagggaaagggagaatagcttttggctcttcttgtactatttgaacattaggtaactggttactgtcttctgcacacttttaggatgtcattggttcaatctcagggtcaagtcttacccaactgtcctatgtactctgtccattcatgccttaaaagaaagaacctgaagaaaaagttgtacctttattagcaggttcttttaaatgaattttattaattaacatataatttcttctcagtaagatatgtgagctggcaacacattgccaatcctatggttatttttgttagtatgmacaataggtagtttcatgggtcaggaaagcagaaatagtatacaaggttaaagaaatgattttcagttctctaatttccactggaattattaaacatataaataaacaaaaaagaagtaagataactcactgtccctaggtgaagcaatgaaagtaagtgaagtagtaactgtgtctcctgtttcaccctcatgcttggacatgtgtatgccttcaaaagctcacatccaagtcatccagaaaaattagcctgttaaatagtataggagaatcaacaatggaatctcttagtgcctggaatttgcaattgccagttaaagctagtaggtaaattaaaaataatttattttacagtgtatactacctctttgctttactgaccctcaaaaacgcctgctgtgtatactaacaaaaatacctttataactggcaatatcttactgagaaaaagttataagtaaatgaataaaattcatggaaaatattccactaacgaaagtaccacttttattcagattcttatacatgcaaaggcttacaatatcatatttctgggtaaatacttaaataggatgccaccctgctttgttttgaagcgtagtacgcctttccgtatgcagtgctccatgctgtgcagtcacggaaattaatgagttcagcgttcaggatgccagggcagctggagaacagagttctgtgctcatgtggcttacacaaacacacgagttgtgtttcccacagtgggatccagggacccctgaggttctgcagcttttttatttggtgaaacatagatccgaaagatgatgctgatgtggtgaagggggttggtttctgaaactgtttaagaattttagagatcaagagtaggtctgagaggagctggcaaagcaggcawttatttgtggtgggaggatatggggaaagagcagatgtctgtagatactacaaaggaaaataaacaccatgaaagaacaaacttatgtagaaaaattttaaaggaagattttttaagaaaggatgtttgggaaacactctaggagttattctgggtagcacttataaaatgggacaacttcttacagccagaatgacctttatactgaaagtcttcatttcttttgatttattccatcctgtcccatttaacaaacttgtattaaacagctactttgtatcaagaactatacttccttgcctcctttccaccagacacagatatacacatatacacacactcactttgaagttcaaataccatttgtaataactggagacccacaggactttagcactaaaagtcaaaacaattcgcttgctatggcaagatgaagttaaaaagcagcttcccaggatgaaacttggaaaatgcttaaatactgaggtgtttatttggatttgcttttctaaacttgttgatggaggtaggtatcttgctgacatattacatcatttctgatgaaagaattttagtaagatttcttgagccagattttcttcttaacattaattgtattgggaagttccaattgtttgaaggagacactgagttggatatattattttttacatcaaatataaattttctgtatttgagattatgatgtcatttccaaatggttgtgttgcttctgtactcattggccaaggccctataattatttgtcatattttaattctctttgttccccatatctttaccactagaggtctgtggctcctccttctcaaggttatggtgctataaaaatactcatttcagatttcaaaccaactagaatgatgtagtactatagagtttttggattcagttatactttgagtcaaattttatcttttacagcaaccatatacatccacactgagatcaaactcacttaacctattaagagtaataaaactgattaaaatttccaacccataagactaatattataaagttgttatacattaaggaaaagggcttccaactttcacaaactcttattactaaaatgtttttcttccaacctcctgtattgcctcaaaatggaatayatttcatctgaatttagtagrtaaaagtaaatttggagttatagaaaatacttaatatatcaccttttagttacagtgagaatatatgactttaggagtttataccatgtgaatggggtgaattaactctttccaccaggaggctttggcaagaggtaagagctaccaagaatgtaccagggctcaggcttggggaagagaggggcctctccagctcttcattatagagctcatactttctagatatgctgtctgattctcaggtggttcaggtcggtgaattccttagtagaatattaatatactagaaagagtcactgcagggtcaccctgtccttgtaatagacttgcaacccttaaaataggttagaggggagtaaattttcattagagtgaaagaaggcccaacttgtgattggctcagatcctaggtggtatcacagatatgcatcatgttttgagcaactgagatgagaatccaaggactctaactgaatggaatggtgtcatctgtactcctcctccctggctagctcttccacttagaaggcctgacaccctcatcttagattttcttcatgtatgtcattgcagccaagtttagaaacaggagatttgctatgaaaataagtccatgaatctgctgtctcatccccactgatgtaacatacctgtattgtgtttcaagatacagtcatcaaaattagggaaaagtcctcttttgaaagaaaaatcaactgccaaatggtatactgattctttggattctacctacgaaatcagttagctcattttttgattattctcttttgctaaatgcataatttgtatttcttgcagcaattaatacctgaaagttatttgtaagctcatttcaaatgtgataaactgaggttcatagaggtgaaatcacttgcttttttttttcaggagcatcatcttttttttttttttttgagatgaagtctcactctgtcacccaggctggagtgcagtggcacgatctcggcttactgcaacttctgcctcccaggttcaagcaattctcctgcctcagcctcctgagtagctgggactacaggtgtgcacctctatgcccagctaattttttttaatgtayttttagtagagatggggtttcaccatattggccaggctgctcttgaactcctgaattgaggtgatccgcctgacttggcctcccaaagtgctgggatttcaagtgtgagccaccgtgcctggcttagcatcatctttttatgactgtatttccaggccctaccatatattcaattcagagtaaacacttggttatatttgtggagtagtggaatatatgaatgattgaataaataatatagatgaaaagattagttcctgtatctccagggatcactatctttctataccaccaaagaatttgccctaaaaccattcactgtaaaaacataattatgattatatcttgtcttaatcttatgtcattatttcattccttatgttaaaaataataaaaataatgttaattctatgatttctcctatttctaaattgcataaacatatgtaagaagctactgaaataaagcaatagcattttaatacattcccttgtcaccatttatttgataccctcttgccttggcttggaatttgcaatattcagaattgcatttgttgttgaatattcctatctggatattactagattgggatttctgacccacctagtccaaagacagaatttctttattaagaagccaacaactaaacaggctacagtaatactccttggaactcaaggatgcgtacaagagggtggcttccttcaatctgtcaacagcctctgtcacctccatttatcctttttctgccagtcctattctcaaatactccagagctacaagatgattaagagccatcatgagacttttgaggattgttgtgagctgggttgttatttttatttttatttttattaatcagaccaactcaatagcaccctagttacagaaatcctatgatttggcctcataagatcaatgttgaaatcttgcttctgtcattaatgcaacctggcttttggcaaatcactcaacctctctgagcttcagtttcttaatacacaaaaagaggggaatgtctgctgtcctgcctcacctcctcaaattattgaatagctcaatatcattactgttattattattattatattttaaaatgtttgtaagcagaaagcactgcagagctgtaggttgcttctccctctttctcacttagttttcttacatatcaaattccatcctggggtaaagtaattgctcacaatttctttttataagagatatccttcaacaccagcaatttcatctttctctttttttaactcttgcatatatagcatatataaccatatttgaatgggagcaagtcttttcatttcttttctacttggacctataagttctagctgaagtccttcaagaagttagatctggagctctgtggccaggacttttctccttactcagactttccagtcattccccaaatcctttccagcccattgctattgtagaaaagtcttctccccaaatttgcctctcaggagatgcagttatgcagactaatatgtggctgtcttctaagctcatcctcatatcactttgtactagccctttctagttttaggmctaagatgtaaaaattgaattaatatgaatagtggttactactttggatttggaagcctgtggaaatgtgggcacatttctctgccttcccaagctttcttctccttattttcagaatgatgatagtaatggtatttaattatagagttgctggcaaattaaatgagagtaacacatggtyagtacacaatatagttattatttataaggggaaaaattactggttttcaattgctggtacatgtgaaatcagaatttcttttgacatctgtcttatctatgtttatttcccattattttttgtattttttctatattgtctctgaagccacctctgtgttttgcttttctgggagtggaagtggaggctcggttgtgaataagtacaattttgytttacttctggtacataaaattccaagacaacttagtataacaaaattcacattgaactaaaagttatgaaaagctgcttttactgtttactcactcctttaaatcaaaagaactgratgtaaactatttttttatgtcatctcctgttcttcaggctcttcggtgcctcagaaaacataaaagagtctgatttacaatcattttgggcaaattgcctgtagaattctaaggacaggaaatgaaaaaagaagtacagcacacacccccagacattccacacaacatgtagaataaataaacagccccaaaaaggaaaccaaaactgcttggtcttatgttgaggagggggtaccacaaatggcttttggagaaaatgtattaaagatgatgacatgctagaaaaatccttcaggggggtgaaattgaccctgattaaagatgatccttttccccttttctctacagcatagtgagtattttttatttagataacttccattacctgtattgacattatgaaaaagaaataccacgttacagagctgtgctttccaaaccttaataggcagggctgccctggggatctcgtggaagcgtaggtagtgattcagggaatgtggatagggcctgaggttctgcattattcacaagctcccaggtgatacagatgctgctggtttatgagccgtggttggttttcggtcatcttcttcaacaaaataattggtggtgatgttcttgtcttcatctgttcaagagtggttttcaactggggacaattttggcctcatgggaatttggctgtgtctggagatttttgattatgacaactcatgaagtgctattggcttcatgtgggtaggggacaaggatgctgctaaacactctatagtataaaggatagccccttataacaagaattttctgacccaaatgtgaatagttccaaagttgagaaaccctgctgcagaagtattattttatgcatttcttgtatcaaaaaatactttcttgaaattgttcaaaaaataaatacacaaaacctgtgagagcaaagaataggagcatctactacagtcatgcatcacctagcactagggatgtgttctgcaaactgtgtccttaggtgattttatcattgtgcgaatatcatagagtatatttacacaaatctagatggtagagctacacatctaggctgtatatcgcctatgtcttctaggctacagacctctacaagtggttactatactgtatactgtaggtcacggaarcacaatggcggccgggcgcagtgactcacacctgtaatcccagcacttctggaggccaaggcaggtagatcatttaaggccagcagtttgagaccagcctggccaacatggcgaaactcagtctccactaaaaatataaaaaaattagccaaacgtggtgtcaggcacctgtaatctcagctactcaagaggctgaggcatgagaatagcttgaagccgggagacagaggttgcagtgaacagagattgtaccactgcacaccagcctgcacaacagagtgaggctcagccttaaaaaagaaaaaaaaagtaaagcattagtgtgtctaaacatatctaaacatagaaaaggtacactaaagctattgtattataatcttatgacaccaccattgtatatgcagtttgtcattaaccgaaacatcattatgcagtgcatgactatttagtttagagagtaagcagcatttaaaactgtcttcaaatatgtgaaagactattatgcagaagatggtaaccagctgttctctatcacgctggaagaatgaacaggaaatgtacataaaaggacccgtgcaattcacccattctttttctgctwccttcatgccagctagacaaatctcttcatgatcttgcaaccatatttgtcctggcctgtgtcttaatacttgcagagaccctcccaaatcctgggtacacattttcttttcactgccaaatctcatctctttctccctttaaaaatcttaattgaaaatttctatctccataaaatcttccttaactaagatgaaatagttgccagttcatctttaactagagctggcatacttcttccttcaacatgttatctgtcagtctgaaaatatgttactgcccatctgtgtacaaggagttgtgctagattttgataaaggattaaaaaaaggtaagtaagagagtcattrtttttaggaattttccaatttggggggaaaaatctgacacagataactatatagtatttaataattatctccatgagaggtttcttaaaaaataagaaaggaggttttagaagtttaaagattacttctaggtagggaggtcaagaaagactttacaaatagatatatgggtgtatctttttttttgtttctttgatgaatttattcttcaaggaaaaagcagttactattgtcgccaaaatttaaagattataaattagagtagtgtggatttaaagtatatttatgaaaaaagttcatagtgagcaagggttaaaatattagagtgatttaatccactcacaatttataagactaggaaagataatttttcaggatctatgtggctatatggtggttttaacaaagaagactgaatttagccacctctgaatgtacctgatgaggctctgtaattttataagacagtgctctttggaaataattttgtttgtttgtttgtttggtttgtttgagacagtctttctctgttgcccaggctggagtgcagtggcamaatcttggctcactgcaacctctgtctcccaggttcaagcggtgcccctgcctcagcctcccgattagctgggactacaggggcatgccaccacacctggctaatatttgtatatttttagtagagatgggatttcatcctgttgaccaggttagcctcaaactcctgacctcaggtgatccacccacctctcaaagtgctgggattacaggcatgagccatcatggccccctggaaagaattcttagttacatctaggagaagaatattttggaacttcacaagcatactttaaaaaccagtaccaaagcaggaatttggcaccatccatttgagatggtgattctagaacttctttaggagacagtcttacttactaagagtttccacaacctgtactatgagaaaattaaaaagaattaaccctcatcaaatatgtagtatgtgccaggcactgggtagaccctttagatatatcatgtgatttaatctggataacaactggtgaatttatcaacaccaacattataaggaggcttcagagaattagtataaatttccatccaattaaggaagggaaacagagcaaatctcaggcctgcataggaagccatctctgagtggagaccatcagcttgccttttccttttgaagcagcaaggacaacatctatttttataaagctttacatggtgatatgtgcattctctgtagttgaaatgggaaaatgagctgttcagagttcattgatggccatggttttctgcagggctcactgctggaaaactatctgcaactgtattagtcatatatgaatctgagtttctgcctgctcttttccacacattctgaaaacctcagctctaggaatggtacagatattaaattagtatggaatttttttgaatgttaatatttgtgttctttaaagtcattatggttttttattttttattgtattattattatttttttattacactttaagttctagggtacatgtgcacaatgtgcaagtttgttacatatgtatacatgtgccatgttggtgtgcggcacccattaactagtcatttacattaggtatatctcctaatgctttccctcccccctccccccaccacacaacaggctgcggtgtgtgatgttccccttcctgtgtccaggtgttctcattgttcaattcccacctatgagtgagaacatgcggtgtttggttttttgtccttgagatagtttgctgagaacgatggtttccagcttcatccatgtccctacaaaggacatgaactcatccttttttatggctgcatagtattccatggtgtatatgtactacattttcttaatccagtctatcgttgatggacatttgggttggttccaagtctttgctattgtgaacagtgccacaatagacatacgtgtgcatgtgtctttatagcagcatgatttataatcctttgcatatatacccagtaatgggatggctgggtcaaatggtatttctagttctagatccttgaggaatcgccacactgtcttccacaatggttgaactagtttatttggtttacagttagtaatacagttaagagtggagaccttccttgagttttcattctttgagcttctttttttttaatagaaacagctttcgatggtaaccttaaccatgccttccataactcaaaacatgatggactcttagttaactctatgtaactggattttgtttttctcctaaagttgttctacgctgctgcgtatcattcaatgttgatgtgaaaaattcaatgactttcagcggcccggtggaagacatgtttggatatactgttcaacaatatgaaaatgaagaaggaaaatggtaagccagtgggttttgttgttgttatttacttatttcacaaggtaatgagaaatattatttgactacagtttcttttatgaatgaaactttaacagaatgaattatttatggtagaaaatgcagtctagtcatttggcaatggaagctaacttaaagtaaaaaaaaaaaaattccttggcaatattagaggaagcgattagtgatttctgttgatgcctggattgacctcaaggaaggtctgtatccaaaaaagctattgttccataattatgttttttggcaagaattctttaattgttctcatttcagagtagcttaaatgcacttgtttgaaattcagtaggaaggattcggaggcaaatgagatggtgctctgaaagggtttaacacacttccgtgagtttggtctttactgatctactgagcttggtctaatgtttataatgaactttattgggtttctggtatctaccttcaaaccctttaatattggttaagttcattgtagataggattttttttttttttttctgagatggagtcttgctctgtcacccaggctggagtacagtggagcgatctcagctcactgcaacctccgcctcctgggttcaagtgattctcctgcctcagcctcctagtagctgggattacaggcgtgtaccaccatgcccggctaatttttgtatttctagtagagacacggtttcaccatgttggtcaggctggtcttgaatttttgacctcgtgatccacccacctcagcctccgaaagtgctgggattacaggcgtgagccatagcacctggccgtagatatgatttttaaagtatatttaacttgttgaaaattatataaactgaatattagagttcttttgcttaatatttaatagaatttttagtaaatgcaatttttgtttaattggacattctaggaaagaagagcagtagctaaactttagtttaataacttaaactaaacaagcctacatttttagtagctgtaataataagcaaaaagagatttatatctacttggataataaagatctatgaatcactataattatttcattaataaaaatatgtggattttctgcattttgttttatcttttagacttggttaatttgataataatgccctaaagactataaaaagtaatgagttctcacattttttaagtacattattttatgctaggtataaactagaatttgttgagatacttcactcttttattctccttacaaatatctcagatgacaaacccaatgctacatgctaaatttttaagttccctttccctccctcctatactctccacccatcccattccccaatttttaaggttaaatgagtacagccctccctctagacaccagctttattcttttaggaattataccttcaattcaggtacctctgggagaataatggtgagtagaccaactggtcagactttgtgcgtaagctataataaacagaaatgcagtacatgttattcttaaaaagcttaactttacataaacacatataaaagttaattttcactaattactaatagttacacaaattttaaagaggagtatagcaaatagcaagctttaagacttaaaccacctacttaaaatgaagtatctcttttaaggatggttaaatattgctaaaatattttatgaaattctcattttcaatttctgatatsagaaaaacctgtatgttttctttcttatccwgtcctgtctctgtgattttagaaaaatctgatgtcagaagtccttaattatatgaatgaaccttagtagagtgaaaaggggttcatatttctttttagaagccttagtgcccccatttgatctctttagtcactgtttctcatgataagaacctatcctattgtgagatttccaccctctaaattctacagtccctcctttcaaggcaccagaagtcaaagcaatggaaaattgaaaaatcaggcctgaatgaagccttgatgtcatgaggaatgtccttcctaaggttattctatctttgtagaaagttaaggtatggatgaggaaaaagaaagacagccaacactggttaaggaacaaaagagtgcatagattggatagtaagaataaggttgcaagaacgatgttgctaatggtctgtctgaatgaatctacactggactgaaccatcacaattctacatacatttgtgaggtaatgttaataagagatcggggactatgccttatatcttggtttacccatgaagctgagttgaattgtctctgaaaatatttgttggtgggttaggttttttttatttagccatagcataaatgtgggtcagtcaatcaacatgtatttatgtaatacattttatgtgtctggcattatgctaaattccatgggaaatatttatacataaaacaaatataaaagctttaacctagtcaaggacatacatgaaatgtttaggaatagagaatagtgccaacaaccagtgcagaatagactataaattcaatgggaattcaaaacaggaggagatgattcttggttcttgacctaagtcttgaaagatgacttaactttcaatatgagaagaaaaatgtcactccaagcttgggaagccacaagagcaagggcccagacttgagaataagtgaggtgagtgtgttggtaagtaaacaggtctcatattgggatgaaaaaagagaaaaggatgatggcagatcttgaaagacaaacacaggagcttggacctaagatgaggacgttgagaagccatcataagttgtcattttatgaaacttaatttgggaatttacatataaattggattggagaatggagttcctgaaaactaggaaatatatagactcaagaactataatctggtacttaagggatgagccttcaggctgtattaggggcaactggaagaaaaaagaaaggtgtattcaagacaaatcaagatgaatcagtaaatcttggtggaagtttggaaatggtcaatgaaggtgtaggagaggtcagatagattccaaaatttctgtactggctcattgggaaatgggttgtcattgacagagaaagggaaattcacttatcaggaagtgggtaagtctatttttaaatagctccagttcaaggtgatttctaggtagttggaaacctcagactggaatgcaggtaagagggagaagttaatgtgttagtggaaatgcctagaaaacaaagactgattttgcagcccacttgcaaccctgggcactaccccacatctagcatgaggccttatacataatatgcactcaatcattatttgttggctgaacaactaaatctagtttaacactctgttatcatcaattaaaaaaaagctgcataaaaaataaagttaaatgtgactctcctagggaaatgcaactacttaggaccagagctgtaatagatttcatctctacactcagtcttgtgcctttttcttcattagaactatatttaaaagtaaatgttgttaaaaactatctttgtggtaggtaccagactttacatattaatatgtgtgtaagtttgtaagcatttgaatgtagatgatatcagaaacctaaatctcacgttgacatttattatttacaatgattttatggaaaagttgtgaaaaatcagagcaaccaaaaagatgtgggcaattgaatttaaaagtaagcaaattacaaatacctaaatttccaaacttttaaggatagcatggtagcagcatattgttctaaagaaatctgggatctggtagtgcaaaataacctgtagaaacatgtttggatgttctgtaagtgtctataaaaacagatagattgcagacttacttcgagaaatgtgctacagaataattgacatatttggaggaacatggattttgttatttaattatctctagaggtaggcaccttcataagtcatatttactgctcatgctttcgaatttcataaactcatatttaaaaaaatcatcctgacccatcttacgtcgtgactatagtacgcctatagaaggagcacttgttagcccatgacaagtacagtctgtgtatttgaaaaacatagctttaattctttcgaaagaaatataagttgacagaaaaggtagccttatgtcctctttactgttcagaagtttgctctgaagtgtaatttatatcttttgctcagaagccacatgctttctcagtagcagaacacatcatacatctgattaagatcagctgttgttcattatgtttagcatgagctggagcatccaagtaattgcaatgtggttcagaagaattcagaaagaatataattgccttcataattttgctttgaggaaaagaaattcaaacatgctcagcacagcacaagccttccagatttccagatttagtggtaaacatcagcatggccaggtctcagccgaacgggaaaatgtgagatgtctgtttggggctttccactctaatctgttgctgctttgcttcattccttccagcatgtgtgcctacccttttaactgcccttcaagcaacctttcttgggggtttcagtgacttcactggacctgtctgatctcaaagtagattttcaggatccacccttgccaaccttcaagccaatgtttatcaattatcttgacttcatgccttttctctagaggatcctgctttatgccaggtcagggtaccaatgggctcatgtgattgatgccctatttccaataagtctgtgttgtaaaagaaaaaagaatccctgctaatgtagagctattccagactggggaggagagacattttaagggtttacacaattttctgtaacagattttaatatgcttattttacattgcttctaacgccttttgaagttgaaatttcctcattgccaaacttgtcatttctttggctcccctcatttccacccctccaccttttatgagcaaatcactgcagttaatgggtcactgtgtaagtttcattctctaagatgaaaaaatgcttattccatttatttaaaaagaaattggcgagcagaatttgcttggcactctgagagtgactttggcttgaactatgtattagacatcaaggcagagttagttgaaaaggatgttaatgaaataatgtaaatataagacactcttttccaagaaactatcttttgcagggaagaaaacataaatatgaaacagagacatcagacaccacctactcttcaaataaatataataatgggcataataacaagataactattgtgaatagcaaatatttctgcttactaaatattattataattgtagcttattcatggagaaaagtgtttctctcactttgatgatccttgagttgatcagatgtttctccagaaatgagtaacgatatccagaacatgttttgatcttctcagtctgcatacaggtcattacaaaaatgccatataaaaagcaagatctaataggaataaaacgtaataagttaaaactaacttgcrttaaattttaaaataatgattctcacagtttataaaacaatgtgcctgggccttcaccttgaccctgtgggtttgggcggatatcattgttatcatctgtattttctagacaggaaactgagacagagaatgaatgtccaaaggtttaatatagcaagtatgtcacagggtcaggatatggaacaccagccttctgactttttagccaattctccccctttagcaacaaggattctctagctgtttgacctggagaaatgcctctggtgtcactcaaaggcatgtatagcatcccacttaagctgaatatatattctctaaaatggaaaaaaaaagattttacaatccagacctcttggctggtcacataagtataaattctcaggtctgccttattcagatttttaagtacttgacacagtcgttaattcattcattcaatagatatttattgaatgcctattttgtgcttggtactagtatgagcactaaggatgtgtttgtgaacaaaatagaaaaaccaatccctactattgtggagcttatattctactggggaatagagaacaaaaattaaataatgaagttaataaacaggtaggttacatcaaatgccagaataggatcagtgttgtgagaaaaaactgagcaagagagtggattgagaatgctggagattcctgaaattctgtaaaccctatgctaatacttttctaggatcttgttattttgatgcagttggagaaaagtgaggcttccttaggattcaagtggtaagatacacgtactttcaagcttgttattaaaagtttcatgtttgttttcaaagaaaacasatactaggaaaatacagaaaattagcagtcctatgatctgctaacctggtctttactattggtcccaactcccaaactccctgtctcaatcctgggctcctacactctaccactttctaagttctcactccgcaatcttcacttatctcagaatatgcaataggccgtggttgagattgctgtatcaggtcagtttccaattatcaccatatcctaagtgctttctcttgccctagagatcaaacataaactccagaccttttcctccagagccaaatgcttgccaaatctcaagctctctgttcctgtctataagcaagctttattctgagttctagccacccatactttctcattatcttcccttttccatcttcattctcctgtctccacacttttccctgggctatccatatctccctttccttctgccttacaattcacaatagctctcctattagcatgctgtacaagactcacttttcatcagttatcctagattttcccccacttgatattacatgttttccaactagtgagtcagttcttctctacaaacttatatttgttctattcagatgatggaatcttagaactggaaaggactttgagggcctaactcccatccactataaaaacaccttccgaaacatccctggccagctgcaacccacctcatcttgaccagaggagctgcctgacagayctacgtatgccttatcagtttaaatcttcatcgctctctacaagcccaccacccttctacctcctctgtaaatctcactagacaactgcagctattattttccaaagaagaaaaagagacagagagagagagagagagagagagagagagagaagctactaggtcaaaatttaatcctcacttcctgtttcagttaactattgctgcataataagtcattccaatacttagtcacttaaagcagcaatggtctataaattctcaagatttttgaggattgaataggtattcccctattgcctgggctcatcatctggtccctcaactggggctggagtgtccaagctggctttcctcacacgagtggaagttcatgctgtcagctaaagcaccaattctgttccacgtggcctcttatcctctgttaagcaacactgggcttcttcacatcctgatgttctcagctttcaaaaacaggtaaaatggaatctgcaaaggccttttaaggcctagccttagaagtcatagtatcatttgtgctgcattctattcatcaaaacaaatcctagattcaatgggtggaaaaacagattctacctcatgaaataataaaagtcaaagtcgtgttgcaaaagtgtacacaattccaaaccatcgaccacccttgcaaaytgctcaatactgggctgctcagcgtgctgcctagggaatggtcgctcttcctcatttttaagacaaacctctccttctggatccaccctgtctacctgctcagagattctactccctctcctgtgaaatcaggatttctcttgttactgtttctttcttgccatcatttagccatatgcagattgcctccatgataaatttggacacatctcaagcccttaatggtttgtcattgccctgaaaaaaaaaagccacatttattaacactgcccatctccctcatttttagccaagttacttgaaatgaaatctgccacaaacatgtacctctcattcttgcctcctattctttatattgtttccttctttggtttctgtgacactgctgttttctgattcttgctccctttctgattacccttgcctagttttcttcctttgctcattgaaaccttaagtgttatttcaccttcagatgtcaacatttagtgctcttctcactatatttcgaggtggtaatatttacttttagggcctcaaccatgctcatatcatgctcatacatgttccacatggtttctgagatgttccccagcaagactgagcccacttgcctacagaagtaactcattatcagtgcatcctttcttggcctttcttccttcccactcttcttttccccatctctatacttatgcatacttggaattgcctccaaaaaacttacctgaaccaaagtttttgtcttggatctacttttggagaaacccgaactaagacagcttatatcctaaatatttatagagttagtccttccatcctctgtacttcctgaatccaaatcctcatctggattactttaggaatccatatcttgtcatttgactctaattttgttcctcttcaatttacttatgacacttcaagcaaataagctttgtaaatcaaaaaggtgatcatgttacacccctctttaatagcttcrttggttcccaacttccccctacatagaataaagccaaagttcttaaagctgactatgagaacattcatgatctggactctttttacctctctagcctcaacttctactgcagttatactgagctacttggcatttatcaaaggagtggtattcttacttctaagactttgctgaagttgcatcaagttcagacctattcaatattgcaatagtacatgtmtagttgtgcttctctctctaagttataagcaaactaaaaattgtgttttattcacttttgtatcattttatatcctcaggacctggcataaatgcccagcatgtaaaatattgttaataaacattaattactccagcctcaaattaaatactttctaaaatcgtaggctcatttttttctctaaactgtttttaactgtaaaaccaatttattccattacgtattttacaactgaaaatattaggaaaaaataatcgtaacctcattaatataatttgttatattcttgatgtattcctgattaatctttcaacatcgatgttagttgtttattcatctgaaataaatacctaataataataagaactaacatttagatagcacatactataagccaaatactgttctaagcattttatatacattaacttatttatttttttgatgatcctctgaaatggatctccattttatagataaaaaaactaaatcacagatggagtaattgacttgtcctaaccatatagctaagtgaatggtaaagccataatttgaactcatataggctggcaccaaagttcatgctatatttcatggagaagattaaattatttaatacacagaaagcacttagaacagggcctagcacatggtataaattcaataaagcctagctgccattatcagtggtagtataatgaacatagtaatttggtgtctttcmtgttaaattagggcacagattttcactaaattagataaattttcactttgagttcgatcataaataatttttcatcctaccatacaatgaatgtacaatatgctatagaatgatcctgaaataattagtttttatttaccatatttcttttactctttcataattatatataacactatgagcattatctttgtgcattaagcttttccctcttactttaggtcattttatttaggatagattcccagaagtaaaaattatgtattaaagggtttgagcatttttgtagttctttatacaaatcagaaattgctttccaaaggcattatattaaaaccatgttttagagtctcaatagcttaatatttacaattgttttataaaatttattttcattaatactagcatgcctatagggcctacacaaaataaatcccatttcttttcaatatgacagactttcaaatatttaaattttcaaaatgtgtgcctaatcaatttgtacttcaatgcaacttctcagttctcctgcagacattctttctccatgccgaacatccccaactttcccagcatcttttgtctgacaaatttaccagactcctaactatctgagtcatagtctcctaaatacattccattgtgcatatgtccctcttaatttagatatttcagacatggcctgaccagcacagaacacagggggactatcactgcttgaccagggcatctatttccagcactgcagactaaagtcacattagcatttttggcactaaaatacgctgttgctcatgtttatgtgctatcatctaaatcccccatgcctttttcacatgaactcccattaagtgagggctcccacatcctgcactgatataaataatagtatgcagctgagcgaagttatttatgtaggttctaagtaaactttagtttatttatgtttattgttccagaatgttgagattcatctgaattcctaagtatgtatattgatatacttgataagtatttttttcttgctctgtcttatggtgctgattgataactatatttatactttttatatcttgactaaagtcattaataaagttgtcatctggctgggcgtggtggctcatgcctgtaatcccagcactttgggaggccaaggtgggcggatcacgtggtcaagagaccgagactatcctggccaacatggtgaaaccctgtctttactaaaaatacaaaaattagtcgggcgtggtggcgtgcacctgtagtcccagctacttgggaggctgaggcaggagaatcgcttggacccaggaggcggaggttgcagtgggccaaggtcatgccactgcactccagtctggcaacagagcragactccgtctcaaaaaataaaaayaaaaaaakaaaataaaaaaataaagttgtaatctaacacaatcccaagtacaaaatctcatactatgtaattaagtcctttgattgctagcagccagagtttttggatatggctactcagccagcaataaatcagcaactgtggatccacccaagtatcttactatttactttagttcatccgattcctgaagatatcatgggagacttaaatgacttgttggaactaaaatcagttgtgattatatgttttttccattaattactgttagaatggttttataattctgtctaaaaggaaagtaagtgattttaacctggatctcataaactatccttattttctaagcacttataaactagcacatgctaatattaaatcttatgatgttccaatgtttatatttcctgacttctctataaaattagcagttcatcataggaaaaagtcacttatacttccacatgtgttttataagttaatacagtagcagacttagccaataattattgattatttcagtaccccaataaaaaatatgataaagtaatataaacaaaataataaagcaaaatctctgaaatatctatcctacatatacacacacatatacatgtatatacacacatatatatgtatatacacacatgtatatgctatatatgtatattgtatatgtatgtgtgtgtgtgtatatatactttttaatccacatcaatatgcaagaggtaggctctctgcttagtttacataacattaaattactaatagcatgattattatctgattatgagtgttattgtcaattatcttaaaatcagtcataaaacaactcatataaactgtttctcaatgttcaaaaatgtttactgatttatttaacttccagggtgcttattggttctccgttagttggccaacccaaaaacagaactggagatgtctataagtgtccagttgggagaggtgaatcattaccttgygtaaagttggatctaccaggtatgtaaaattaaaaaaatctggttttaggccaggtgcggtgagtcacgcctgtaatccccacactttaagaggtcaagacaggcatatcgtttgagcccaggagtttgagaccagcctgggcaacctgacgaaacctcatctctacaaaatatacaaaaatagctggatggggtggtgcactactgtagtcccagctactcaagaggatgaagtgtgaggatcgcttgagctcaggagtttgagactgcagtgaatggtaattgcgccactgcactccagcctgggtgacagagtgagaccctgtctcaaaaaaaaaaaaaaaaaaaatcaggtcttaaattatgcccagtattctcactgaaaacagattttgggctgggcgcagtgtctcacacctgtaatcccagcactttgggaggccgaggcaggcggatcacctgaggtcgggagttcgagaccagcctgaccaacatggagaaaccctgcctctactaaaaatacaaaattaagctgggcatagtggtacatgcctgtaatcccagctacttaggaggctgaggcaggagacctgcttgaacctgggaggcagaggttgtgttaaggcaacatcacgccattgcactccagcctgaggaacaagagcaaaactccatctcaaaaaaaaaaaaaaaaagaaaagaaaaaaaacagattttaatcaactcaagaaaatattagaagtaatctgtgtgtcagaatggtcgagcggtctaaggcgctgagttcaagaagtaatctataatcatttttcatataatcatttataatctataatcatttttctataatcatttatcttccagattgacatagaatgccattttgattccctctgtccttaatttgctttagaaagtcatcaaggagcatacataaattagaataccgtactaattttataacttttaactctctgcatttttcagaattctttctaattcagtggtaatgtgaaagaacttctccaaataaacctgcccaccacattccctccacaaaatttaacttagtgcctggttttcaagaggaaatagaatcagaggaaytgtaatagataaatttaattttaaaaatagaatcacacaagataaatttatattgaaatagatgtatttgacataaatagtaggaatgtgaccggaaaattcctactaaaattatctagaaattagaaccctgtcaatgttctatacaatattacatactatggaaattatttatagccccacaagtttatttcacatattgtatttttcagttctcctttttttgaattttctatttgtttgtttttatgaactttttttctttacatgcataagcatacttataatagctgctttaatatccttgcctgataattccaacatctggaatatctcaacatcactttccatttattacctttccttgaggttgcatcacattttcctgtcttgtcttgtaattttggatcataacctggattatatttttgaattacaggtgtggagattctagattctgttatatgcctgtgaatagtcttaactttttttattagcaggaaatttacttggctcaactcaatttccaagcattgactttcttgcaatgacaagtagttaaaatctctattcaggttttatttcagctgggctatttgaaatatactctgcgcatttaytattcaagtcatctagttatttggataaaatatatatgcatattatagaactgttgttttgtggctctttttctaagatatactactctcctcctcattttgcagctgctgtcattgccctcaatctctgttctctttttattcagtacagtaagactaggagttctatttgagttttagccactgaccagggccttccctaggttgggggtgggttaggggtgggggacaaaaacaaaacaaaacacaaaagcacaaaactcatttagtgccagtatcttcttccaagtatggattcccctccattttctgccacctttctagtgccttcaggtgattgtttcatgtattttttttaattcttcctagaatttatagttgtgatttgcagaggagctgttttgttaggagttactcctcccttactggaaattggaatagttttaaaattaggctagagattttagccacatcaagtacagtagggaagtttccactgtagtccctaattgtcccaggaatgctttttctgggtcaagctttgtatataaaactctaatccagattatacaagatcaatgcatacaatcgcccagctctaggtgctttcaaagcaaaccagactaaactcttggacaaaggccattgcgcagatcaggaagtctaactgaccattccagaatctctgcttccattccccactttaaatccacatacagtcttaacatgaaaacaacctctggaacaaacrgtgagacaaatctttctcaacctgaattttgcctctttctaatattccactctactaagcagatttagaagttcttgtttttcctgtccagtctttttttcttttttagtgtgagaaagtgaaacttcttgccaatattgttaggctggcatgcttcatgcttcaggacccaacattcccttcagaatgtcaaatgyagtctctttactgtgtttcctttatcaaaactttctggacactgctctaatattcctctagtttcctttgtcacccaaaggatgtcctcatgattttggaagtcatggtcaaaaaactggtgtttgagttttcttttctgatcttctacccatttccccttttcttgccaaaaatcgtgtttcatcactggtcatttataacaaagttataagattacattatatctacagtattatgagattaaaaactttgctttaattagcaagaacgtgcaaaaagcaatcccacattctcattgccctgctagttctgcattctttcacagttcagcaaaactatctgaaatagtttctgggacatgagccaactcttcagccttagcttgttcattatattccttaagaagacttggaagactaattagttgaaccaaaagaagaatgtgctatgatatgagcaaaacaaatagaatgtcttaatgagagatgcttaaaatttcactttgtgaaacttttcctccctcataaaattttgttctatttttagttaatacatcaattcccaatgtcacagaagtaaaggagaacatgacatttggatcaactttagtcaccaacccaaatggaggatttctggtaagaatggagagaatgatatttattgacaacagatatgctatcattttaagtctttgtaagatctgttatataattttcagtctaatgatttctaattttaaaacaattttttaaaggcttgtgggcccttatatgcctatagatgtggacatttgcattacacaactggaatctgttctgacgtcagccccacatttcaagtcgtgaattccattgcccctgtacaaggtacagattttatgcaatgttcttgcatgtttgaaaagcctatgcaatgaatgagacgtatgtatacaaaggaacataccaaaaagcttaaagtattttcttagctaccagcattaccaatttaggtaaatgtttgctttgccagtatataacaaaatctgactgctatttttggaattgatattagtgtaaataactttacaaagtcatttttaaacatcatagataaagctgtcatgckgcttatatttaaagaatgagtctctttgaagaaagaagtaacttcatttgagatatgctcaaaaactgttttataaaaacttatataaaattcatattgagaaaatttgcaaagataactctcatacaatactaattaaaattcagtaggtatgaattttatcccacaccaattgttattgaaagcaatgaatatttttatcatctttactttttcgaaaactattttttattgctaaaacaatgtgtctactttggagaacatcagttcatcttttaaaatgaacttctttcagccatgaaagcacttcatatgcctctgaaaaaaatagattccaaatttgacaattgactccttttattgcagaatgcagcactcaactggacatagtcatagtgctggatggttccaacagtatttacccatgggacagtgttacagcttttttaaatgaccttcttgaaagaatggatattggtcctaaacagacacaggtatgtgactttgtgttttgatttctgttgttctaaagataaaaatgcacaaatttttaataaaaccaaatattctgaaagcaaattaatcaataaaactaaagttgagaatgaattttatatccatttcctgttcttatttctgataaaaaggacattactttaagctgtgttattttctatttttttcttttttcttttttctttttcttttttagacagagtctcactctgttgcccaggctggagtgcagtggtgcaatctcagctcactgcaaccttcacctcccaggctcaagcaattcatatttctcagcctctccagaagctggaattacaggcatgcgccatcacacctggctaattttttaaatttgtaatagagatggggtttcatcatgttggccaggctggtctcaaactcctagcctctggttgatacacctgtctctgcctctcaaagcattggtattacaggcgtgagccactgtgcccaacctaggctgtgttattttctaaacagaaaatattatgaaagctgccatttttaatgcacttgaaaaataactcctatagagttctataaactcatagtttaatttttacttaaaatggatatagccacttttggtaatgtcagagccgggtgtcagagtttgtaaaaactaatctgacatcccaaacaacccatcacattataatctctcctctcatattatacaaataagttagtaactgaccagaggatactacttaaagcctgttgtcctttctgttaataatttcttttccctaagttaaaagaaaatgcccctggctatctctgcataaaatcaaatagttgtttgtttatccccccaattaatatctatttctaaacacatctcctttattgccactaaatgaagtggaacttctcacacagcttttccactttagatactgagtttaatttaattacatttaattaaatacatttgactgatttaatgtttattaaactcatatgggcatatatattaaaatacagggcagacataatggataacaggcaaataaaatgtcaaaatgaagtcaatgcctcaggtcaggaattagccctagaatcagagcctaaaagattgttgtgtggtttggaggctgtagagagcataggagactttaagattatagtactgcaatcaatacagtgatcttccttttttttttttttttctgaggrctttactttgggagaagtttctgaggcactgaaaaagcagactgactgcgttaatgtttgccacacctacattaaatttggaacataatatgtgcacatatatatacatacatgtgtcttcatgtgtctgtgtatatttatgtctctcttaatattttgatatctatgtatatataattttctaaaaggatggtggttgaaaatttcaaagttgaackcaaacttcaaagtraaatgtattgctgcattccaaggctgaataggtctctgtagagagtgagtggaagggtaaggttataaatatcctgctggacaatagagaacttgttgaaatcagtgtaaaatcattaaaaatgaaatgggcttttacgtatcacaaaatgtaattttccctggaagtgacttatttgcaattgaccttctcaagtgaaattactagtggatggtaggggacctttttatcccgtcttgctacaggstacagggcagcctgcatcttaacagaccaactccaggatgtgacttgytcttccttctggcacctgttcctcatggacctccttttttcccttctgagaccactcttccttcctcctttcctcgcttcccctatcccttctctccttggccaataagatagcatagagtcataagattaaagctggaaagaatcttaaaggtcatttggcccccaacctcaatttatgaaggagacacgagaggctaactgatttgtttaaggtctttctgcttgctgatggcagattagaacacacacagctctctaattgtagcccagtttgytgttgttttttttctttctgagggctctacttctagagaagcttcagagccagtaccatctaatgcccctgaatagtagatttcaatccttttctatttcatgaggatgactgtcctcatccttcctcaggcagcctcttggctgaaaccgtgctaggcttggcaatgactcactgcctggactaataccttaaatgaaatggcttgtgttcccgctttctccacttttgcccatgatgtgcgttctttccttcttcttgttttgtccatcccatttgatcttcttacctaactttttccttccaaagctaataacatgcttgaaatattttttacaatttattatacagccatctaaatattttattttacctttaaattcacttatgtatattactcttaaaaattaatttatttgtagctatttgtgaaaattagtgcagctgtgacatgtctgaagttggtccacaactttagaaagaaaatccatacggctcttttagaacaataattacagcttctgtgaagatctatgccagtgactccattttgtaaagaaataaataacagtcaattgcttatatgctcaagctattcttctgcaatttcgatgtttttcagttagaactataattaatttacatttctgtgttgagagtcctaaaagaggagctattctgcctgtccaccagaggaattctagcctgccagagtgggcaacatgaagttatatgtattttctggagggaacaatggctctattcagacaaattcaggagggcccttggggtccagatgctaccagtgaatgggaggaaaatgaacttaccctgcagcagaagagttcagttacatttaccaagatccaggacctcaatccacagagaagaatatttctgaatgaagcaccctgcacagtgtcgtttacattatcttctgacttcacccaagggaacctgatttttaaagagagaagctgattatatttctgaatttttatgtcacatcttgctttcatcattgattgtggagcttaaccatatacattcattcatttattcagatgtatgtactaagggcttactatgttccaagctctatgctatagcttgggtaatagtggggaagatgacagacaagggtgatgccttaatggtgcttctgtctaatgccatgtttctccaattatggctcatggaatttctgcttccaaatcactgggatgcttgaactataccccagattttcaaaatcagaatctctgagggtggggctataagcctgcattatatataagcaacccatatgattcttttctgtttgtttgtttttttgacaaggagtttcactcttgctacccaggctggagtgcaatggtacgatcttggctcactgcagcctccaccttctgggttcaagcaattctcgtgcctcagccttctgagtagctgggattacaggcatgtgctaccatgcccaactaatttttgtatttttagtagagatagggtttcgccatgttggccaggctggtcttgaactcccgaccacagatgatccgcctgcctcggcctcccaaggtgctgggattacaggcttgagccactgtgcctggccccatatgattcttaaacagattaaagtttgagaaacactggactaaggcataattattatattagtgtgcgtgagtgtgtgtctgtctatctgtgtttgctgcatactgtarataataggcacctcaagagcaaagtctgcatcatcttcttatcttcgtcagtggccagcccagtggtttactgtggcacagtaagtcctcaatgagcacttgttgagtaaatgtttgtatcatattgagtccagttttgtatttttctctgattattggacatttaatgagtcttttttctataactggtattttaaaaattattttaagtatattactttatactttattctctagtattcagtcttttctaatctttttttttctattttggcttatgttttatcagtgactaaattcataaataattctctaaaatgaagagattggaaaggacatatttaccaagccattgcttttgctaaataacatttaatagggttttaagtataatgcatgtgaactctttttaaagtttgatcatctttcagtggattcagaaaagaaatcctgtcatagaaaatttggaaagacatttccttttcaaagaaaatatgtgctgaaaagcatgcttatctttcatgtagtcttacagtaattctttccaaaaactgtttacttgacaatcaattctttttcttgattggttgctaatgtaatttaaatccatttgatttgtttgtttgtttgtttttagttttatttgtttcttttaatgaaagcattcaattccaccctatgattggcagaattarcttctggaatttattctcccctttatgtattctatctctgtttctgaaaggaacagatgtaaaaatgaattgtgagaaagattacccagaggagggtgcaaaagatagaaagctaagagctggacagagaacttttagactcctcatccataccaaatttctaaaagactatgaatgtagttgtaagatttgtagagaggatttctctgtagaaagagcctactcagaaaggcttcagtggggtcatacacatcttagtatgtgtatactggagttgggacacatagttgattgactaatgcctaactcctgtctgaattgtcagagcatgacagcagctgttatgtctagctgctgacagggaagtcggagcagaggtcactgcactggagtcagcctgcatccccagagattgttagaatgcatgtgttttcccaggattggcatgggtactcaaaagcaagagccagtgtgaggtcatgtcagggcctgtccttagggattactggaagtgagtggctgcctctgcagagaatgcagaagatctctgtaattcttaggaactgaggcagtgggatgcattcactcagggcaagggtgtaggtgagatatctcaatgaagggagttctmcaaagaacccttgaaaaacttgtacatacctattaggacctgattcatcttaggataataccaatgcagtaataatttctctatccttatttatcttccctacctctgtccctggaaggtcagaaatcacagttagcactctaagtgaaaacaagtaggaaaacaaataaaagccagtcatgcatctttctcaactacaggcttcttacctcgtgtaagcccttagtagaagtaggagagaagatttaactacaaatgcgctttgatgtttcgccttgttggttttaatttagacagaaccatatgaaagtattgctgtttgatcttttttttcccaacctacaaatacagcaatttcatttggtacagcctaaattaaaatatataactttttaaattaacagacattttaaaactaagaataaaaaaaagtcataagatatttatctttccatctagggatagcaaaatacttcactttaaataaattttgaaggactggtgggccacaaataaaggttatattctaattacacctcctgtatttttgtttgctgtattgattagttacacatttggtacaatagatatagattgaatatgattcctattctctgcagtcatagatttgtcatttagtaattgcaagcaataaaaggcagagtcaaagatatggaatatttcccaaagtaactgttacctccaaaaaacaaaaataaaaaaaaagaaaaggaaagggggaaggaaggaaggaaggaaacttacattaagttttccatgtgacaatttagtatacattagggaaatacaacacaacgatggaaacattcactctaaagagttactcaaaatccattctatgtttctgtgtggcccaattaagacttttgcaagcatagtcaaggaatttttgtcaaccaattttttacccaagacagagtaaaggctataaaattgccttttaaaaatcacctataaaaacaaacctgaaacactctgagcttgccattaaagatatgatggtgtaaacattatggaggtcttattgatcctcaatacctaaacataacattgcttttaataataaatgaagataatataaatatgtcaaataagtgtgcattaccctaaataaaaccagtaaattgtgaggcttgatataaaagtgaaatatactaacggaacaatgtctagattgttcacatcaaaagtgtagcatagcattaaaccaagcaaaatgaaacagagaaattaattaaattttaggaatattatttatctttctttttactgctgattttatggccatttccctagaagccttaaatctggggcctgattcattgtttgtaggtctgaaaagaagcctgagggagacatgcagccatacctttgtcagtctgcttacagtttccgaatgtggggtagggaatggggtgaatcttctctctcactagcctctagtctccattctcccacccctccagccatcaggcactagaataatcattccgaagtgagttcagaacatttccctaataacaaacaaaaaagaaacaaataactcttcttgttgcctgctaaataatatccaagctctctagtggactaactggcatctgaccacctggcccagccatttctcatgcatcctgcttccccttacacccgyctcagtcaattttttttttttttttttgtgggtggaggagatggagttttgctccgatctcagctcactgcaacctccgcctcccgggttcaagctattctcctgcctcaggctcccgagtagcttacccttcagccattcctgggcccttgccttccttgttcawgaagtgctgtgctcttgttacttgcttttcctgtgattccctgctccatctcaagcgctgtattctaggagaatttcaaatgtcactttctctgtaattttctatgattatcctacccactgttcttgagaaaaatgccttcctctccyatgttcccatagcagctgcaaccgtgagagcacatttccttactgctcttatcactcagtagcattgctctttgttttttgggtctgtctcttctagtagactgaattacatgacgacagaattgtgccttagtcttttcatttatggaagatagtctagggttttatgtttcctagcacatgacatgagccatttatgttgaaaaaatgggagtttttgaattttcaccttctcatgtataaaatcgttgtttttagtgacctctttcccttactttgcttcataaagtcatattgatccactgagctggaaggtacttgcttgtgggggattcccctggacaaccctttacattgtatttcagtcttttctttgcaggtgtttacccacctagccctattcccctcagccctaatttctcctatagcccttgcccttctccacaaacacagtgaattaactttgttttaacctctcctatctttgcatttttgagcctacgtcactttcattgtagcatcttccatgaagcaagagtccagataaagataccctttttctagaacctgtatctattatgtatcaactttattatgtttctgaacacttgtttccttaggaaataatcatctacctgtaaatcagtcccatttatatccctctttataatgacaaaatgttaaacctagcctctgctaacatagcttcagaatggtttgtgctaacagttaactgggattgtatcmtgtattatcactacatttatatcctgacttagtcacactggaagcatgttgtagggtagggctttgtaccatagtttgataaaaggaaatatacattggccagacataaagcctgagctcttttcatattaggcaattgtgcatcttacaggaacacacaaaaacacctcattgtttcaccttgtcattacttctgtaaaggaacaattgacttggtaatattagttattgaatgaaagcccagaaacttagcttatgctgggcattaaaatttgggtgctggtgtaaccctgacttaacaagatagatatagaagataataatataattattaattaatagataactccattccttcataactctttgactaaatatacttatcctagttgagtttctgttgctataacaaaatacccaagactagacaatttgaaaaaaaaaaaaggtggattatttagctcatgattctggaggctgggagggccaagatagggtggctgcagctgttcagcttctggtgagggccttgcgcttgggtcataacatggtggagaaacaggaatggaagcagccacgtgcaaaaagaccaaacacaagaggcagcctcgctttgtaacaacctgttctcttgtagtaactaatccagccccacaagagtgagaactcactcctgtgataaagtccctcttgactcctctttttgcctcttaaaggcaccacctcccaacaccactccattggagaccaagcatcaacatgagttttggtgtctcggtggggacaaaccatattcaagctgtagcagaaattcatagctactttagatacttctttttcttaaacactcttatcatttaagatagttgttaaaatcttaaacatgactttcagtttcataagagactaatccaaaaggccctcctttcagtgttttctgatagtgtccttcctttcatgttcacacactcacttttctccctctttcttctctgcacccaaaagaaatgaagtcattggataattaatttgctttaattgagcagatatttataaagtgtctggacgatcaagtattatgctaggtgtcaagagcaataaaaaaaatcactgaaatgttgttcctgattctaaaatcttccaatttagaaatgaggtaaaataatatattgggacagctacaatgcatgatggtatgtcataaatataatgaaggtgaatttaaaacacagaacaattagttgatcttgacaagtaagtaagtcttactgttgtagaacattgtttcccagtctgaggtgttgaatatgatcctcacaaaaaaatattactttaaataagaataaaatataccaggtcttccaattagtaatccacaatgcatgtttttaaagactctgagaaaactttcaaaagaatttgcttataagtctaaatagaacaagtagggataggagtaagagaaaaccttactcttttgcaccatttgcaatttgtgacagttttcatagtgataggagaaaggtagagatggggaggagtctgcygtaaagatatatatttaactttattttactcattgttttccaagattatttgaccatagaattcttttttaaatcaaacttagtaacatacaaagggatgctagtattcccaaaaaaaaaaaagtgagtggatatttgtgtgggggcttaccagaaaatatgattgtaaatctcatatttaagtggaatgttctaataagtgttacaaacctcttgttcatgtaacaaaattcatagccaattgtgtacctgatgtatgccatagcctgaatcagcctttaggtctctttggccttggattgtaattatctacccatctatttattttgttctacttaatcaagaggtttaaaccacatctccccaggaggtaaatgtatcctttccagttgtctctgaaaaggaattttccttctgcatgtgactccttatcccccgtgatattataagaaactgttctttctatattcatctactcttttactgataccacaaactgctctttacaatctctgggaaagaatgtccacatttaacccggttgcacctttttagctgtcatccctgcatacccatttctattcatcaaaatgcctaggatatttccacctccatgatttgttgtcatcagctctctatccaacttccaccatctgacttttgtatcatcccaacgtaattggctacttcaagtcaaatattaggattactggttttttttttcctttttcctctcaatttctaggatgacttaaactcctttaattatcatctttgacatattttccaggctgagggccactttgtttccttccatagtactttcataatctcttggctatttttgagctggctttcagattcaggaagctgaatcctccttcctccttgaggattttcacgtgggagagaataaatatgcttgtgattttctctcctcttgcttcctcacgatgttcatcacttggctcactttttaacttgctatttaattctcatactttatttgattctgctacatacatttacattatgcttgttttattagccttaaattataagctaaggtgaaatgggaactatctctgttgaattgaatctcaccaatattcagcacaacattacatttgtttgttttgtgatttgaccctttgtctgtaatgaaaattaacactaggttagtgccaaagtaattgcggttttgccattatttttaataaatggtacccttttctggggaagactcacagcacaccttactctttctggttcctaagaaaacaagcaccccggtatcagccagggaactacattgaatgtcatttccctgagacttgagtttttccactgctccctcttcacatttcccagacttcgttgtatctctctttttctgcttatcattatttccctgctatctcggttttccatttgcttatgcgaaatgttacagtcatctagtaagaatgtcttagggtcagctgtgagcaaagcaaaacagcagtgaaggataagagaatatcaaaagccatgacatagtccatactctttacccctgcctgtccctctaaagttaggatgtacttgggaagatatagtgtgcactcaaacagttgagaagaatgyaatactcacagacaagtttgtttcagagttccaagaaggggaagctcaatatgggctatcctggcaacaaggtaagaaaagttttgcagagagagtggaactggaattaaatcttacaagattagcttagtaggagggacaaagaagtgcatttggtaggagtggagttcatattggggagtcctgaagatgggggtgaatggagaatttagcattggaatattragggactgaaggtcaagaggagaaaactggattttaacatatggacctagtatttcaaggagtagcttgaagttttatctatttttaaaaaattagaataaaaatctatmttttaaagtatatttcgaagtcattgatacaggcaatggagagttattggaggtttttgaacaagtatgttataggatgaaagcagagtttcaggacagttagtctgccaggaatatgtagaaggatgtgaagagagtggaaatgaagagagggagatcagcagcaaagagactgaccattgccatggtccaagttcaaagcaatgatgtctggcctgagctaaggtaatgaggtaggaggcgagacttgactctggagtcgggctccaacaccagatcaaattgaggactagataaaacagggatgaggcagaagatgccttccataaacacgcccaccagggtgccatgttagtttaccattgacatggcaacaaccaggagttactgtcccattccatggcaatgacccaaggactcaaaagttattactccttccctagaaagttctgcatacaccacctcttaatgtacatgtgattaaagttaagtatgaatataactgcaaaactgccctgagcttctcctctctgcctgtgaggtagtcctgcctggcaggagcagtcacggagcygtaaggccaccagagctgtaacgctgcagcttcaaaataaagctgttttcttccacctctggcttgcccttgaattctttcctgagcaaagccaagaacccttgtgggctgagacccattttggggctcacctgtcctgcatgagtaggaatgcagggacacagttgacagctgccttagatccagctcccagaagcaaaccctgagaggacgattcacatgatagtgatwtatttgtgaggaagcatttccaacagaaagcagatgaattggggaagcaaaacaaggtatcaacagaggacaaaggaaagtgtaatttcaagtggaatccaggcctcagcttgatatggaaggggagtttctacttgagtcaaggggctgatttctcattccctgcactcaccattgcctgtggatcagggtgatggggagctgaggaggacgggggactcccagacactcctggttttttcagtctttggggtaaagcagtctagtagctcaagtgcagtcatctgaagagagtctcaggtagagttgttagaagcaaagtatccagagcagataagggaataggcagttataactcatcttatattttaagatttacaaagaataagcttttagaagccaggcacatattggaggtggatagatggatgatagagatgtaaaatttaaagcactgatttctgacttaccaacattttgagttttttactattcctagtgtgaagataakttttccggacaatccaatggttcatagtaggttctttaagatatgtaaagtgtgttgtaaatgtaaagtattaacacacatgtggcaaaaagcagtcttgttaagttggcatctcttcagctcctctcatgtgagctcatccccacatgtaagtgagataaccctttttcccaaggagttggcagtttacgacaattagattaaaaccaataaatgagaacaacgtggactcattagtaaaaaatagttgtagtgtttgacagcgctcaaatatgcaacctcctttgagattcatggtcattcctttaaaaggagaccaggttacaatttgtgtgacttgtgtctagcagcattcaaagccacagaagcatatagagaggaggagataattggatttaacccgagttggaagttagccaagtgagtcattggagggaaaaaaaggttaaatgagttaaatgtttgcaaataaatgattatagtcattggaccatggaatctagtctaagtaccaaaaaaaaaaaaaaaaatggcagtattaatgaattagttggaggtcttgatatggtcagggaattagtgaaatgagccaaagttaatgttcaaaaagaaggacatttgaaattgggattgacctgctgacaaggtcttccaaatgacaaggtcaaggataagaccttgggagaagatggctagaggaaagattactgatgctggggaggtcaaagaaatgagagactagggtattccacagattatcagtggatactagattaatagattattaagtagatgccaaaattttcaagaaaaacaacaggagtaggagggaaaattttcaaagttctttagcctcttaatcaaataaaaacaaaggggaagaaaaacaaagcaaactgtaagatgtccttaattgatgagcaattaacttccacaacagtrtttgttcactttgatacctagaattagccataatgattatccaagtaacaaaaccattttgcttttatttacactgaacatttatatacccaaagacatgygtatccatggatatgtcccttaataattattcagtgtttccaaggattactaatcaaaaactttagggtcattgaagaaaagaattttaaatttatgcagagggtaataaaaatgttcctcacattttattataaataaagaaaatatcctgaattgcagtcatagatgtgtctttatccactttattatttttgtgtaattagttggctgtatcctatcttgttcccaaagggtcttytggtcayctttattccaaatatagtagctctctcagaataggtggtaaaggatattgggtgaaagataaactcacagaacaaggctaacctggacatgaattgagcagagtgcatgttcattcagctgatgatgtaacctcatcttacaattacatatattcyctagttatttcttatttatcttatacctaactaagcaactttaggagagaattcatatgttctattattttttacaaaatatgatatatgtatttatgtgtttgtttcatcatatactctaacatatctcagttaactagctagttaagcaaattcattgagtagccatgaartggcagtggcactcagcagaagctagcaggttgaggtgactaaagaatggaggattttagatagatgcctttttastgagaggaaatagggtgattgaaagagcccttggrtaagggatacacatcttagactagaccccccttccaccacttcactatagggattgggtgttttcaactcagtttcctcacttatgaaacattatcatgtttctgttattataatttaaataattagagaagaaagttttaaaaagaccattaaatatatatcatagtattcttatttaagcataaggacataattgctccaacataaccagtgtactctagagggtaactcaaagatgataaaaattgctttaaatttgggcttctcttatttgtttctaaaaacacaccagaatatgcttttagtttccaaaaagacttagtgtgaaaatgtacatataaacagacatgaaattaagactaaagctttctgacatcagtgatttcagcagaggagcctggaaaccagttactgagccttcatgctacttaagaataaggttagactaagaaataggatttgctctaaagcaagtaacagaggcaacttcaccaacaggcaaagtaggcaattgccttggaaagaaggcaggcttgttgcaaattacctcccttacccaagtaatgaatcacctggaattcctgaattaaagagacattcctttgggcaaataattttctgagtctggattttgagataggatggttaaacaaaaagtcatcttcagtcacaatttttaatgcagattagtttattggttcacatcaacctttaaagggagatgtggaaaaagtgtaggagagatagccattactggggccaggaggcaggtgggaagaggaagaatatggagcaagggaaatcaaatctgggggcactttccctcctgtatttcactgcatgaaggctctgcagttagctgcctgcgttatccaatctgtggactaaagggaatgaaaggaggaaggcagtaggaaaggaagacaaaacaaggaaasaaggtggagttgggaagggctgatttgggagaaatgaggctgcagcaaggttagacaaagctcactgctcaagtgtgtaaccctgcaggctacataacctgattattcctccagcytcatggtgccctcttctttcctcacagccctggccatggctcactgcctttctttccattcttagggtagatctatctctttcccatcctggtcttcttcacatacacagtttcccctgtatggacgctctgcccttctagcactcactcttgaagtctcagcttctgagaagccttccctggacccccattttcagkctggcctctagattatattggctgattagggattttcccatacagtcctttccacagtttgcaattgttcatgtatttgaatgwtcacgtgtttaatctctctctccttctagctttagagaagctccatgaaggcagagaccatatcagtgtgtttcatattctacccaccaaggcctaccagagttactctgtaaaatctgttgaattagataaaccaatcgtttgagaagtttagtaacagcatgtttgcttttgttctttggactacgaacagtcacagaatggctatgcttattactgtcaaaatagaagcatttgtgtactgataggtttgcaaactcatctgaaatgtattatatctgattcacatggttaacctgaagaaatctgaacaggaaatttggattgacgtataactcacagtggcttggtatttcaggttggaattgtacagtatggagaaaacgtgacccatgarttcaacctcaataagtattcttccaccgaagaggtacttgttgcagcaaagaaaatagtccagagaggtggccgccagactatgacagctcttggaatagacacagcaaggtatatggataaaaaaataaactaaagtaaaagactgcaaaaataactgctcatgatttagccttttggcatatcaattgaaagtttaatatgacaatatttaaagccattttgtttaaaatgagattcagaagattaaataatggttacaagatcagatgtttgtatgacacaatctcaccatccttcttatccttctcttrttacaagggtttaattgatagagaatccattttaaaatatcactgcatctatattttcatgttcttgggtactaagacaatattagttaatatttgtttcatttattttttgttttcaacttctaagagtctcaatctaaaagaacggattaaaaataggtctacctctactcaatatatatttatattctagaatgtccatgtattttcagtacttgatttaccgttatcgaagctactagrtaagaggtgttaaggcgccaaattaaatattgtctatttraaatcatttttagtgcaaagtttgaaagaaatggaaaggatattatcatttgtaatcctctctccttttttactttctttagattccctccaatttacaacccttcctttcttccatctgcagttttccttatggtgaacacataactcagtctgtggttgaatttcattttataagaacgaacrgaattgtcctctcttacaaatgtagaacactttatttcctgtgtgttctcttatctcattcattaaactagcaaacttctgaacaaattcaaaacaatacaaaaatcacaggaaatgtaataagtagtttgattaatgttaagaatccttctgttaaatgtcttcaacttctgaactcttgccttaggtggaaagctaattacccatgctctcacttcatctgcctgctaagatgactgttttaagaaggttaaaaaagttaataatgatcctgcaaagaatggattggatattcaaaattttataatttcatgtacagcttttgcctcatgaatattagaaaatcatctggctctagttatatggggcccaagagaaaataaccacaaacagatggaggtaattggacatttacctacctattggatcacctattggatcaccaayttgtatacacaaagagtgcacatgtttaggtgtaccraatgcacccccattcaataatcaattaaatgtgactgcacattcgaagtaagtcaaagtgttctttgaaacctctgagcctgtagggagctgtacgttttccaaaggcaaycatttaagaatgaatattcatctctgaaaacwaactgaagaaatattctggctgcttttgcttctgcataaatacggctctaaataccatgtccctatgtgttttttgcctctgtgtttcacaaaggktatagctgtgggacacagagtttattgaattttgattatacattaaaattmtgtagtgatagtaccaagtatttttctcctacattaattaccttttcatgtttaagcacattttaattgttttttattcctttcaggcagaagttgcaaacaatatttttaatatttttagaattctttaccttcattttcagtaaatcccagttcaaakttttgtgtgtgtgtgttcycttcttcctatcccaaatttttacttttgtcaataaacttacagtatttaatcatgaggcctggattctcctgtcttgaagaaagggacactcttgatatattttaattttttaaagcatgcaggaaagtcaatgcttagtgccaagaaaggacactggatactggtactttgaggacaatgacaattttttaaggaatgtagttgaaacaggaaaggtgtactcaggagttctgtcaatgtctaatcttccaatattacataaagccagccctgagtttagaacagtcacattttatttatgaaaggccttytaatcatctccttcagctgatgttcattcaattcwtttgtaaccctgatatttaagagaattaggaagttttagtgayctaaggaatttgaatttcaaaagtgattgaatctcatatgatattcgcatacaaagatctgttaaagactaacatgtaacrtctgttttcacctttgtttgtatactttaaaaagtcagaaaatcggctgggtgcagtggctyrtgcctgtaatcccagcactttgggagtctgaggcggctggatcacctgaggtcaggagttcgagagcagcctggccaacatggtgaaaccccatctctactaaaaatacaaaaaaaattagccgggcgtggtggtgggcgcctgtaatcccagctactcaggaggctgaggcaggagaagcgcctgaacccaggaggcggaggttgcagtgagccaagatcgtgccactgcacttcagcctgggcaacaagagcaaaactctgccytaaaaaaaaaaaaaaagccagaaaatctacttgtatagtatgttaaaaattattcatgatatttgttaaagattgtaaggaagacatcactcaagaggaacctttatgatgaaggtattgcagtaaggaagagagatagggctcagctttgactacagtgaggacaagtgggcatttatagtcaaggaacagggcagggattggcagtaacatcaaggctagggggattcttgctagactggctcaacaggattcttgctgaaggcagataaatagtaggaaaaataaactgtttttctctttctatattctaaacacttgacatgtcacttctgatgccagatgtgtgggatttttcccacatcgaccagttatctgacatcagctgcatgttctagaattcaattcagttctgacaccaactagagtttatgcaaacctcccacagattaasggctcagtccttcaagaattcattccaatttagagccagtaggtttccaggtacccacgatttgtccaacgtggctacaaattagaccccttacttgggtttgattatatgctagagtggatcacagaactcagtaaagtatcttacttactattattagtttattataaaaggatacaactcaggaacagcaagagatatgtagtgcaagctatgagggaaaggtgtcagagctgccattccctctcatggtgtacctccttccacctgttcagcaacctggaaactttctgaaccccgtagttcagaaagttttacagaggcttgatcacaggcatgattgattattaactgattctctagcccctcaatctttcctggagaatgagagctggggctgaacgtttcaagcttctgatcatggcctggtccttctagtgatcagctcccatttaggagcccaccaagagttacttcattagaacaaaagatactcctatcacctaggaaattcaacagattagaatatctatgtcagaaacccaggttaaagaccatatattagaacaaaagatacacctctcaccagtattgctcaggaagttatgagagttttaggagttctgcaccagaaaccagaggcagagaccaaatatatatttattatttgttaaaggaaaattttagacaaattaaatttgacagagtttatttgagcaaagaatgattcatgaatcaggcagcagtcagaaccataagaagttcggaaagatccattttagcagtgtgagcaatgggcttttacgagctgaatgcaaaatcaaattaaagaaatgacttgattggctatagctaggcatttaccttatttgggtatgatctggtggaaagttagaggttacttgccaggttctgattrgtaaagtctctasttagaagttagttgcagtttctaattggtaatgtttaagttttgttttactgtttacattgaattggactttggtttgattatataggaacatacggcactggagctgtctcagcctaattgcctataaattcaattcttttaaaagataatatcatggaacagcgtaatmagatttagagggtggggaatgaggaatgtgatcagataccaaggatgagggatttccactaaattgattaagccagattcttgcttaaactggactaagtgggtaaagaacacagcccagggtcagagcccagtctagaagaagatgtaaaggagcctgactcggttttggtcaaggagagggtctttgtcaagtatagagggcagagagactcaaagaaagtaaaaaattagtacaactatatcctgtatatccaccactcagaactgacagttgtcaacatcttgtcatatttgctttaagtccttcgaaaggaaaagtcatcayatagaatccttttccccatttcaccagaatcctctcttcctgcttaaagatatcagttatggtatatttagtgtgtatctgttgtgcaaactctttggaatgttagcttaagacaggcgtttccttggcaaatctatcccaaatggcagctgtttgtctgtacaaccaaatatctaaatggaccattcagtacaatgattgctgtactttgtaccaaaatcctagaaatatatgaagtcttttcattactttagtcctaaataaaatatactcatctcttccaagactccagagcgaaaaggtttgagtaaaaggaaataaagggggaggggagaagtgtgtgtatatatttatatagaatacatacaaaacaaaaattttccatttccctgtcttctgtttctttccataagtgctgttcaattaaattsaaattcggttttttgttttgttttgtttttgagacgggaaggtgtctcgctctgtcgcccaggctggaatgcagtggcgcgatcttggctcactgcaagctccgcctcccgggttcacgccattctcctgcctcagcctccagagtagctgggactacaggcgcccgccaccgcacccggctaattttttgtattttagtagagacggggtttcaccttcttagccaggatagtctcgatctcttgacctcgtgatctgcccgcctcggcctccctgaaattcagggtttttttgcagttaggttatagcattttcccctcctctccattgccatcttctcccatcctgctctcagcagcctgtgtgctaacacatagttcaggccaaatgttttgtaactccttcaaccactttttgctccctaaaacccaactgactactccatggactcagagcatcaccatctgcagtctattactcccatgtgaaagactgcagatgtccctatccccaggacactctcaagcactcacagccccactaatactctgttctctctcatctctcctccccagattagaggattttcgagccattctacaaatgtcagagtagctgtgggggaagcaaaatctcaagcaaaagtttctgctagacgcagaagaaaagaggcctgttaaatgagagaaggggtgtttacagagaaaggagcacctgggggagtgtttacagatctggccttctctgaccatgatgtatgcctcagtcacaccctccctttgaaatttccaaagaatgaaatactgctgcctttttatatataggatgtgtggtgattagcaaaacggagacctctccatcatctgaaataaatctaaaactattacaaacaaggctcattatgcctcccaacttgaatgatgggcattgatgctaattttggagggaagcaccaggctacctagagtagtcagtgtttttgtttagttttttactttgtctattgtaaagtggtgtcttatcaacctctcttttgtttgtgattactttagaaaggaggcattcacggaagcccggggtgcccgaagaggagttaaaaaagtcatggttattgtgacagatggagagtctcatgacaatcatcgactgaagaaggtcatccaagactgtgaagatgaaaacattcaacggttttccatagctgtaagtgtgttgccggagatattttcaaactcttaggtgtagagaagagctgtgtgcatattgggtaattttatgaaagtcacacaaaccaggttggaaaagagaaaggtctccatttgaaggtaagccctgggaggacagacttggatcttgctccctctgggtccttagtacccagcacaatgccaggccaaacagacactcaacaaacaatcattgaaaggaaggaaggaaggaagaaaataaggaaacatgaaaagaggaagaaggaagsaaaaacataagaaggaaggaagggtgagaaaaagaggactgaaaaaaagaagaggaaaagaagaggaggaaaggaagggaagagggtgggaaggcgggaaaaatgcctttgcctttaaataagagagaggatttgttcagtataacaagagcagtggccattgggcttcccttccccgtctgagcaattttcgactmtctttttcattaattatcttcccccatcacttagctaaagtgggggaaagtgccagttgtctctgtttaaatattaacaacttctgacgtttgacacttgcttttcagcgaagtagacaggaattgaatttttgttttctgatgcaatttataagctcctggtatagacctttcgacctaaaatgtagacattctagtggggaacaagttctgaaataaaaagttacccaaatggtatgccaattacttcagagctagctctagttttaacagtgtgcttcttcaaarcagcttgmagttcttctcagacattagtgcattactcctgtaacctcattattcctrtagcttcatggaacagcaggtgagggagctgagaaagaggcaagggcacccagtgacttgggtggtcccagaggacaggggcaaagtggcttaaagtcctctgatgagacgtgtggtatttcctctgggatggtcactgatactccccagggaaaaggatgagggcyttactgaagcaaaagaaaagaattgagaataaatctgccactgccttctctctagtaaggaacattcaaaagccactgcactgccttcaagactcactttctcacattaacattgagtgtacrttatagtatttcagttgytgctctaaactactatccatttttttttttaaatggagtctcgctctgtcacccaggctggagtgaagtggcacgatctcggctcactgcaacctccaacctcccaggatcaagcaattctcctgcctcagcctcccaagtagctgggaccacaggcgcacaccaccacacttggctaatttttwtatttttagtagagatggggtttcaccatgttggtcgggccggtcttgaactactgacctcaggggatccacctgccttgacctcccaaagtgctgggattacaggcgtgagccaccgtgcccagcccactatscatttaatgatacaaataaacaagtctttcgtagattataaacagcagcactttaaacagtaattttagttcttttctaactttctataagtgaaaaatctgtatccttcttaatcaaactatcagttttttaatctaccattctaaatctaactttaaaaaactacatgtagatgtgcagtgggggtgagctactcagatgggtagggggagcctcagacctggaggaaaggggtgggggcagccctcaagcccattgcccttgtgcccactatcctcccaggccacagtgcagaaccatggtcggaagggtgcttgaggtctgttttgtaacaggactttgaaggcagcaccatggagctcttcgtttttaatgatgccagacaaggctattattggaaaaagaaatgtgaagccaaaaaattcctgtaccttcatggtcactggaggccaagactctccttcttcttagaggatttggatattcttaaaaaaaaaaatcaagcaatagcaaagggctcagtgtctttcctttattttttggattccaggagcatagccttgaattaatccgatccttgcttcgttcaggccaaattgtaatcatttgttgaaacaaactttatttgtttctctgtttagaactatatctgtgtatttattttaataatattataagcatccatggacctaccacccaaattgagagctagctctcttttttggtaactacatctgagcacatttaccacctgccttcctccacctgggtaaccatcagtccactttctacattcctcaaccctggctctacttttcaaaataatatttaggcacccatacatatccaaaaaaataaattttaagaatatttcattgtttttaacattttaaaaagagtgtaatgctgtatataatattttggaacttttaaaacttaatactatattaagattcatccataatgttgcatatctgtatagttcattctgtttttaaaaattgaagtgatatttacaatacagtgaaatgcaaggtttcagtgtgaaaagtgtgcacgaagtgaacaatttggtgagttttgacaattacgtgcacccacataagacttaatcaagatatagagcaatttcatcactcccagaaagtttcctgtgctttcttttttaaaatgtatctttaatttttatggatacacgatagctgtacatatttacctggtacatgtgatattttgatacaggcatacagtggctaatgatcaaatctgggcaattggaatatccatcacctcagacacttatcatttctttgtgttgggaatattccaagtcttctcctgtagctattttgaaatatacaatatgtttactgtagttgtcctatagtgctactgaacactagctcttattccttccatctaattatagttttaaatccattaactaacccctcttcatccctgctcttccccactactctttccagcctttgataaccaccattctattcagtaygtctatgagatccacattttcagctcmcacatttgagtgagaacgtagtgatatttgtccttyagtgcttggcttatttcatttaatataatgttcttcagttccatccatgttgctgsaaatgacaaagttttgttctttttaatggataaataatattctgttgtgaagatataccatgtttttttaaatccattcatccattgatccatacttaaggttaattctatatcttgtctattgtaaacagtgctgcaataaacaggggagtgcagatatttmttcaatatactatttcctttctttgggatatatacccagcaatgttttttttttcttttttttttttcattttaaatacacacctcctgtagtaaccactgatgtgacataccaccatagctcacttagatwgccaattcttgaatttcaaataaataaaactgtatagtatgtactgtgtgtttagcttttcactcaacataattattgcttgtgatattttgtgtactggggattcattttttgttattgttatctattttatagaccacaatttgtactctactgtttatagacattttgcttgtgtccagtttgagttattgttataaatgtatcatgaacactaaaaaaaaaaaawaaaaaaaaccaaagtgataatcttcaggtaacacttgcaactatggtaaaaactaatttttttatttattacagaagtgattttttattataaagttttaaaaaaaatattgaagcaaatataaggaaacacctagtgtcctaatatacagaaatamaaaataatatattatgatacacattttttcacattttttatgcccatgtacttatgtgatttaaaaaatagaattaggtcatatctacatattggggatttttaattttttttgcatgttaaattttacatattgttttaaaaatgttttcattatcttgaacatttttatattaaaaacagttttaacataaaaaatttttacattaaaaactaatttttttaggcagaaaaagtacaaacctyaacaaagctaattagttggacttcatcaaaatgtaaaacttctactcttcagatgacactgttgagaatatgaaaagacaatctacagacgggaagaaaacatctgcaaaacacataaaggacttgcatccagactatatacagaactcttacaacacatttaagggaaaataaacatctcgttttcttttaatgggaaaaagatttgaacagacactaactacactgaggaagaaatactatagcaaataattgtatgaaagagtctcaacatcattagtcattagagaaatgcaaattaaataagacaccactatacgctaacacaattgctaaaactaacaagtgaacaaaaaaaactgacaataacaagtattgacacgcatgcaaagcagctggatctcttagacatttctgatgggaatagtaaaatggcaaaatgggacgattactgtggaaagcagtttggcagtttcttaaaaagttaatcattcacttattgtatgacccagcactttcatttctagttatttactcaagagaaaagaaaatatatgtctattacagagacctacatgtgaatatttrcagcagcattattcataatatgttgaagctgcaaacaactcaaatgttctcattaagtaaattgtggtgcatccatacaatggaatgctactctgcaatagaaaggacccaactactgctacatgcagcaacacggatgactctgaaaagcattgtacaaagtcacagaagccagacacaaatggctacatactatatgattccttaaatctgacattctggaaaaatcaaagctataaggacagattatttatcggtggttgccagggttgaacgaggggaggaagggattgactataggggcaggagggaactttttggggtgatgtaaatattctacaccttgatgtggcagtaacacaactatattggtttgtcacactcatagaattgtacatctaaacagggtgaattttactgtatataatttattgcaataaaccttaccttaaaaaaaaactaaatgtttgagaaaacctgcttggacatctaaataattatagttaacaatcatatataactcctgcttctctctcctcttcataaaaaagaatgcccctgtctccagcatttggtttcaaacaagaatatctcaattgtttattttcyagattgccaatttagattaccacttagtccagtatgtgtttaaaatatatrtgtgctggactgtgccttggtaatagtttcaggaagaattgctcattcaaaagcaggcaactcacttgctgattgcctttgccagcagataatgacatcactagctggaataatatcaaagacattcagaaactatgaatataacattacttttgaactgtcagattttaaaaatacagctgttagtaacagggacacagagtacaagaggagaaattttcacagacatacaaaattgccctttatatttttctacaccaattgtggtgtttatataacagttaatattagggagtctacaaattttgaaaatcactcttccataaatatgaaagtacataaaaattccattatgctaaggtactctacactgttgtttactgacaaaatgcttgagatcctttatttaacacatagaatttaaaatatattcttgctgtttctgttgtgtcttagattcttggcagctataaccgaggaaatttaagcactgaaaaatttgtggaggaaataaaatcaattgcaagtgaacccactgaaaagcatttcttcaatgtctctgatgaattggctctagtcaccattgttaaaactctgggagaaagaatatttgccctggaaggtatgtctatttatcttattgctgcatgttctctctgcaattcaaaatcagtataatgggatttttgtatttattcctaatacatcagtaatactttttttttttttttactgtgtacaatatctagcatggaacaatgctcttttatataaatctgccattaagatggctgtttctcacaacactgtgtctgctagagactctctttgtaagggcatggtagggcagtgctgatgggacagccgatgaagacaatggtcaatgtagatgtgccaggacaaaaatgtttccatgtgctttgttccttttctgttacatagatttggaaaatgagggtactacctctggtttgggttttttttgtttgtttgtttcttcatttcatattgagctactacaagagtgctcttatgcaataacttctttgttcacttattttctctgtattttgctccttgcccattttaaaggtcttcatggaaatttgccttaaaatccatggcaatgaaacattggttcactgtatttgtctaaatcatgttacttctttgcagatttttccttgagttttcaatggtgactggctgttgaggataacgagttatggcattccctattctgccttaggtagaggatgtcaagtagctaattactttggaactcgatctttcctaaaaaacaaaaaaaaaaagtcttcagaattgttatgccaggcaaactggcaaagcttctttcttcacattctttgatgatctctagtctcagggaacatgcgccttttctccaactagggagagaaaccaccagagaattcttttccccttaggctacatccaaatccagttgaccctgtccttgtgaggacacactgaaagactgttgtttctacatcttaacaatagaaatttaaaagcactttctcagtttccctgatttgattgataataggaaacagaaagacaaaatgggaatgagacacaactgaaaaaaagtagaccattttgattgagcgtcaaggggctgggaaaatgcagaaaaattagaatatgaaaatgtacagaaaggaaagataattatttagagttatggctttcaaactttttttgagtgtgactcacgataataactacattttgctttttgacccagtgcacataaatatatacatataaaaataaggcaaagtttcacaagataattcttattacatgtgatgcactgtgatggtttctcatcaattccattctaccctaatctctttcaatgaaaaaaaaatgctggctatactcagtctgttgatttcatgactgggtcacaatccgtacttagaacatttgatttagaggtgataggaatctacaggccagccagactgaatttctgtgcctcccttttcccctggcctctttcccctgtgcctttagaaacagaacactctaattgtttatgagtctggagtcccagctgcttctgaagaactcagctgtcttgtgctctgtgtacaagtcatttttaagtggctttggtctctcaacagctctcccggtgtcatttaccaataaaccagattatgagcttggctggccttaaggaaaatacataaggtcttccaactaattgtgtacttttaatttttaataacatgggctaagatatgatagaaacaatctgtaaaaataatttaaaagaaaagttacatagttacatttgatagttcaacagaatacagtgtcatttctaaatctccttttaagtaagcaagtaacctaaaactggcaaaaatgaagcccacttcagctaggggagggggagatcaattgcctgaaatgacatttcagattatttctaacctaactacaccatggattaaaggtgacaggttgaagagcccaaacactccaagaagtctctatatttaaatatgacatcattttataaggaactttacagattacaaatgtcttctatatcatctttgttgctacactacaccaaaagcagtgttttgactagactatttcttatttttttcatgagatatttaaaaaggctttatttctttgttgctcgggaaatctccatttcctgtcaacatgtatcttaagatgacaagtagctgtgattatgaaatttctgtttgccaaggacagtgccatctattgaggcaagtatgccaaggacttgcttagtacatcagaaaatagtctactgtctccatttcccgttgagcactgggagaaaatgccaacatttctaaccagaggctgcacagtggttagagtggctgrcccaaacacccatgaacagtccagggagaagtttgaagcaagaagcccaggagaatatagtggtctattaccatgatgccactgcagcaggaagaacatcacatagcgtccttctgtctgttctcagctgaaggcagartagcggcagggcaggtgctgaaaataatgcaggtttccgttgctgcattcttattgatcttgcagataagtgagaaaacacctgaaagcattgtggactgaaaatacatgtttaaattaaagttaaaatgcatctcagtcatttaaattacagggcaattcacacaagagattaaaatgatatatttgaattcttcactgccgcgtctaatctagtcctacaaaggtaattactgatgtatttgttcacaattttatccatgtaaataactaacaaatagttacattcacaaatttgattattctcttgcctcaacgaaagggcagactgactttcttaagtgctatttttaacttatctgcaaggccaaataaatcagtaacccctagtgcaagcaaataaatcaacattccatcaattccctcaggaaattgtggctttgggtttgtgaatattttgagaataatttgagagtagcagactgccatggaatgctctgaattatctctgcatttcagtaaagagcttcaaaatgggtacaggatcttttaaaaatgtatgattgaatggcatgtgggcagccctatcacaaagacccctctggatctgtgagtgatacttaccaccagtaattagagcaaataaatgcatactaaaatacctaaaccctttatcacacaatgaaattctgacagaatctatggcctgaatatgggtgggactgatggagttgagaaacctctttaaatatgtgaatgaaatttttttcagtcccataacatattaagggagtttagcctaagggctcagcagggttcccaaggcatgaatttggacaggaatttcctactgtagtacatccaacttgagccttgtggacccaaagcaccataggatccacaacatgctacagtataagaatggagatttctcaacccctctggcgaggacagggctgctaatgaacaagaatttgagacatgagccctttgactatttttctctgtcttctacccaggcctacctrgaaattttgggttgagaaatrtatggctgaaaatgccctaagatgtttgaagttctggttggtaagaccacaagctctaccaggtatctgtattctgcaagtcagtagtgcrtgaaaaggcattgttacttatttacagtgatattttcctatgttatagcyacagctgaccagtcagcagcttcatttgaaatggaaatgtctcagactggcttcagtgctcattattcacaggtatgttgaccagttggtgaaaaatgaaatayatgtttgcaagacttcccttcccaaaaccaacatctagccatcagtatgtaagtgcaacgtgcagttcatagcttgaacaattatgcaggctatgatgatgttttctaattcaaataggaaaatatcmtttcacaagcttcttattaagaaaatatgttctctcacacagttcactacattgtactaatagttgtgaatcagacagtgtgagctttgccttgtaattatgtatctgtctaaatgaaataatttaacatatttgctacagatgtggaatatttttccacagtgtcaaggaattcaagggtcttattagaattccatgttcaagacctaggatgctgggcacccagaataaagtagaaagacaagattagaaaatatatcatttgcagttaatgraagaaaaggcataatggtccttgcaaaagaatattgacatttccatgtgcaattttactgtataacttgggtaagttatttgtgccttgatttccttttctgtaaaacaggtatggtagcaatagcatctaactcatagagttatcatgaggattatataagctaacaaatgtaaagcactttgaacagtatacctatacacattgttaatggtgtttaagtatttccccttattatttttattaaatattattatcttatttatttgcatgtaaggactgggtcatgcttggagcagtaggagcctatgattggaatggaacagttgtcatgcagaaggctagtcaaatcataatccctcgaaacacaacctttaatgttgagtctaccaaaaagaatgaaccgcttgcttcttatttaggtaaggtttggatataattataaaagagttgttttacttttccattttttacctttagcattatttgcttatgtttctataggcttgcaaccatatagcaggattatttcawcragttgggtattttccagaacccatgcaaagttttaggcctctgagcagctttagttagtcaaaatgacatacatgggggtccttttttgttagtagggctgtctaatgcagggaatggtttaggttgatatgtgccctttctgatatgttcagtttctctgtgtctggtatcaactttaacttcaaggagaactttgaacctggtggwcaagaaatgagagtagaaaaggaaacctcgacttctcctatatcctgaaaaccaaactcatattgtcttaaatgtcttctatcattaatttctctctatgggtcctaatttgggaaaagaaaaatgtattttgtcatgtaacttcttctttaatagctccattcacaatcagacaaatattgaacttaaacccagtgatataacatgatcttgtttcccagtgtcttgccagaaatgaggagttgtatgtctggtaccactttatttgggatctataccaagctgagcaacacctgggggatgccagggaactctcccctcactgaaaaaagatattcaccaacagttgggaggacctaaaataaaaaggaccatcaggatatggcttcccagctcttactcactcaacaaatatttgggggatcctcttttgccccaggcattgatcttagtgctgggaataaagtgataaagaaaacacataccttggcctggaarcattcacagcttcacgtgttagccttcctctctgggatctttctgtcccggagacaagtctttttctctctgtcccagttgctttctattttaycaggaaggtggcaggtctttactgcggtgtttatacatctccttattgaaggacacctattaaagctgtaggagcagcaggacttaagaagaataaaaggactagagttttagatgactaaaaatgtaacagtcaacagcagctgcactgtgactgctaaaatctcttaagacatgtagaactgcatgaatgaaagtccagtctgtttctcatagaaatcctgttacattccactctggtcagacaacagctagagtatctggttgttctaagtatcacatactacaaggagaaaatgacaaactaggatgtgccagtaaaatattacacagaaaagtcagctcccgaagcaattccctgctacaagtctcactctctcgaaaacttaaagaaattgaaggttagaaaacaaagtgtgcattgcatgtattttaggtatttggaggattgtgatataaaatataggggttaggcttaaaattcatttcaaattttagcattaaaagagatcctatggagcatgtagtcttaatttccaatcaagaaactgagagatagaacaattatgtcccagctgcctatggcaggtgtgaaaccacaattgaggcttcttgattcttatgtcagtgtttatatcacgataccaaaataactgattctgggttgattaagaaagcactgcacaaatattgagtaccagcaatgtgccaaacactgagtttatagggaataaaaagatagatggggcaggtcagttcctacactgataaaccttacttttttgggtgagagacaataatgaaacaagcaatcactatcagtatgatatgtgctatgacacagaatacctaaaaaagagggctggggattagattagatatcttctaaaagttcattacatcctaaggttctatgagactgtttatgtgaaataccttggaatcaagaaccagcttaacctgaggcttctgttatatgtagaataaatatagaacatttatcttcctatataatggatgacatataaattagtaaaactccttatgaaaggcatttgacaatgtgtttacagagctataaaaaatgttcgtaccacatttatacagaaatttcacttctgtggacctaacctagggaaaaaaatccaatatttaagaatgccaagtgaacaatgatttccattgtattattatttatgttattgggrgaaatgccattatcctaaatgcccgaaaatatgcaggtagttaagtaaatagtaaatccacttaatgaatattacacacccataaaaataaaaattataaagctgctgattctatgatactaaagacttgaagcagttatggtacaaggtgtacaattagygatagcgatgaggtcatagagacttgagcttgttttctgattctgcccctggctatggctttaggcaaattactctccccctcaaagcctcaattttcctatttctaaaatggaaataattacaccatatatatcatttgggttgttagattaagtaatgactatatttagtactgtgcctgacacacagttaacactcaatgggtgttgtctattattttattatgtaaatgttattatgtatttttttattrtgtaatgttatataataaacattcctcttattagtattgtggtaggcagaataatgatccccaaagatgtccatgtcctaatccctggacccatactttgcatggcaaaagggacttttcagatatgatgaaattaaggatcccgagttggaagattatcctcagatatctggctggacctgatayaatcaagcattctaaaaatcagasaacctctcctggatgtggccagagggagacagaactatggaaaaatggtcagagagatgcagtgttgttggctttaaagatggaggggggccacaagccaaaaactgtagatggctctagagctacaaagggcaagaaaaccgattctccttgataggctcccgaaaggaacactgacctgccaatatcctgatgtttagtccaggaagctctatgccagacttctaataaacagaatggtaagataaaaagttcatgatgctttaagccaccaacttgtggtaatttgttacagcagcagtagaaaactcatacataatacaaaataataatagtagctgacattagtactattactaataagtattgagtatttacaaatttaaagacactgtgtgaagtccacaaagatgtgtatgatattgttgccactcttaggaagcccacacattttaattgataacactgtagtttttggtattcttaattatatgtgattaaattcctttaaagtaaataaactcttaagaatcctaaatttgtcattcccaaaaacctttggttaaacgttgcttaaagcagatgtggagaattcaacttaaagatgccactgcaagtaagaaaatattaagaatcttatttctgagcacagtatttataatatatgacttctctctgtccaaaaaggaaatttttgggtatgttttctacagtgtgctgagattttcttttctgtttcagaaattatttcattagcttactcacaagtgagggtatatgacattttgccaacataaagtctaatacatgtaagatttctttcaaaatagaaaagcattcagaaaaggcaggacaaataccttgtgttttttttcacccaaaataatattctaaatctgaaatgaagttttcaaaatgtttctttgtgggggtcacaaattgagaagagactgagtgtattttttcataaactgtgtggattgcaagttgtaaggctatgaaaaatcttatgaaggaagcagaggcagaggctctgttagaaaaatcccatgcttatcaataaggatcaggaaactgtaagaactcaagctgtcaaacatctgtctcaggacatagtcctaccccatctttctattacccaaactgccttatgccaatacaggcattgcaagtgaatttggtggtgaaaatacagctgggattatgttcccctgcctcctccacccacagtttgctgaattctattcctgccatacagcttccaaaggagaaggaaagatgtgaggcaatgtcatggcatcaagacagatcatacctgtttcccattacctcactagatcctggcccttttcccaagaagtgaattatgagagctgacagaattcattcttcataaatccatgcaaagggctatgccatccattttagcctttttttcctctttttttttttctctttatttgagacagagtttctctcttattgcccaggctggagtgcagtggcatgatctctgctcactgcaacctccacctcctgggttcaagtgattctcctgcctcagcctcctgagtaactgggattacaggcgcctgctaccatccccggctaattttttatatttttggtagagaccgggtttcatcatgttggccagactggtctcgaactcctgacctcaggtgatccacctgcctcggattcccaaagtgctgggattacaggcatgcaccaccgcgcccagcccttttcttccatcttattcttttctttttcaggaaacactattaagcttaaatatttataattattttccttcttttaaaattaggctttacttggctctggctctctttttcttttcttctttcttgtctttagacacccaagcctcaattagtaactacgctaactggtagttactgtccctgagattatttcagctaatatttttagttatcaagtataagtcatcaaagagagttaactaaataatctcacaactcctagcctcaaacataatttttaactcatttttaaaggaggccttttatcaagttacattcacagctctgcaaattacacacacacacacacacacacaaacacacacgtactaacactctcattctactcccttctttatatttcttagcagagtggcatgaaataaaacagccttcattttgcacattcttcttttccattttatgtatgtataaacatggcctgaaagattcattttaaaacaatattgtggttagtaatacaaacatgtaacacattacatgttcgaaaaaatattttagattctattatgtataataataaaaaaccctcaaagaaagatgaaggaatgagaatgtgaggaatattcataaaggataatatgcctgaggaatagtgttcctttagcacttgtaagaataaacatactgtataaaaacttttgttcctttttaacatttttgaaagaaagtcaaacctactttacagtaaaatacttggtaagtgagttagaaaaatgatctttttctcagtgagaagtgctattctgtggcattttgaaaaataatcttacttctgctccactgaagaaatctggttattaaaagagttattccttttataaaatcaaaatctgcatgtggcaatttttattcattgatatggctctcttctcaaaacacaaagaacaaatctaacttttcactcaaaaattaatcttaaagacacaatttatgctcttcctgtaagcagcctgagatgatctcttaaaatggtttactattcacttgacccagaacaacccaaaaaatcattcaaatcaagagattgaaatcttcgtgttcactttaagaacatccatgaagctacccaggcaatcaagggttatgtatatctgaaaagccaccaagtatctgaaagatgtgactttacagaagcagtgtgtgccgttccatcattgcaatggtggagctggtagatgtgtccaaagccaaaccgtggagctggacagagggtttatggccccaaaagagtgctgaaagtttgttgcacatgcatacaaatgtaaaaagcagtgctgatcttaaaggtttgtatgtagagtctcttgatcattgtgtacatctaggtgggcgaagcacccaagatacactggctctgtttacagggctcatggtcagattaacccatacgtgacctccacccccactatcgcacccaccgcactgaaatgatgcttactgaaatagaacaaatttttctaagccagaggaggaggttgcatagaagaaaaaggtattccagaagaaaccgaagaaacaaaaataatgacccaggaataatttcaatataaaatatatgcaaataaaatcaaaagtagaaaaaagacaatcaaaattttaaagagcatggaagctcaattaaaatagaggagagaaccgggcacaatggctcacgcctgtaatcccagcacttcgggaggctgaggcgagtgcatcaggaggtcaggagattgagaccatcctggctaacacggtgaaaccccgtcttactaaaaatacaaaaaattagccaggcgtggtggcgggcgcctgtagtcccagctactcgggaggctgaggcaggagaatggcgtgaacccgggaggcggagcttgcagtgagccgagatcgcgccactgcactccaacctggacaacagagcaagactccatctcaaaaaaaaaaaaaaaaggaggaaagatcagatacgtgaaaaatgattcaagctctgtgttgaataaagtcacattaaaatcacagaaaggtactgttgttagacaatgtttaacacctattaaaacatacacaaatttaaataatagtgatgatacacaaagcctgggacagtttcatgaaattgtctttcatatggcggttcatagaacaaagtagtacaaattttctggaaacaattttctagacactataagaaccattaaaaacgtgatccagtgatctattccttgaaatgtactgtcaaaaaatccagaagagggacaaatttaaatgctccaaggtgtctttgaaatctgaagcataataccaaaaatattaaaaccacctgaattctagtgttttatcgggaaatggccatgtaatataaatgcaatgtctttatgctttaaccaagagaaatcatcttcaattatttaaaattacaattttaaaagctagtagcagcacagaaaaggtttacattttctatgattccaattatatgaaaagtgttaatttctgtagtgcagacacatatatccaaatgaaatacaattgatttattacaaattggggtggggatgtgcaattttttatgtgtgtcatcattgttatatcatttgtgattttaaataatgaaaaactcagattgggggaaaataacttctcaggagaaagcagttgtggtagatagagagcatattaaaagcttccaccaaaacaaattcttacgtgcattgaagaaaaaatattattttcaaaatataaccatataaaaatgattatcttggccatttaaaaagagtcttaatttattacatgaagcctttaagggtccaggtggtatacctggaatctttcttttgttaggttacactgtaaactctgctactgcttcttctggagatgtgctctatattgctggacagcctcggtacaatcatacaggccaggtcattatctacaggatggaagatggaaacatcaaaattctccagaygctcagtggagaacaggtaaacttgaaaaatattcttttatttaaattaatctattcatactctatgtatatttactgtctattgtcctaaacttaaaaatgcaatacccacatattcagtaacaactgggaacagggccctgtgttaggttctttggaaggatgtatagtgtctgtatctttgtcttcatgttggatgggtgtrgaggtaagatatacaatagatgtggatacagatgtacaaatatatacacaagaaaagagatccaaaacattaagaggcatgaaattaccagtggcccagacaatacagtcagaatatgatgggattgctttaagctaggattggtgcagaaaagcttattagaagatgaaattcgggctgaatctacaagggatgatagaatgtggataggtagaaagagcagtgaaagagaaagttaaaaagataacatggacccatatgatgtgaggttttgaatggcaaattaagagcttggattttatcctggaggtaatgggaaattgtctgtaatatttaaaattgaaaaattcttattaggtagtattgaatattaaaagaagtttgggaaatgatacatgaaataacatttacatatgtatatataaaaactgaaagaaacatcgtaaatatgcaaacatttacacacacacrtattaactgaaagaaagatctaacatgctttttgttgttgttatttttgaattgtgatagcttgggaacttttgtttctaaaaagttttctgtatttttcaacagttctacaaggaggatttattaactttattccacagtccttttacagagggtgggagaggggttcttcttagccttcactaaatattccaactctctagactagaggggcaggactgcatcagccctcctgctctgcaagagtccaagctgcagcccagcgcagcagtaaagctcaggtgcagggatactcacattaggcaggtccacaaactgcactcgctttaaagccccatgccctgcaggagcagtatcttttatgacaacaccatagacatagcttccagggtgtctacaaagggcaggccggctacaagagtaactgcactctgggaagtcaaaaatatgtcatcttcatcaggtacttataattcatttatagttccacacagcctgaatacaatattccagtaagaggttatttttacccctgtcagcgttgcttagccttagtggtaaagttgaaatcccagccacagcagattcccagggcaacagagttagagtagctaaaggtcagctcctcaagtatcaggtgaaagggttttattaactctttgcccacatttacgcttggaaaacgcataacagttagaawaaggctattgttgtagctcaaactggaggtaagagaacgtaaaataagatgtcagcagtaaaaatggaaaaggaagggccatgacagatatcaataataggaagttgacaatagtaaaatgaagcattttagatgaygtctttgatccattatcactccattaattgtatacaagacaagaagtgtcaaattttatgaaaatttgcatatgaaagttgaggagagtatcatgaawgatttaaatcgtgaatgatttcagtttcaagcctgggaatctgaaagaaaggtggctccatgattagaatgtcaacacctcaagcaatttagatattttttaacaatgacgtttggcttttagacatgttccttgtaacagtaagcacaaattcagatatttgaaggtgccagtaaagtaaaatcaaaataggtaaagtcaatgagtaaagctgctgggcaaaaaaacacaggaagtggtgggaaccatggccctgggcagcttgtgagcttccactgagctccagttgacggttgccatgtggggaggaaagcccagagttgcaagatcttctattttatttatgtttataattaattcaacttttaaaaaaacctctcaaggccctcaaaagcctgtgagaaaagtgcattcaaaagtcagtgtcttttgcccacatgcctagaagcaatgtctaggactgtagaactgaagccttgagaaggaagacagaatgatgtttgcaattgccttagtagaaatttttaagaaggattggtcatctagggtaagagaatggaaaaaggctacaggtctgagctttagaagaggccaaaattcagaaaatgagagttggggaagaagccagtaaatatgaaaagggtggtctatgccacaggggcagaagcaagagagtaagagtaaaattgcagaagccagtacagggagatgtaccataagataattgttaagagcatcaaatattaaacatagaataatatttgaaaaaattaagcatttaggtaatgaagtataagttctctgcttttctctaaacagatttctatctttaaatgagaaaacatattgctacaagggatgatacccctgcaatccttccatatttttctatgtcccatagctgctgggataaggcttaaccatttcattgagaagacaatcttccaagactatgaggtgaaatatgccacaccagtattccaggacaactcagctccttataatgtatttaaacatatattcagccattgcagcatgcattctactgcttatctaattttatttccttaaaaaatcactatagtattactgaccttttctgatttgtggagaagaaagagaggttagagtgaaatctaaagaaattcattttgttactgtcaagcgatgaaatctgtaacagctgttcatcctcaaagatggaaccgactgatattctttatcctcatgaaagagccaataaataactttcagggagcatcaatttttatctttcatttcctttgccaactagctcctcttctagattgctagamgtaaaacaaatgtagatttcagtttccttgagaatttctgttgttcattgggctgttttgtttcattttgtgtcctagattggttcctactttggcagtattttaacaacaactgacattgacaaggattctaatactgacattcttctagtcggagcccctatgtacatgggaacagagaaggaggagcaaggaaaagtgtatgtgtatgctctcaatcaggtaatggtgtctgagtttggtagaaatccaggaaaatctcttccttctcttcattttttaataataaattcyaatttttcactcactttgaaaaaacagagcaaagaagctatcaggattcattcactccaccaacccctcagttttgaaatgaccatttataattctaataaagtagctccaactcttagatattttctgcttggaaatgtgaattatgtttaacaatatataggataaaggaggtaaatataaatctcactaaactgctaaataaacccacaaggcttatttaggctgggaggcttatcagctctggcttggagatagataataacctcagcagttaaatcggatagggtggagggggagaagtcatgagtttcaaggcagcaacactgcaggcttccaggaaatacttcactgggctggagtgagattttgtcttctgttcctgactttagacatcattttttaagttaaataatttttaatttcttcattagaagagtgttttgctctttatagcaaagccagtgtttatctatttagcttttccaaatatgtacattctctcctaaattgattattttaaataataaatcatgtgtctttcttcctatcattttttggcttcctcctgtcaactttttttgtcctgggctgttttgtcctttttccaagaaagtgtattcttgattacctttgctagtactttctgtctgggttttttttttttttccttccactctaggcagctttagagaaagtttcctttctgagcagaataaattttcgctttgcacaatattgggtgaagaagggatagtggcacaaattaaggatataatattatttggcctgaaaaagatgctctgaattgtatactcaattgcattaaaaagagattccattaaartatgtctcccacacttctaccatctgctctttggaatccctaactttactctcagataggcacactttttaagaaattttaccaactttaccactaatgtacaaatggctgttaatagcactgatttagtatactttaaaaattctactctgctgtagtaatgatggaaatacataaatatcctgtttatctttcttccagacaaggtttgaatatcaaatgagcctggaacctattaagcagacgtgctgttcatctcggcagcacaattcatgcacaacagaaaacaaaaatgagccatgcggggctcgttttggaactgcaattgctgctgtaaaagacctcaatcttgatggatttaatgacatcgtgataggagctccgctggaagatgatcacgggggagctgtgtacatttatcatggaagtggcaagactataaggaaagagtatgcacaagtaagaattgaaacctacagattcccacccttcagtgataagtcggttcaatgccaggcattacctgtctaacttcatgagttatttaatttcttcctcctgaccttattgggaaactggatttaattctctttaagtgttttttatagattagttactatatatatatacacacacaaacaaactataaatatacacatagtatgtatatagtatatatagtgtatatataatgtgtatatagtatatatatatacacactatatatactatatacacactatatactatatatggtatatatagtgtgtatatagtatgtatagtgttccttatagattaattactatatatacacactatatatacaaatagtataaatatatagtatatatagtgtatatgtagtgtgcatatggtatatatagtgtatatatacacactatatatagtatatatggtatgtatactatatatagtatatacggtatgtatactatatatagtatatatggtatgtatactgtatatagtatatacactatatatactatatatagtatgtatactatatatagtatgtatactgtatatactatatatagtatgtatactgtatatactatatatactatacatagtgtatatagtgtatatatagtatatatagtgtatatatagtgtatatatagtatatagtgtatatatagtktatatattgtatatagtgtatatatagtgtatatagagtacatattgtatatatagtgtacatatagtatatataatatatagtgtatatatagtrtatgtagtgtatatatagtatatacagtgtatatatagtatatgtagtgtatatatagtatatacagtgtatatatagtatatagtgtatatatagtgtatatagtgtatatatagtatatagtgtatatatagtgtatatagtgagtatatagtatatatagtgtatatatagtatatagtgtatatacactatatagatactatatatagtatagatacactatatatagtgtatctagtatatagatacactatatatagtatatatagtagatacactatatatagtatatatatctatatattagatacatatactatatatagtgtatctactatatatactatatatatagtgtatctactatatatactatatatatagtgtatctactatatatactatatatagtgtatctactatatatactatacatatagtgtatctactatatatactatacatatagtgtatctactatatatactatacatatagtgtatctactatatatactatacatatagtgtatctactatatatactatatatatagtgtatctactatatatactatatatggtgtatctactatatatactatatatggtgtatctatatacacacactatatatagtatatagatacactatatatagcatatctaatatatagatatatatattatatatatagtgtatctactatatatactatatatactatatatagtgtatctactatatatactatatgtatagtgtgtatctactatatatactatatgtatagtgtgtatctactatatatactatatatggtgtacctatatacacacactatatatagtatatagatacactatatatagcrtatctagtatatagatacactatatatagcgtatctagtatatagatatgctatatatagcgtatctagtatatagatacgctatatatagtgtatctagtatatagatatgatatatatactgtatctagtgtatctacaatatatattatatatagtgtatctactatatactatatatattatctatatactatatatctactatatactatatatttcatatatagtgtatccagtatatgtattatatatagtgtatccagtatatgtattatatatagtgtatccagtgtatgtattatatatagtgtatccactataggtattatatatagtgtatccactataggtattatatatagtgtatccagtatatgtattatatatagtgtatccactataggtattatatatagtgtatccactataggtattatatatagtgtatccactataggtattatatatagtgtatccactataggtattatatatagtgtatccactatatattatatatagtgtatctatatactagatacactatatatagtgtatctataaactatatatagtgtgtgtatatagatacactatatatatagtgtgtgtgtgtgtgtgtgtgtgtatatatatatatatattttttttttgagacggagtctcgctctgtcgcccaggctagactgcagtggcacgatctcagcttactgcacgctccacctcccaggttcacaccattctcctgctttagtctcccgaggaactgggactacaggctcccgccaccacgcccggctaattttttgcatttttagtagagacggggtttcaccgtgttagccaggatggttttgatctcctgacttcgtgatccgcccacctcggcctcccaaagtgttgggattacaggcgtgagccaccgtgcctggccgtaattactttatattttatacatttatctagtttcctttctgttgttattttccatatctccaggatttgactttttgaaacagttaaaaaaaagaatactttgtaacaatgctgtttaacatctgttaaatttagaatgggacatttagtgtgtcccgttctaaatagagggcactgctttctgaataaggcaaaaataattgtatgacttaaccaataaaggaaattagattcttgattttatatttaatgtccatgctgttataataaattgcattaaatttatatttatccattaagttgatatattttcgtcaagtgaattacgatttctaaaggtttataattttctcgcaagtaatccttagaaaaaataaatctgaatattaagtttaagctgcagggaacttctgttattcctgtttgtaatttgttgtcagttaacagctctaatccataagtgtattttttttccttcattagaaaaataacaagttacaaaagtgcttaatgcactacactataaaaacaaaagaatttaaaggagtttgaatgtaattgtctgctctcaagtaatcatagttggttagatattgaacaactacttacaaataaaacagaattcactaccttctagcttatataatttgaaaagaaatyagaatattaattatttcattttctatttgagtgttctctttggttctgtagtcaacagagctctcaaaatctattcatgtaatgcaaacatgagtgatttttcataaaaccataatgacaatagtgaacagaataaagggcttatttcaataagagcacttgtatccatttgataaataatttgtttctgttgaaaatctttatggcattatttacttaacaagagacaggcaatattaatgactggggcatgatggaattaggaaatgcaggaagagagttctttcttatattctaatactttattccttcagcatcaatcctgtaaatttaatggggtagcatttgaagtagaaaaggaaagctaaatcattgtcagatgaaatagatttgtcataaacaacttgttttctaaatggtggtaartcaagatgcaactttaaacaaaaacaacaaaaagaatattagagttggatttgtttaattactggcaaaatgtttttccaaggaataggtgaagatgtgcttactcatttccatgagaaccagagatgctgcttatgtatgggataatccagaatcaatcaagcccatagaaccaaggagtcagatatctcctgaattcttcacttaaaaaaatgaggaggattgctgggtgcggtggctcatgcctgtaatcccagcactttgggaggccgaggcaggcggatcatgaggccaggagttcgagaccagcctggccaatggtgaaaccccgtctctactaaaaatacaaaaaattagccgggcatggtggcgcgcacctgtaatcccagctattcgggaggcagaggcaggagaatcacttgaacctgggaagtgaaggttgcagtgagccgagatagcgtctcaaaaaaaaaaagggggggaaatactttcaaacgagcctcacctgtttaaggatgaaaaatgtttccatttggtttgccttagtaggcttcttattttatgttatttatgtggaaaacaagaggctcagaagacttgaagtttagggagggtttgtaagtcctgactgcttgccatgggcttctgttaaaagcattagcttaagcttgaaccaatgctaagtcaggaagtacagatatcaaacatactatgtatggtaatgtgcacagatcagtcttcaagacatactcatttgtgccatctcaacgttgtgaatacatctgagtggaattgagtctcttgtgccctcaacttttaggacaatttttgaaagacagtagagattacatattggaaaatgtatttgatgggatgtgttatttatacccagccacaaagttcagtgaactccaaattgacccctaggacaatattatactcccctcccccctttgctgatatgatatgttttcaagatttccagtacctttagatatgtctgtgtgatgggattggctaggaagcagaaagcacagaaccaattactcatactgtttcctttgaggattagacacaatgacactatataatttttccctctctctggtgtcagtgaccttgtaatgattttgtctgtactataaaaacagcaatatcctctgggaacatctgagtatttcctcttatctccacatgagggacctcttgggcggattcccaaattaacaaaactgattattttgttaaacaatttaaattctcagatttatttgaaactgttttgaacagactcttctcatatgaaactcttttttttggattctcacagcgtattccatcaggtggggatggtaagacactgaaattttttggccagtctatccacggagaaatggatttaaatggtgacggtctgacagatgtgactattgggggccttggtggtgctgccctcttctggtatgtattttaataacatcctgttaatctgagactgggtcacttgcagagctcccagtgtgattggagctcatgtcataccaaatatctatttccttttgtgttccactatgcaaatacaagttattcagttgagtgagctggaagagtcaatacatcttaagaacaaagaagctatatgaaagaaacaagtagaatgaactcttaatttggtgtgtctattatgtggtttacactaaaataggtattctgttttaggagaggtataggggaagagaagatcttatagaggatgtatataaacaagaaaatatccctaatatttggttgcttacaaggttttagagataatcgactttgtattcatttacctgatacatagaaacagataatcgcgtagcactctctgactctgtttatattgttggtcaagcctagaggcatcttaagtaatatcttygctcagcctttaaaatgcctaaatccccaaattggcccagttctttcagatacatacattcataatgctttattaattatgaataaataataatttagtaggcaaaaataattattgcttactaaatatcctatctcaaaaactaaatatcctatttcaaaaactgttctgtttgaaagaaattactaggaagtcaagaatcaacttaatgagaaatccacatgataattttgaaaaatatataataaatttcattaagaaatataaaggaagggtttcataaataaaatctatttatgccaggtgactttatgggaagtcygcatgttgattctcctaaattaatgcattggtttactgtaattcgggtggaaacatacatcaatgctctttttcccaaaaatctacctagaagagtaataaagtataaaagaaaggtgaagatagagaggtgaaaatagatgactttgctataatttaagataatgcttaagaactaatggtcaaattaaaatggtrcagtaaattgtgcacatacaataatcactatttaaaaaaaaaacctttacaatagaggggaaagaagactgaagggtgatacctaagaaaagggaatattaggcagcacagtggctgggactttggggaggactcaccagaagccaaggctcaaaaccagaagtcagcagtgtcagggacaatggatatacttcaattttgtttgaaatgttaatcctgaattagtttattatgctccctttagctcacaaatatttattgtattaattctcatattaaaaatatgttttcagggtttttatgctccagttttgtttcaaggctttcttgcaaagctttgcaaacttatttatggcctctcctgccccaaatcaaggcattgatggcccaaaatgatagtcatttccctatcatagtccaggctccactgacagcagaatggaccaaaycgatatactgggacacgaagactaagattcacaatgcctaacaagaagtgagagtggatacaagtgacagatgataggaaaaacgtttggaagcaaatagtgagagtcttgtcatgagacctggactgactcccaagaaagatctggctggggcagagaggatgtgtggggtggacaatggtcgaggcagcttcatgcctggagaatccatattactaagcaggaaactaggcatgttcattcattgctgatgaaagggtaaactggctaaaactcattcgaaggtctttatcaataagtgtttaaaagcattccaatgttcctactttttaccaaggatttaacttcctaaaaatgtaaagatacaatctagaagtacaattaaaggtgtcatcacagcactgtatgtaataccatcttttaataatgttaaatttaccactatactcagaaaccttttttttaaattaagctaaatatccaatgagatgggattgaatgcatagattatggtatgtgcatatgctggtatagtctgcttccattaaaaataataaatcccattaaaaataatgttctcagaaaaatgtaaatattggaaagctgttcattgtaatataatgttttaaaaatttgtaggcatacatatgaagatgtgcttttgtatatatgtatgtatgcatgtgtgtacgtgtatgcatgttttcttctgtaaagaaaaaaccactgagtgtactaaatgttaatgatgattattgctgagtggtagtataacaagttatttgtgttttctttatgcatttctatgatgtttatattttctatgagtccattgttttaacagaaaaaagaaaaccacctttttttaatgcaaaagcataagtagtgacctcattattcacaacatacacagttataaggggctagctctggccacaaggcagaaaccaggtaaaaatgtgcagtaattgttccggcttggatctaagacaatgacctcagwatccatatattctccatgtctgagatcttactctgatctcattttggattagtagacattactgggctttcgagttaaaacgactgagtttaaaatcccaggtttttcctcttaatagcttttgacctggcataaaatatttaacttttcagagccccagttatcaaacgtaaaacaaaaaaatgatgttgcttataattaaccttaagaattaaatgaaatagcatccatgtctagcacaatgcctcaaatgttattttgcttttccttcctagaaatagaggaagagctgaactcacaaggacagacaatattacagtccagacaagagatagcaggggyctacgggctgttcagggacctttagacttctttcaaatttggaacaaactcgtaaatccccaaaatacagttgattctggggtttcacctggacacttgattccatctcttttccatcacaggaaaaactagatctttggtgtttgaaccaaaagccccaaatggtttccaaatataacctacatgtcttagaacatcagatataatctcttctgtaacaatgattaattaaagaaatggagtcctgagcgctgtattatacatgaagcagaaccctcttccatgcactcactttgcactcccaagttgatgacattcattaaatgtaaaaatgtgtgagtaatcccattgtttttgtttgtaggtcccgagatgtggccgtarttaaagtgaccatgaattttgagccaaataaagtgaatattcaaaagaaaaactgccatatggagggaaaggaaacagtatgcataaatgctacagtgtgttttgatgtgaaattaaagtctaaagaagacacgatttatgaagctggtaagcaaaataattatagcaagtacttttgggtagaggacaatatatttgctctagcatgaygaagtccagtargatattgtattttccccacwtggtgagctgcacgtcatatttgcmccagtgaagatgcagaaccttgaaaaaaaattctgttgcaaaaggaataggttatggaacccagtcaattctggagcagaaattacatgtttgtatgcagtgccctcaacactccatagtttctgtctggctctcctacttgctatgtacaatgagacgcttaagaaaaaaataccgattcagaggtagagtttagaaattgagctacaaatgggcccagttttccttcctgtaggtttctaccatgactcttctctcccttctcttgccccctcttgggaaagactgatattgcagagaaccctaatactttaccattcccacatttcygagatcctttgttccattgaggtgaccctagtttccgagagtcagacttgttctgtgtgtgtgttctcaggtgcatcaggtcagcctgtgcttcctcttcctccctccgttctccactttctaaggcagctttttaatgatgttgaaatatgctcgaatcaaagctataaaggccattggctaaagaagagaaatttactctgtaaccaaatacaagcagaatgagaaaagccattaatccttaaaatctgtttttcttgatttgttccatatgtgcatgtatatgctctgaaatagcctcctgactagaaagatcaatgaggtataagaayataaaataatgattttgagttttatatgtaactttatttcagtcttatttaatttttgcaaagtaattaagtgatcaaataaggaatattgtagccttcatatacagtgtaagatttcatttattttctttattgtggtatgcttattttattgaaccttaatagtggtttgaccataagctgagataatgtcattttatatataaatagattaaaatgtatatatttgtaaataaataactaaagtatatttttgtccctattgaaatataacataatcaatattctaagcagggttccaacatttctaaacttaaaaagaatgttttaagtgaaaatataataaatacagtggtggcctggcaattagatgataggcaggtgtgcatgtgtgtataagaattataaacaataaatgtaattagacactgaaagcacagtgaactcagagaccagttctatagagttcctcaaggttatcttcatgactgctaatatcattgttataacagtgtggatatgctgaacaatagaatcttttttgattgattgccaaagagatttttctataatgctaatttaataatctgtacaatatgagaatcacttcaaataaacatttccatcaattattttttraaatttttgtagatttgcagtaccgtgtcaccctagattcactaagacaaatatcacgaagttttttctctggaactcaagagagaarggttcaaaggaacatcacagttcgaaaatcagaatgcactaagcactccttctacatgttggcaagtaaatcatatatcgttgctgccttattccaaatcaagaatacagtagagatgtcttatttcaagtcaatcaaattcttactgttttatttcaaaatgcacttatgatgtcataaaggaaatcttgtttgttcatttttatcataaaatcgcaggtctaattttctcatttccaaatatttgtaaaactatctctagtcttccctgtctgcattatcagacatccatatattatggaacggcaggaaaagacacagtgttctagttgacaagaaaccttattcatgtcttcatttctttcactcattcatttattccttcaacttgaaaacatttaatttctgtgggccttgtctgtcagttgtggttggtaagtgattaactgctctgggggcagactgctgggctgtatgctttctgggatccatgtaactacatatctcgccgtttgattttagagcgaaggggaaaattatctggtattttctatcatctgtaggctttgtgctacttcagttttttttttttaattttagtggatgagggagttttggaaatcaaactattaatgtttagagatggctggtaagccagtgtgaatcatttaaaatgtattttgttgggacactgtgtatatggggaatgttcccaacagagggcaggagtttcctaaacattttcttaaaatgtacatgagagtgataaaaacaagaagcagcatgaaggtaatgaggaaactgattttagtaactgacattaagacttagagacttgacggtaaacttggagctttaaaggaaccaggccaattttcctacttctgacttatttctgtattattgatatattcatagtctgtattttgaaaattgtagttcaggggcaggggagtgacagaaaatgtgcacccttttgtgccacatttgttcttcctcagtgattttcatgttgatatgcttcatgatacttatcatgaagcttattctgtcaggaccaagatcaatctattatttggtaaaataacactggagttgcccctcctatttagttaatcagaactgaacacttaggaattagaatgtggataaaatttgaatgggtatgaaaccagatatggcattgtctccaacctgctaaaaatcatctcagtctatgtttgtccacaaattcagtgtctaagttatgtccaggtactggtgtttaaaggactgaaatattttcaaaatttcgaaaattgttttggattttgaaagaagcactttgaaatttgttctggagtcagccagtgtagaatttgtatcccaaatattccacattctgagagactttggcaacgtcgtttggtctcttagagggtcaatctttcatctgtaaaataaggacaataatagttactcatcttagaggactgttgaaataatttgcaataatgtatataaagctcataattttgaatactataaatgattattgttattggtggcatgttaacagtattaatcatattcacatcctttccaaataattttacattataaaattcttggccaggcatggtggctcacgcctgtaatcccagcactttgggaggctgaggtgagtggatcacctgaggtcaggagttcgagaccagcctggccaacgtggtgaaaccccgtctctactaaaaacacaaaaattagctgggtgtggtggcacatgcctgtaatcccagctagtcgggagctgaggcaggagaatcacttgaacctgggaagtggaggttgcagtgagccgagatcgtgccgctgtactccagcctgggtgacagagagagactctgtctcaaacaaacaaacaaacaaacaaamaaaaacttatagctgtaggtatatattatattaatgaaatgtaactcattttatagaaagtttgcccttctgaagttgggaaatgttcccggaagtgttacataatgatctttggcttgaggtctcaagaaaaactatattgtgatgcaggtagctcctatgttgacacagccargtgtgatgttgccatcactccagcagggccctctgaggaactggaagtgagtcaacaggtcatactctgaaacctccacattcccctatgccccttgtcagaatgccaatccctctccagggaagcaaaagcctgatgagatcatatgtcagattagatgcacaagaatgctgcagtaagcctgacccttgggaacagaagaaggagacataacaagatcagaacacccggtaaatatgataccagtgatatattttatgtttcaccctctaggacaagcatgactttcaggactctgtgagaataacgttggactttaatcttaccgatccagaaaatgggcctgttcttgatgattctytaccaaactcagtacatgaatatgtaagtcagatttctttaaaatacaaaataccaacttgtgaacattttaatgtcactagtaaactgtgttttttcactactctgcattgatcacaaagaacgaacaactaactggaagaaagaaaaaaaaggcaagcagattttattcctggtcaggaatggagaaagagggagctcttgctctraagaccttctcttcaagctgtgaaaacctggggaattttaaggagttagatgtggggcagggaggtatatgtaagcatgtccagagaggaactccagatgtacaagtacagctcataaacatgcttccttatacaacatatgttcaagaaatggtggccattttcttctatggcagggactttagcattataatgacatgttaatgatctaaaggtaacaaggggttgctggttcttgtttgctccgttttctcaatggctttatcttcctctggtaattggcaaagggtcctgaagctyccaggccgtctrtagttgtttttcagcaagcttacctacagataaatagactagaaaaaaaaaaactgtttaagaaaaaataatgcactttctcagctatctactgtttaacaaaataatgaactttctcagttatctactcttcaagaaaatagtaaactttctcagccatatctccaggtttgccctggtaacattaggaaaaagcttgaaacccatgcacacataaccctaaatcaatttaaaatgttttaaaaaagaattaggctcttctagactttttccaatccttctaatttcctattgttggagtttaagaaaactaataaatgacactcatttttacctcatttgaatttaggaccaatggaaagaaatctcccccattattctaataagcactggattgcagtgtatggtttaggtataaagggtgtcctcacrctgaagcatggacttagaccaccagtaaccacctaggtcatcagcagtgctgatccatctctgtccttcttcatggagcccaccttgtaaaacttgtcaaatggagtagagccaaatgtgtgcttcctgtgggtacagctgctctgagaatagaaatgagagaaagggactgagttgtgttcacttagttcctgttcccaaagttagagtccatgtgccacccctgagagtggagtgaggggagagaagagggagggtgtcactagcgtggctccaatggaagagatatgagggatggggaattctttttccccatacacctatcttccattctcccttccttcctaccagatatattgattgtcttatacataccaggcattggagcttacagtcttaacactggaaacaggtattaagtagtaattagagcatatgctatggaggaggatttcagagctctctaggaacttccacctaggctgagaagtcaggacagccctcctgaagttgtgccatttcagtggagccctgaaggatagggtgatttccaccctatttaggggagtttggggagcagaggggatgctaagtgtgaaagtcctgagcatgaaggaaacaacgacattcgctagtgtggctgacgctaaagagcaagaaaggaggtgacgtgaggtgaggccrgaggtaaaggcaggggccgggtcattcgggacttggtgccactgcacaaattctaaacttttgaaagagcagtgcagtgcttttgaaggtttttatttggttcagccacacgacaggatgcagcagagtgaagagtggttggagggaaacaggtggatgtgggagccccgtgggaagctattactttagttcagggaggaaatgagaatgcttgggtgtgaggtggtggtgggactgcagaagcaagaaaggattrgagagatatttagaagaggagtagaatggrcagggcttggtgagttacatatggtggtggtggagaggcggtcaatgaagaagaatcaagcaaaactcctagatttgtggcttgaccgttttccaccctctcaactgagctttatgatattcctaagyatttgattaattttaagagaaaaatctcatgattagagttgagtagatttagatcttgcagtacttgactttgtatttcaaaactgtccttccctggcagacaaaagccagtgcaaagcacccatgaaaattgtgcgttcttaaaaggacaagcacaatttacatttgtaagtaaatgtttactcttctcccctataaattacagggataaatataaaatcccttaagatttttgcagggaaattctccttatgagttgcttaacttaytttggctgtatgccatttttgttacacaaattgatgggyaattttcaacaatgcrtagctaaattttgaaaaattctttcctgtcatcatttcagattccctttgccaaagattgtggaaataaggaaaaatgtatctcagacctcagcctgcatgtcgccaccactgaaaaggacctgctgattgtccgatcccagaatgataagttcaacgttagcctcacagtcaaaaatacaaaggacagtgcctataacaccaggacaatagtgcattattctccaaatctagttttttcaggaattgaggtaaacttccagtttttcatttatttgttctcttaacatcatttacctggcctacttttcatgctactgagataattgcttttattagattgattttgaaagaatagaaggaattttttacattagtcctcaccaatggtgaaagtattaagctttttaaaaaagttttgytttatttattcaaatatgtatgtcttttcttagattctgtgtgagaaaaggatagctcatgtataaaaactgtrtgtttcataaaatccttaaaccactgaaactgaaacagagtcaaggaaaataataacaatcaaagccaaaacagttaacagacgtacagagaggtacctctgtgttaagcaaaaaaaatttacctgcaggaaaatcaagataccatatctccctttctatgcaaaatccttactttggcaagatatttgtattaaataactgtgtcttattgatttgtaacagaggtttcttttattacattggcaataaaatatattaatctgtgtaagatgctatatcagaggtaatcagtgtttccaaatgtgaactttgctcttaattctgatctccaaatgaatcccactgagttaaaattttgtgtatatttatattaattaatattacatacaatttatattaaaagcaatgcacttattaatattatacatagtattaaaacactattgtctactttctgtaaactcagatttcatggacgtttctctctatctgttaggatatcacttagagacatgatgactaagacaaacctaaaaataatgtcatatattactatattttggattcaactaagaatattaattacaggctgggcatggtggctcatgcctgtaatcccagcactttgggagaccgaggcgggcaaatcacggggtcaggagatcgagaccatccaggctaacacggtgaaaccccctctctactaaaaatacaaaaaattagcaaggcatggtggcacgcacctgtagtcccagctactcaggaggctgaggcaggagaatcacttgaacccgggaggtggaggttgcagtgagccgagattgcaccactgcactccagcctggtgacagagggagaacaagactctgtctcaaaaaattattattattattattattataaatacaaatgtacaaagtaatcttggggaaaatattaccacaraatttttctctagtaaaaattattgcctgtatcctcctatgctgacttaatggcctggcagagaggcatagctaaaaaatctgacagtgcatctcttctgtgtatattaacagtaacaacagtaataatgatggcaaccatttcttgagtcacatcatggtttaggccctgtactaaggatttcacttatttcattttcattaattcttttgtaagtaggtatgactgtactgcagagatgcraagataaaacctttttwtcatgtttcaacattcttgtaattgcattttacaattgataacatgtttatttacgtggcagtgttatttttacttcttatgggtatgtaaaaataatggcatatctcatgttcaatggcattttaaactggaaaaaatagagtatatgactaaaccacttgatagaaaatcagtcccagagaggtgaggaatcttaacaaggataaagctaacagtggtgcagycagggtttaaattctggtggtcacgggtcagagcctatgctcttatccactgcactaaactcctccaatgactagcattcactgaagactgctctgcaccagtcttgggtgtctggattattttatccagccaccgcaatcactctgtgagggaggtgctattagtacttccattttacaactgaaaacttaggtaggattgtgagatatgctttgtctttcaggcacccacaagtgatgttttaggatttccatgagtgtagaacagctggtcccagaattctgtgcctcttccagctaaatcgagacaaaaatagtggcaaggcagtcaccaagacacatctgggaaaattctgraagaacacgtatcaatatttcacctgcttgtccactctgattctgtttgctttctcttcctaggctatccaaaaagacagttgtgaatctaatcataatatcacatgtaaagttggatatcccttcctgagaagaggagagatggtgagcagatcatacaaaatacatgtagaaattgaatatgaaaagtaatatgtgcaaagacaaatatataaatccttccaatggtagtttaggataatacggatgaaaaatgttcagttcaaaattgtgacagattggaatatgctatggtcagaatgtttgtgccccaccaaaattcatatgttaatacttaatccccaatgtkatcgtagtaaaagatgaggcctttaggaggtcagtaggtccagagggtggagcccccatgagggattagtgtcctcataagagaggcttgagggagactgctcaccccttctaccatgtcagaacacatagcaggtgccatctatgagaactgggtgtttccagacactgaatctgttggtgccttgatcttggacttcccaaccctcagaactgtgagcaatatatttctgttatttataaaatgcttggtataaggtattttgtacaaggtatttataaataacagaaacatatttaacaaccttgtaacaattcttacacaggcaaactcgaacaccaagacaagatttaaaatttatactacataacatatctaatttatactacataacatatctgataaaatggagctgggaaattctgttattggagtctcctaggtagtaggtgtctctggccttcaagaaaaagaatgcttcaaatagattggtttagaacttaatcagaaattctccttccatctctctctttctaaaaaamaattgccttattgagatataattcacgtagcatggagttcactcgttgaaagtgtgtatttcagtgggttttagtatattcaccaaattataaattgtacagtcattacgacaattgattttagaacattttcacacaccacaaagaagccacgtatgcattggcagtcactctgtttttcctcaacagcctttctcccaagcccaggcaaccactaacctgctttctttttctatggaacaaattgaatttccaaatatcaattgacttttattggcaattctagaatcaggcaacaccttattctgtaaaataaaatgaatggtggatgagctgaggagaggaagttgactttatagagagaaaagggctgaagaaagcagaaacagaacraaaagttgattggtcatttcaaagttattttccttgtaaaagtgaaagcagaggggattttcttatcatgctgtttgaaactggcttgattggggatttggtgattatctctcacttttctcatctcccaaaaagtcagacaaatgacttaatttcggctttgtggtgtggaacttaagcattatttagtctgttgggcctagagcaagagctgtccaaaccaatgacctcctatatgttttacttaacatgtttcttagtctattctggctgctataactaaatactataaactgagtagcttaaaagccagaagtttatttctcacagttctggaagctgggaagtccaaagtaaacacactggtagatctagtgtctggtgagggcccatttcatgcttcatagaagatgtcttttcaatgcatcctgagatagcagaaccaggaaggcagcattctgagttacaagggtactaatcccactcatgagggctctgcccttatgatctcatcacctgcccaaaggccccatctcctaatatcatcacattagtgtttaggtttcaacacatgaattttgaggggaaacattcacattatagcaatatgtaaaacatggtagacattcacattgaaaaagaatatgtatattatatgttattctatctattttgagatacaataaggtttcattttgtaagacaatgtttctcaaataacttcataatttgagtttaggtaatgtcatttatggaaattgaatattttagtcaaagtaaatttcttatctgttactaaagacatatttttattttataggtaactttcaaaatattgtttcagtttaacacatcctatctcatggaaaatgtgaccatttatttaagtgcaacaaggttggtttacatgtgtataaatgtatgtatatgaatgtatattgcttcttctgtgtatgtcgaatattttgctctataaactcactgacagtttcttccaggttgtaggagatcagtagaagtggaaggcaattaaccactttgcttcacaaaaacacccttaagaataattagcaaaataaagaaattttcatttaatagaaataattcacctagattaaagcaatggttctatgagctatagaagataccataatcacacatcatttatatctgccaaattgcatttaaattcataaaaaatttactgataatttaaaaactttcactggctgcccatcaaggtcaaatgaatcattagatggacttaaagttttatgatatccttttgtaatttaatatactttattcaaatcagtcagtacttctgaaaggtatcatagaacacacagactaacaacagcaaaggctcaataaggaaagtgaaatagtggtctaactttcttctaattgtaattatccactgacctgtctgcagtgagatggtgtcttttactgttttattcacagtgactagcattgtgcctgccatattataatcactacatagatgtagacgaaatgaataaattagagaaatgaattaatggattaattaattctgtatgttcaagtcaactcaacaaatatttatttgacatctattatgcacaagatattgagttagtcactgtaaggaatataaaaattactaagggcatgaaactcctcatagggtaagtattacagtagggggttgagtctagtataaaattattgtaacctgggatagaataaaaacactccattatagagatagaaagctttgtcagaaaattaatagaagctgaaataatatctacttggcaatgggaacccaagaaagctttatcaaggaacttataattgagaaagaccttgaagggtagatagcatttcacagagaggtcactgaatagcaccaggtggagcatttcaggcaaaatatatagcttgattaaaaaggttatcaattttagctgaaatataaagaatacataaagtagcaatgaaaataaacagggagtgtgcattctatcatattacgctaggtactgaatgtcagtcaaggtattatttcttaattgaacagaccttgaaaagccagtaaagtttttgagaggtaaagtcatctgtacagagctgctgcttatggagatgaatttaggaaggctgcagtgtggaatgggtgagagaaaaggggaccattcatgctaagagctgagtcacacaaatacctataatccaaggcagcatgctgctttctctgtcctgctgcttatgagccactttatacatttgggaataagcagagccattaaaaagtactcttatgcccattctgtgagacaatatgttaggtgcttggtcagttggtggaggggtatgtgtaaaataataatgaaagctaacacttactgaatatttcctatgtcctaggcacaatcttaagcactttatacttattactaatttaatcatcatttattactcatttgatatcccattttatagatgaagaaaccaaaacaaagacagataagtaatttgaccaaagtgtatcagtgtccaagaacaatctcattctctggccccagagccagtgttcattactcgttatatcatttgtatgtgttttctaatacgaggaagtatgtatatgtgtgtatgcacatatatacatgtgtttacataatatataatttaaatgataaccaaaatcaagagaataaatcagtgyttaacaaayaatatgatcatcaagtacttagtatggaaagactattaaagaagaaaacaaaagaktttagatttactctcagctgtgtgaccctaatcacttatctttactaagtcctcatctgtgataaataagcatcacctgggggcagatatgtggttaaaaacagaaattcctgcaccccaagttggaacccctaaatccatatttctaagggaagcccagtaacctttgtattttaacaattaaactgagggattcttatcaatattgtcatagaattttgaaaaacataaatcagtgtgattgtcaagtctagtcgcacatcagaatcaacttgggaactttcaaccataccaatcatctctgatctccttcttcaccccaattaaaaaaatgattaaaaattatactcttacatgcttttatttagttgccaggataagcktctctttcaaacacttagaaatgtctttaaatagtcaagattttaatggtttgtctgaatgtgccgtgtattttctagtgacagcgaagaacctcctgaaaccctttctgataatgtagtaaacatttctatcccggtaaaatatgaagttggactacagttttacaggtaggagaaaactacatttttatgtggatgcctttctattaacccagtggttctgaaartgtggtccctgcctggccaagggcatcagcatcacctggaaacttgttaggcaaattctctggccccaccagaaacctaccaaatcagaaactcggaggatggggttaaacaagccttccaggtaattctcatgcatcctaatgtttgagaaccattatactaaataacccaaagtgttaggtgttagtgataccggattgcatttgctgtccagtcttaattcccgaatgcaagttgaagacccagaagtccttcgcaaaacacgatattttcttagaggccgccagcatatttcttggtcatcgttctcatcctgtggaagctgatcagtcttctcaatctggacacacaagattaaagcatttctcattgataagagctgtttatttcttccaccattcataaaccattctttctcttaagaacttcttatctatcccaacacaaaccatgttgacaaactttccctctataatttcccctgcttaagcagaactccaagcttttgccaaataaacatgtgcaatatacttaaaaggataagaatcagtggcaagtaggtttattctaaaagtcttatcattttattaattttttaataatagtggctaacatttattgagcctttgtgttctgtcttatgtgatcctcatgataacactatggttcaaatacaactactatctccattttccagttgaagaatttgaggttcagagaggctaatttacccaaggttatatattcaggaagtgttagtttaaaccatttcacatgcttttttttttcttttaatttaaaaactgttttaaattgacacgtaataattgtacatatttataaggcgcttggagacgttgtgatgcaagtaatatatagcaactaaacagggtaattggaacatccattgtctcaaacatttatcttttttttgtattgggaacattcaatatcttctttctggcttaataatttattatctatggcactctctctttactaaatggagactacaaaaatggcatgattataggacatacatgtagattgtgctaatatttctcagcctttaaattctrtctccacttttctgtatttttctgtatccacttctattggtgcactgacttttccccaagagttttccatttacttaaaatcaaattttggcaaacacttataaatattttttgtcttcccttgactgaagtgctgcttaaaaacatactattttactctaccaagttcatscaaagaacatgatgaagctgtgtagagaagattgaacttttaagtttagcagtaaatataggactttaaattatgaaatggtaaaaatttttaatctatttagaattcagcattacattttagtttcatttttcactaggtataaatggtattagtgaatttacagaaacttttcacttgttaaccatgaaattttaacttttaaaactcatattctagcattttggggtcaaataagcatcagtgactattgaactaaattacataatccttctcactctcctcaaagatttaattttacgtttcaaggtaaatgaattcccctatgatttgaaatccctacaagtatttttgtggaattacatgatatggagaaagaaaataatgaggccaaataaaagttaaactttgttatgttttatttttcttctaattaattttttaagctctgcaagtgaataccacatktcaattgctgccaatgagacagtccctgaagttattaattctactgaggacattggaaatgaaattaatatcttctacttggtaagaaattacctctaaaatagtattctaaaggagttatttgtaaatatataaattaaagtattaacagacacataaaaatatgttgcttcaatgtttaatctctatattccagcatattttctttataatttcataaatataaatatagacatataatatataaatataattttcaatttatatttttctttataatttcactgaagatttaaatttgttgtaattatattttcacatcagtttagagatctaagcctctaatttcctcaaaataagataccactagaatgactttctagaaaaaaaaaataaactatgggactagatagatgctaccgataaacctgtagactttacttacattattttatcagtgtgactgagaaaagcactttttcattaattatgactatatcagaaatttgttatcacaattgtcttggcaattttttttacttaacaaataagtatgtatcacattctccttattgttacctttcacatgcattgtactataaattactcatgttggtactaccacctccttaaatgatgttttctattacatttatttttccttttaaatccttcataacaaactctataccactatagcaaacaatcacggaattttattttaggtaatgcctagttactgacacagactcaagttaaaatcactcaaggaaaaaagagarcacaattcaaataatggatttaaatatgtattcaaaaatatgagataatgcaacaaaattataaatgaagacagcctcaatccttttgggaattgccaaccacaaaaaaaagttctctcatagagtataaataaacgtatactcccaagattaatttcattttttaaaatttgtactctttgctagaattcctatgacaatttatgctaatttccctggaaattagcataaatgccaatcactctactggattctaggacagatttttggaattcaggctatcagatttctccagccctattcactttccctgaactagaaaattcagcaaaaaaagaaagaaaacaaaaagactttgttgcagaactttatatattgtaacttattagggtccagatttgaaataggtactctctcttataaaagtgttgatatgaattacattgctaagaatattcctgagcataaaactttgtgtgtatctctgattattttgctgaagtaaattctagaattggaataaaggagttttttaaaagaactttttttaaggtgaaacccggtaagtttactgctcggaattttccctaggaaatttttggtgatagaaacaaagatttcagggatgttcttaacaatattatttataatagtttaaaaattaaagcctgggcacaatctaaacacttaacacaatgaaattacttacattatcatatatttagtgaagagattatcatatattcaatggagagacaacgtaatattttagaaggcacattttggagtaagaaaccataatgctgctatttactagctttgtgatcttggaagttcttaattttcattccaaccttcttacctcatagataaaacaaagataatatgaggatctgcttcctgcagttgttaacagggttaaaagcaataatgcatataagaagattagcacagcatgtggcacatagtcaacaatattgatattgtggttgttatgaacagtcatattctcaataaacttatacatttaaaggaaaatgccatagcataatacattttacagacagggtacaaaactgtattttattgtgttacaaattttataaatatgcatatatgcaaataggacaggtaacctacactaaaatgttaccaaggtagttgaagtataggaaacgtttattttcagtattttccaatgtttctacaaggaacattttttaatcagaaaaaaatggtaattacagaacacaggatttcttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggaccacaggcgcccgccactacgcccggctaattttttgtattttttagtagagacggggtttcaccgttttagccgggatggtctcgatctcctgacctcgtgatccgcccgcctcggcctcccaaagtgctgggattacaggcgtgagccaccgcgcccggccagaacacaggatttctaactgaatatcaggaaacagaatttgactggaaatcaagaagataagagttagggagcatgtttaagggtccaggtgcagctggtcaggaacctccagaattccagaattaaaggatgtatttcgtctttacaaacccaggaaactgcttcagatctgaggagctctcagtctggaaggctcagttgggtagatcactggctttccttgggtctatctatgtagatcaaggcgttccctacccagctaaagaagctgcacagggatgccataggtttcaggcctgcagattatgcttcagcagtaggaaggggacaactgcatctggttgtcccagttcagttgtaccttttaagcagggaaggacctctggatagtgagttcagtttcctgttgaactttatcctgcccacctttccctctgagctacactcactactggtagcagaacatgatactaagtggaaactttgggttagtggataaaatcgaatggagactgagatgaaagtaaatctgactctcataaaaccagattatcaacagccagtgtcacggtagccctagctgggggtagaattgtgaagggaagcagatgggagtctggttttcctgtatagtggtggcagatcccatctagccaggattagagatgatttatgggtttaaggaattatggcaaactgggtaaaggcaaccaaaaatctaaattgttccgtggtctcccttctttccagtttcaaaaagactggtatgttaaaaaaaaaaaaaaraaagaaaaagaaaagaatgagcmtggcaagaacataataacagacaaaaacttccaattctggtcttctgttaatcctaggtctattaagagaatgggggatggaggaacaatatgattatagctgatacatayggctactgaccattaagtgtccatattttctgctggctgaattatgccaattctctgtacagcaccataaaggatctacatttgtttggggattcaaaatattacacaatttacttcatcagctagaaaacaaagccctacataagacagaagaattctattaaaagaggaagaaagattacatttccatttttttcttgtagattagaaaaagtggatcttttccaatgccagagcttaagctgtcaatttcattccccaatatgacatcaaatggttaccctgtgctgtacccaactggattgtcatcttctgaggtaagtcatgtgtgccttggaattatgtcattactgttatcttttccactttatgtttaagccttttgttctgcatgatacttgtaataaagaattttaccaaagtaacatggagaggtatttagataattaaaagcaaataataatagatgtattattccctagagctgctgtaacaaattatcacaaattgagtgacttaaaacaacacaaatttattctttcacggttctggagtccagaagtccaaaatcaaggtgttgacagtgttaattccctctggaggctccaagagagactctttctcatgctgtyttcctagcttctggtgacaactggcaaccctagtcgttccttggcttgcggcagcatagctcctatctctgcctctgtcttcacctggccttctctgtgtttctatgtgttctccttctctctttgtgtttctgcacactcaccattagatttagggtccaccctaaatccagagtgatctcatctggagatccttaatataattatgtctgcaaagaccctatttccaagtaaagtcatatttactagttctagggagatttaggcatatctttggggaccactattcaatccactagagtagattttaaataattcattgttatgaaatgtttcttacacttttccttgatttgtggtaatcaaacaactctataaagtgacttcttaattgtacctaagcatgcacagctgcaaacaaaatagtataattgtatttactcacatcccaaataatagcaatattgcaccccctttatatttttagcttgaatgagactatatgatggttcattatggtttagtgcctaaaacaaaaaatcaccataagtattgaattaatgtgtgcatgatgtcagaatttggaaatctgtcttttcatgcattttttaaagtgttcccagaaatcaagaaatagcaacaatgctaattggcttgtgatcayttaaatgttttcctaagggcaaggaaaaaataagcctttggaatttccctctaatccaaaaaagcaggtttgygaaaatccagaagagaaaaaaaaattgtacttttcatactgcttaggaaactttaatcttattaacttttgtcaaggatattgacagtactggggaagcaaaaggtttactaggttaagtctagaaccagctatcttataaatatagcattttaacataatatattaacatctatagggctgtctgcttacgtctacctcccatgtagactgagtgtcytatccttggtgtgtagggaatcaaaagtattactggatgaatacataaatacagatgaaggtctctcgcttttcaattgtttcatgagccataatattgaacaagtatttttgttgtttttgtttccttttttttgagacggaatctctctctgtcacccaggctggagtgcagtggcgcgatcttggcttactgcaacctcctcctcccatgtccaaatgattctcctgcctcagactcccaagtagctgggactacaggcgcctgccaccacacccaactaatttttgtatttctagtagagatggggcctcaccatgttggccaggctggtctygaactcctgacctcaggtgatccacccacctcggcctcccagagtgctagaattacaggtgtgagccactgtggctggccgttgtttttgtttttatcagtagaatttaaatgcttttctctctctgtagtatagaatttataagcttatctttgattaaggtaataaattaatgaatgtattaatcacgtaatagtaagttctattagcattctttcttttccattacaacctcactagtttccattacaattcaaaagtagcatggtaagagtacatattatcttggggtggatatatatgtatgtatggctggtgcataacaacctttcccatacagcacacttacaaagatggatctctaatatatggcaatggctgtcattcacagattctttacactactgcagcaagtcatgtttttcctctgatatctggcattgtctgataaatgtaatattttcatttctagaatgcaaactgcagaccccatatctttgaggatcctttcagtatcaactctggaaagaaaatgactacatcaactgaccatctcaaacgaggcacaattctggtaaattaagacaagtgctatttttaccttttgctttccaaatgaataaaattgatatcawtcyagaaataaccatytgragaatttaaatatagatatttgataaaacggcaagaatactgatatgtatctctggacatttaaacaggactgcaatacatgtaaatttgctaccatcacatgtaatctcacttcttctgacatcagccaagtcaatgtttcgcttatcttgtggaaaccaacttttataaaagtaagtaaatacatagttctatgcactkattgaataatatcaataaatattcatttaccacttagaatatgcaaggcaywgtgctgcttttggaaagaatgtgcgactggaagtataagaggatgtgaccaagccccagctctacttaaccagctatgtgtgtctcatcttccttgtctgttaagaactaagatattaccaaggtcccctctggagagatatacttttttcaatctctcttatcctttttctttgtactttaagagataaatacctttccagtaccaaagcttgcacttatcttaatactttggaactcagttaatgtacagagtataataaagtggcaacccttgaccccagtaacaaaggaaagagctaacatataccatagacttactgtgttttatcagactgttattatatgtataattttataatatataggtatatatgaagccttttttcttttttttttttttgagacggagtgtctctctgtcgcccaggctrgagtgcagtggcacgatctcggctcactgcaagctccacctcccgggttcacgccattctcctgcctcagcctcccgagtagctgggactacaggcgcccaccaccacgcccggctaatttttttttgtattttagtagagactatgaagacatttttaaccccttataaagccaaatctgtctgacaataagctactttaaaactttttattgtattttgtattatttatttctcaggaagtatttagttgaacatatgactttgccatttttgaatttgattatagtaagttgctatttttatgtcattaactgttaatattggcaatttcattttttaaatttcaactttaattttagatacagggagtatacatgcacgagtttgttacatgggtatatttgcaggatattgaggtttagggtacagattccatcgctcaggtagtgggcataatacccaataggtagtttgtcagctcctccaagtagtccatggtgtctactgttcccatctttatatccatgagtacccaaggcttaactctcacttatacgtgagaacatgtggtatttggttttctgttcctgtggaatttgcttaggattatggcctccatctgcatgtatgttgctgcaaaggacatgattttgttcttttttatggctgtgcagtgttccatggtgtatatgtacatattttctttatccaggccactgttgatgggcacctatgttaattccatgtctttgctgttgtgaatagcactgcaatgaagatatgaccgcacgtgtctttttggtaaacagtttctttcgggtatatacacccagtaatgggattgctgggttgaatggtagttctgttttaagttgtttgagaaatctccaaactgctttccactggctgaactaatttacatccccaccaacagtgtataagcttttccttttctctgctgcctcaccattttctgttattttttgacttcttaataatagccattctgactggagtgagatggtacctacctcattttggcttttatttgcatttctgtaatgattagygataatgagagttttttcatatgtttgttggtcacctgtatgtcatgttttaaggagtctattcatgtccttygcccattatttaatgtggttatttgttgattgattgcttgctgagttgttcaagttccttattctggatattagacctttgtcagatgcatagtttgcaattattttctcccattctgtaggttgtctgtttactctattgataatgtcttttgttgtgcagaagctctttagtttaattagatcccacttgtcaatttttgtttttgttgcaattgcttttagagacttagccaaaaattatttgccaagaccaatgtcagagagggtatttcctaggttttcttataatatttttatagttaaaggtcttatatttaaatctttaatttgtcttggttagtttttatatatggggaaagttaggggtccagtttcattcttctgcatatggctagccagttatcccaacaccattttttgactagggattcctttccccattgcttgtttttgttggctttatcaaagatcagacggctgtaggtatgtggctttatttctgaattctctattctgtttcactggtccatgtggctcttctgtaccagtatcatacygttttgattaccgtagccttatagtagagttcgaagtcaggcagtgtgatgggtctggctttgttctttttacttaggattgctttggctacctgagctctttttttagatccacatgaattttagaatagttttttctaattctgtgaaaaatgatgttggtactttaagagcaacagtgttaaatctatacattgctttgggcagtatggccatttaatgatattaaatgaaaggttttttcttttatttgtctcawctctgatttctttcagcagtgttttttaggtctccttttagagatctcttacctccttggttagctgtattcctggatatttcagtgttttttgtagcttctgtaaatggagttttttttttttttttgagacggagtctcgctctgtcgcccaggctggagtccagtggcgcgaccttggctcactgcaagctccgcctcccgggttcacgccattctcttgactcagcctcctgagcagctgggactacaggcacccaccaccatgcccggctaatttttttttttttttttgtatttttagtagagatggggtttcactgtgttagccaggatggtctcgatctcctgacctcatgatctgcccacctcagcctcccaaagtgctgggattacaggcgtgagccaccgcacccagccctgagttgtgttgtttatttgactctcaccttgaacattattggtgtatagaaatgctactaatttttgtacccctattttatattctgaaactttactaaagtcatttatgaattctaggagttttttggcagagtcttaagggttttctaggtataggatcatattaccagtggaaaaaagatagcttgacttcttctattcctatttggatgtctttatttctttatcttgccttattgctctgrctaggacttagagtactaggttgaataggagtggtaagagtgggcatccttgtcttattccagttccccaggggaatggttccagcttttgcccattcagtatgatattggctaggattagttacagatgactcttattatttggaggtatgtttctttgatgcctgtctctacctagagttcttgtgctgattctttctcatcttgggggactgatgttcttcaactgtggtgtaagttgagtgtagtcatttgggtttgtttctggatgctttcagagggccaagtctctgtacgggatctttatttgtgggtgtatgctcacaggagtgtttattagcaaagtaatttttggtgttgttgtttgagctgtgatccagtagagggcaattaagggtaatgggcagtagataggctcttagtcttgccactcttgtatttgctcatgtttgcaggggtgctctgcagtgggtagggagaggcctcctccaatcactggcactgtacccatgtttcttttgttaggtgttctgggccacaggctctctcgggcagaggccatggcaggtagataggtgacaccttttccgaaccagccctgtggagggagtcatgccctactccagtgctggcccacgctggcccacgaatccatgtttgttacccatctcagtgctctgagatgggggctcctcccctacttgagtgccagccatagatctcagcttggtactcctgagayggacatgccatctctgggtctccaggacaccccgcagctcagagtcaggctctggttgctttggaggatccaaagtcctcccaggtcacagggaaagtactcaggtggggcgcagcacccaggctgggcggcagagactgcgctgtgcacatgctcctgtggggcagttaggcagggactctgggagggtctggcaggcgggagaggctgcagaacagacatgccccagtcccatggggaatgcctgctttctcctggcttgtggtcacctggggctagagcctctstgaaggagatggggagtcygagggratgggcacctatgtctgtgctctgctcacaaaagctcctgggctccatgctagctgaagccctgtctctacctgctccctgggaaaatccacctgccagctcacacatccattggagatgttgggtactctgtagcttagatcccagatgtctgtggcaagagtgagctgtccctcagtcccctccctcaccccttctccaggagccatttagggccaggaagtagcccaagcattcaggtaccctacgcagggttcccagcttctccctcttcagcctcagcatctgtgttgcctctccacacacttgcggtgttttctccctagagatcagatctgcccaaattatattatttacttgataatttgggatctcttagtgggagagatggctgtgtctagttagccatcttgtccccctagatcatcaatttcatttttaatcctaaataagtgcctagataaacttcatcaccagaatgtagttgtttcatgtcttgctacrttaaaggtaggcagwgtttgaggtttgttttttctaatgataaatcaatacaaaatatttttaaaattttttttcattccataacgaggatctaagtaaggattttcagtggcaaatgagggaggacaagtgcacggttattatttgatactaccagttccatttggaagttaacaaaactggaatttttaatctctcagaaaaatcttagcttttayaaatgtcctactcaaacatgactagctctcattttgattagcatcatatattaagaacaaatcctatttgcttttcagtcatatttttccagcttaaatcttactataaggggagracttcggagtgaaaatgcatctctggttttaagtagcagcaatcaaaaaagagaggtaagtgcaacatgagttttgaaaacattatgcatttcactctgaattttgtgacataatgttttataattgttgatagtcccttaagcagtgactggtattgctctcggtaagtgacagacactatttgcttcaaattatacttcattagcttcaaatgtgattttagtcttattcatccttgtaagacactgggaaaatcatgatatttacaattcacatgccgcatttgactttatcacttataactatcacggtaaatggatgtttttactttcactttgataacaaatgatgcagttgtaactttcctccttaaaagctgacattataaaatgcagctgatatctgaagagcagccgcaaaaaacaacttctttataaaaagtgcctttatactgtacaggaaaacatgtacattttttaaagttttctttcaaatttcattgagaaatttgaaacaaaaawgtgatggtatttcctaatacaaattcagacttgagtcctcagtaaaaatagaaaggtttgagtttttaactcttgtcctttttataaattaataagccaaggtgayggagtaagaccccatctctaaaaaaataaaataaaataagtacttgttacacatgcaggcacttcagcatgatctccccccttctcatgggagactttaaatatcccatgtggataacagcaccatgtgaatcataaaattcaatttggaagctccctaactttcagatgttctttttaaattgcttatttcaaatttttccaatatcaatgacttctgataagtatacgcttttcaagaaaaaggaaaatacatgcatataatgtttacttatgtcataaagagcgcttagcataagcaatgcaaaatgcaaagttgttccttacatagaatagccaacatttcactaaaacctaaaaaatttgagtatggtttatgttggaaaagtacatatgattcctaaatttatgtgttaaaattttataatgagttttattttccctaaatattagttaaaaattcccctggaaatatttattctacattcatcctaaaggaaaaattatatctatattgataaaattactaaaagtgatcattttgtaattgtgtgatctgaggaaagtcactgatcttatctagattccggtttccrtatctgtaagttcagggaattgttttacatatgtttaaaatctgccttgctgggcttagtggctcatgtctgtcatcccagcctactcgggagactgagatggaaggatcactttagcccaggagtttgagatcagcctgggcaaaatagtgaaaccccatctgtgttttgttttgttttgttttaagaaactgtcataatggtctgatgctgtatatgtctacattcttgccagctctgtcacctacctggagtgatttgagaggttttgattagtatcatgcatatacaaatctctcccctgttagtttctttttctaccctaatcttccctctaggtaaagaaattgagrtgttactgttaaaggcaaatacagggcttgaactattactagccattgatatctaccctaaattaatttttttcaaatcccccagggatgagacacagagcagataggtttcattgaggtttgagtgccaccctgagagagcttgagtagctggaacactaaaagcggtccattttacagctttgcttcagttaaaacctgatttatacatgtggacccagtgataagtcaagtagaagaaacattgtggtataatgaagagcacactgggagtgaatacatatgcaaacattcacttacccatacacttgacatgtatgcattatactttcaatttataaacaaaaaattatgcacactagaaataaaataaggagactttctcaggttcttatgacaacaaactgcgacattccaatctaaactaatgctattgtgataatacagtagtgtactaattaatctttaacacacataatactttggttctccctgagttaaacagaaattcactcctccccttgagcattccaatccattgacatttaaccctttatgtataaatttcagaaggataatattataaataccttttggtaataataaatttgacatagttagagatttagactagatgaagagcattttctaatgtaaatctratgttttctcrttatatagtaacgagattaatgcactggtagagaattgtagcctgcaagaaytcaatgttccaggagttctaataggtgtttattatgttaacaatcttgtttaataattttcagcttgctattcaaatatccaaagatgggctaccgggcagagtgccattatgggtcatcctgctgagtgcttttgccggattgttgctgttaatgctgctcattttagcactgtggaaggtaaacaccaaaattcctttgactctctacttcaatcatcaacagcaaactggagaaataagctctgatmtattcagactatgtaatatagtattattacagcaatgaaacaaacgttgaaatgatgactaagggaaagaaaaaagaaaaatgcgtatttcaaacactgcacacaacttgacccaatttttgtaaaggaaaaaaaacttattttragttagaaatagtcaaaaattcacaaaagtatctttctagagtttagtatgataggggactttcacatgtgtaacaattaaaattttataataagtatgtatttcttttataaacagagaacaatgaaaactgtcttttatagagaaagaaaaaatgaattcctatgtcaatttaaggatatataagcagtagattcaaggttaaaataagccttgttttaatcacatctccatgtgtcttaaatatcaaataattctttaatgtttaaatatatatggcacattttatgtaataaattgtgtgcctgagtggaggataagggatcagctgatgtaggggagatcttaaagtttcacagactcctatttcaaattctgtggtaaatgtgagtaaccacctattttgtgtcaagtaactctggatatttatgtaatgttttgcttaggctgaaatagacatgatttttaaaactcttagcagctgtataattttcacattaagtagaattgagatgacagcttttgggataagttgaatagagaataacatcccatacagagttgaatgttttttcaattaaatatcaaataagcatttattctagcataatatccccctagattttacctattgttttgttaaatagttaaattatgttaaaaatataggttgtggctacatattaattgttctattacctgagcaacataattatttaatcaaatagtttaaatagcaagtttctctcccactgaaataccaactgttcctatcctttcttactctcctatgactcacttcctcttttgaggggcttagtctcagaggagatggtgaacaaagccagatgtaggtcagtggcatttaattcagtaaatagaatccatggcttttctctagcaaagttccccaaacaaaattctccactatagccaatgtccagctcttccttctactttataagggatcagtgttctctctgtaatacctagctttgccacactgtggtacccaaggcctggcttattggtgtcaaggttgtacttgaaatataggaagtggtttcttcatttctatgcacctctaatagagagtgttactgttgatttttttcagcatagtcttctgttctcagcactgcacttacctctatggttttagaacaccgctggcaggagaagaggaaaaccagagctgatatttggataggttctttcaggccttgtacctctgtttcagacaaacaaataggaaatttcagtcacctatttttcagtcagtagtctgaaaaagcataaatgtaaaactaagctcattgtttcatccagataatgatgtgttgatacattctgacagcttcttaggttattattaatattattattattgcaggcccaaaagaagatcatttgacaaactttgggctgtcttacccggtagaaatagttcagccacttcattgggaggcccagcaatcagaactgtgattctaaggtagaagggaagaaactagctcttatcgaatgcttactatgtgcagggagctattttaaacatttctgctttaagcattcccacttaatactcatatcaaccttatgaggtcgtatgaacctcctcttttaagtgargaacataaaatttaagtatatttcccaaagacacatagtgagattcagagtaaggatctgaattctgtgccaaaaccactgactattatcactctgtgttctctcttgcttccattcactctggtgtcctygcaacaatcttttcgaccaagtattttaactacattttacacctgaggacattaaagcaaagggaggtaaagtgactctcccatgattactagctagtaaatgactggattcaaggaatgatctacagagctctttctttttccaatatatcctactgctgcaggctatagggtagggctctttactctggagctccaggagttgggttttgttcaagagagtcatgaactctcttaaacacataatactgtctttggttttggaatgagggtccctggttggattcagactttcggtagttccattatatcaagaaggctaatcccacttccccctactttaaagttctgttggaagctgcctgaagcatgagttcagttgcagtaggttcagaagagctactcttatcccagacatcttttttattctaactagatctggatcagacacctcaggactatcccttcttccttcctttcctgaatcccaccagtttggagttcattggaactcccaagtctgagtctctgtgtaagagacaggccaaaagtttctcttagagcagagattcactttcaaaagacacagtctttatatctttgtcttcatcatacacatggcaaaaattaaagcttgacaaagtgttagtagctgcttaatacacttcatgattgatgggaggaatcttgtaggggacgtaggtttaaataggtggagaaacttgtcctgaactgtggtaccacatgccgggggagatgccagcacaccaggagccatgagagactcagaacattcctctctcctaacttgatgtcataatgatgcctgaagttcctcaactgatgatttatttattaatcytaaagctttattcttcatccaatatacatgttctgggtgggtgtggatggggactggtgtctcaccactttttagtcttttatayattagtatgaatttattcattcagcaattattccatgttatattcattaagcacttacttttctgacagttatcacctcattagagcctttgccatagggttttgaacaagggatcatgaagcaaacacaggaaggaaaaaatgaaagccagtgctgcaaagaaagtgttggggctgaaaacaaactctattggtttcaaatttgggctaggattggcccagtccatcttgaagctataaactattttctcctaatctccactctttgccactcaacttctcttaaaaacccatgttaattggttgggtggagtgcttagataacagaagttattttaaaatagaacatttaatgtgtagaagccaaggagcattgtaaagaagcaaaaagagctgtgagagatcagaagcaaagcagagtgggaaggagaaaaagtcttagaatccaccacctgcttttgtgaaagccttgtctgtttatttttgactcaggacatgcaggcacaagttaagaagcctmatggtttgtgaatctggaacttttatacttggctcatatgaaaaagcctgagacgtgtaggagagctggcatttggggaagaaaaacttattgttttcatgtgtatttgttccgttaccgccttttcttcatctaccaccaactagatgatggcataatagaagacatgagccctgaataaaaattttccaacctaaaagtgcatatttttgagggtttatcccctctaagccctcagttgtttaataattattttataaacacatagttccctggcataatttgccataatttcgtgattaaaatgatgtagaggtgccacacttttaaagaattaactcattgcctttgctcgatctattatagccccctctcaaatttaaaaaatatatacaaatttgaaaaatcacttacctatgacccttaattttctttttttaaaaataagcattttaggttagataattgcaaagatcccttctatcccccatacttarttttgttattctataggatgggaaacaattgcagcacttatarctttttatgatgccccaaattgcaaagcataatgaaatatggctcaccatccaccacgatgtgaaatttttcttatggtcaacaacttcattttttatttccaaatgatatagtgtgttttcaagaggctttttatatcaaatctatataagcagacgtcctgatgcatttaaagttaatacagacaactcagaaatctccctaacgccctagccataatatacctgtcagattccctaccatctctaatgacctcaacttatggtcatcratcattygatggaaatttctctgccacatccctgaaaaaaaagatgatggcaaagaagagacaatgctagctaattgcagtttgtctcccaaaatattttcccagaagcttttaattagttcaatgtgtatactatattttactaggggtcatggtgtatttaaccaatgaaaatattaaaaatgaaacmgcggcccggcgcgatggctcacgcctgtaatcccagcactttgggaggccgaggcaggcagatcatgaggtcaagagatagagaccatcctggccaacatggtgaaaccccgtctctactgaaaatacaaaaattagctgggcatggtggtgcatgcctgtagtcccagctacccaggaggctgaggcaggagaatcacttgaacccgggtggcggaggttgcagtgagcggagatcacgccactgcactccagcctggtgacagagtgagactcgtctcaaaaaaaaaaagaaaagaaaaaaaaaagaaacagcaatttaataaatgtcattttttgacattgaatattaataggtcaatgagaaaatatttcttaattatattagttgtgtgcccagcattgccaatatactattaaatttaattctatccaaaggattaatatttgctacctaaattaaaatagttaattgtgttatgttttgtgttttctcaacagattggattcttcaaaagaccactgaaaaagaaaatggagaaatgaaatattttaygaaagaaaataataacaattattcaataatctatcctcaggtttgcctcaaatatgtgacaagaaatgtataattcatgacatagtcatgtaactatgtaatccatcagggattcattacttggaaaatgacaggtcatgcattatccaaaaacaataccaaaaagacatattttataaaatgacaaaaaatattttacataattactcatttttgttgagtaagcaaaattacaaagtgtttttaaaaaaacctgtacaaatatgtttatgtattaaatcaccatccaaaatatttaaggaatatataaaaagatttttatgatcatagaaacatctattttcaaaacaatataaattaagcttttccccttgattcctgttggatatccatgttcagcatgacagtcagcactcgtaaatgccaagaaaagaattacctgaaaaagatcatttctccctattcaaatgagaatattttccctyggtagaatccatatacaatatggattgaaaattaagtcacsaagaatacatttagcatctttgtgttgggttctatacctaaaaattttccctccckgcccaaggtgattggaaagtactgcaattgrgctaaaattttatctaggatggaaaatcaggatagactcgtttaaaaacaagtatattaaatgggttaaattaagcttttacagaacatgcttaattytgatattgagctctaaatgcaaaacycttttatactgaaaaaacacttaaagyagttttgtgtggcatcacagtgatttgtcatgaaaagccatatatgggggacatgctaaaatggcttctgaatgaaatacgacagcagagaaagatgccactgaaatgctgaaattatctttgctgagcagcttttgaatgctaagggttccagtatgtgacccaaagaargagttgtctcaactccttggtacagggttcattcaaacccccaagctgtgagagtgtgtttatttttaattttttaaaaggtatttaatttccaaccacacttcttatttttttgaaaagacaattttccatttcagtattacattttaccaagaagtcactgctttttaggtgtgttgcatcaatatttaaataaaatcccagaaatgtattttaaagaatttcaggtttgaaaactcaaaccaacagraagatatcacacctttgtatgtgcttctttgttcttgaagtagtcattatggttcattggaatctactgtagcataagctcctaggttgctccatttcttaggaaaatagcaatgaatgaatgtatagtagytgcwtgtgtgaactactgctgtaaagtttgctgacatttctgcaacaacatttctccatctgatttaccagaacctgtaacaagaccagaacatgtattyatccagaaactcctgggctctgctttgttcaaagaggagcaaatccacatagaaattaaatgttataaatttatttttttaaactaatttccaaagaatttagctgaagactcagagtcagcctacctcttgactctccacatcygcatctaagatcctgaaggccaaaggaatgygcctgtgggatgccaaagccatcagtagctggaagaaagaatacctctttctagaggtttggtgtcctcttgctggcctgtcattatttggaaatacgcgcttttggaatttccttcattttcgctatttccaggttcagaaatcatacctaccacttgttctttctttgcccagtaaaactcagggtttctcttattcagagttaccatgttgcacacccccagtgctcagcctgcccagaagcccttctctgatctcagcaagatcttagtagtaaagctaacggatccattgaaattcatactcagcatctgtgactactagacaaagcccatttactgaaccataagtgtgcacttttaaactaaattrttaactgaaagggaaaaaatagaaatgagggcattttgaagtttttagaaaagagaggaagagctgttggccagatcaaagagatacttataagcccggcacaatttttaacataagtcattcctggctattaagtaaaatatttcatgaaccagaagtcctgtttctctaatattataatttgttgaggtttgtgtgtgtgtgtgtgtgcatgtgcagacacatgtacacatataaattgaatacaaaaatagctctataacaccaaaaaacagagtttacagaaaataaacacaaaagctatatctgcaagacaagtttgattcatctagtttcatatagtttcatatagtttcatttttattaatatttaggtttaacttatagttctgcaattatttaaaaaacaagtacagagcgtttgattaaaaaaagtcaacaaatgtttcaaaacagctttgtacaaatgttataaaacatatttaatgattaagaaatgtactagactctatcatttacttttaaaacatttaattagaaaaacaggtgatatttaagactatttataaacttattggcyaaattgccaaaaagtttctttttctctaactttggtattctaaataattgattattgctcccattgtaaactgaaccatgtatgcactctcttttctgaccaaactacaatggtatattggtaaattatttaacaacacactgtccaggagggaaaaaaaaaacagtctctgatttgtatcatttgccaatttccatggtccaaatattctctctccattttcaaactaccaaagtgaccctaatcagcttacaaaattcctggaaatgtatctgccacctcttaccaaccagtgtgagctgacttcagcacaccactgagacagattacacgatagacagatagatagatagatagatagatagatagatagatagatagatagatattgatagagaacatgttgtgtctatatamatatccaatgacacacagtataatcatgttttaaattatgccaaaagtactgattatatcaagcccagtaaacataatgctacacagcacccattctttaattttgatttctaaaattataaccttcctttgatattaataaaatgttatgaacttgcaggagaaggaaggagttgaaagaaggaaaatataaagggtgatccacagtgaaaatcagacctacacaagccacaaaaaaattgtctcattttcccaaggaattcaaagtcctgtgatacacattacaaaagatgacactttgtaaatattttgaacttctatgatccaatttcaacttcattggtccaatttgtcaaactattttcctctgagcactagattcatgggcaatttaatctctgaatattttctgtgtcataagtgtgcttgaaaagaggcttgtagtaaacagatatttttacaaaatttgatgcttctgcaaccataataattttatctataaatgcgtatatacatatatatatatatatwcacatacactcacatgcagatatttacatatatagatattctcttttccttttataaaatcaaagtctaggctcaattggaaaatggaaatatttgcaccaaaagaaaaaagtgccattgttgtgatcaatggagtaaagctggggtatagtagaggctggggaakccctgcccatgttctctccaaggccacagcttgcacaccgtgaatggtggccccactggctccatggagtgtgccttcacgcgggggaatgtccttgtccaacacgctgtaatctactccatgggaactgactgtcctgcttttcacaacattgagaaacaggcccagagcctgtctcatgtgccaggtgcagtcacattattgttaaaataaagtggcttctgacaaatcagttyttcaaaatagcatcctatgtacttttcatttcttccaacaaccctcaggcccccttttgccagttttctcccccaggggrgattttcaagactactggagaaaaatctgttaataaaacatttgctctgagtaccagcttcagtgactcaatcatttatacaggatttcagtgttttgttctgcagcggtgttctaaagggttcacatagtataatggaggagggacaaagcagaatatacttccaagctggaacatctttaagacatttacaaactgttatgggacactatcagcaactacgcctgbggaagctagcaggatttagctcttcaatggccctccaaatgcacccaacaatcgccaacctcacccatggaaatcatctaaaaaatgaaaagaagggccttaaagtcctcacatggatgctgtatttataactaaaatgtacagtttaattctaaatagcaggcttttaaatgcaaacagcttccaggtgagtcctctggctgccaatcagactgctgattctaaaccattctcacacagaatttctgaaaccaacaccaggtattaattgttaactgcagtgaaaggaaaccaaggcacattacaaaaggctaaatgctgctgtttctaagtggaagcactgttgaacaacactcttaggtggaataagaaaattagggttaaactgtaacaytgtaatcggacgaacaaatcagcatctttgatcctcaggttaaaatttaatcttaaatttagaaattcaaagtaacagcctttaaccattaaccttgaggaaaatgtgaagtagcatctggagtctcttaagccccagccctgttgtcccctacagcatctccacccaggaagtccagttcctaactaatgggaatggatccttttcccattataaagggccgatgcttaacccttgaacccactactgttcttatgccccaagatctgcaccttacatcaggcacccgggaatgcttctcattgaaattttaccataccaaaaaatatgtaagggtgactcatcacycctaactttggactccttgctttgagatcggtatttttttctctctctttacatatagcaaaagctttccccagtagctgatgaatttagaactttatacaagactccctagcattttcctcctcccacaggctggagaatttcagtgctatsagactgggcagtaggagccagagccaatttgcaggatctcttttccttctgccttccagttggcttctcttctcagctgcgtggtggggatgatttggggtttcctcagcaaggccattctctgccttgtgcccatagcagggccttgggtggtgacatgttatctttgttggtgagcagacactcagagatcctttaattatctgacacaccagggaaatcttggcaatcaactaaggacctgtgacactcataactatgwttacatttggctttagcatatttcaggtaatatctttatgaaaaaaagatgaagtatggaattgtaggaactcttttgcaatagactgagatccaatgtttaaatctttttatttcagtttgatctgtgcctttagattggggacaaaattttaaaaacaaatcttccaaatgacaccacaatgaaagccagttgtggtcttgaaaaatctctctattgcattacttatcctcacccttgttttttaagaggtagagagagattactgggaagcagtkagccaacataattgtcctttcctctacagaatagctgtgcagaaggggaccaccacacttaggaccagtgccaggtgacaatctttcygtcatgctgctgcagcattttgcaccttgagagacaggaaaaaaaatgggggtgagggagtggaagatgatgaaactatttctcttttatgtctacatccttactcctcaaaatactttaagctcactcagaccccatataccctgcccacaatactaacacatgtactttgcataagtaaattgttgattaaataagagcaaaactatattcttatgtgtagattaaccaaggctaatttcctggagtttaatacactttggattcaagtaaaaacaatcacttaatgcagcaacatctcagaccctcttcactctagaaccrttttatacaagagaactcaacatttactgttttatttctgatattgcctgccattactcaggatgcaagagatgctctgcattccttattaggaaaaattggcctgtaaggagaatggtatactgygtattactactgtgagactgtaaaattgttaatggacagtgtaaagaattgtattcattttattagcaagaaaaatattgcatacaagaactactgccctgaaatatccatcactccaatgaactgttctgcctgatctaacataaagttatatttcattgctcatttttttttgcctcactaaaatgactaacttaagggaatgtgcatttctacaagactttaattggataaactcattagaagaaaatgtttcgattgcattcaggaacaaagaagcataacctttgttgactcttgtaatttattatatgcttcatttaaacccattttgtaaagaaatcaggtaacagtcatttaayctgatataattagaaatagctgagagagtaaaaaagcattttgaatgtcctatgtatggcatatcctgtacaccaattgaaggtcagagctttggtatttttgtataattctgtcttatctggtgcatcagctgtgtattttacgtcaaggtaaatgagcatcctgttttatatgttaaattttaaaaatgackttttcaaagaagaatgtgattgctgtgatttttaagtgtgtatattttttccaaaattaatgtgacttcttctgaagctccgaccttttttttttttttttgatgctttggcaggttttcactctaatgctctaaaaggaaaaagcaaaaagtaaattaagtctgtctgtggtgtttcctgtacaagatttagcaatgtgattagtttttttgtgaacttgagacaaaaaccacaggatctataatactatatatcttcttctaatgagatgttttaataataaatagtctgcagtataaacatagattataccacataggtgatataaaaaaaatcaagaaatttaaacgtagttattttctttattcaatttatactttattatataaaattatttaacatattagggctagaagaaaatacaggaagaagttttagtaaaaataacacatggtcatcttatttaaaatttcaccctcaaactatgctgtggggtgagtgagaagctattgttacagaagacacagactgaattatgaaggggttatttgtcaggtcatctacctaagttttggcagagcacattttcactgccctatcttttctctcttactgtaaagtaagtgctttttctctctcttcaccccttatccaggaagagaatacagtggagttactaaggaagaatctggatatattcactggaaaataaatggtatacctcaagatttattatttgtacatccagagaatatcacaacatttacttccttaccttcatttactttgattataaaaataatgtgatccgcataggcagatgtcaagtgtaatttcaccaaacagaagtgatcatgaattaagaagactgaagattatgtctatttattctttataacagcaatattattttaattgcttaaaaatatgtgaatattaattgttaagaaaacatttatggtaaaagggggatgtatacacatgtagataatttgaaaaccacaagaaataattttaaaatagccatcataccagtaccagaaattatatgctaaaaatcataaagaatatagtaccctgtacttttaaaaactataatattatatttcttaatttttctctagtaaaaaaaggatgatggtcatcaaatactttcccttgctttgaagttgacaataaggaagaaaattacccactcgcctccttctccttctgagccaataactgctatacacatacacatacacatatggcacactagaattctccatagtctgcatggagaataattacttctttacctacttcttcaagcaaaagtgggatggggcaaagagcaaagagtgatgggggaaagatgggtaagataatgtcactaagaatgatagcatatttggccttgtttattatgcaaaccaactatattattttattaataatcccagagaaagaaagaatttttgccagaaacaaaagacctggcatcattacaagcattagcaaaaaaaagacagtaaataaggaacagaggaacacatgagacaggagacatatagaaaacaaacagcaatatggcaaatataactctggccatatcaataattacattaaaggtaaatgatctaaacacccaaatcaaaaagcagagattttcagactgataaaagaataaagttgatctacatgccctctaaaagagaaagactttagcttgaaaggtgcaagtgggttgaaagaaaaatgatggaataaaaatacactacgcaaatagtaaccataagagagctggagtggctatattatatcagacaaaataaactttaagatgtgtctagttccaggcataggaagattctaatcttgtgaaggagacagggacccatggaaatctgctaagcatgtagatattctagatttttgcttggattgactttgatgtcctgtagattttcaaggaccattgacacctgaaataaaactcggatgaaggaagaatccatggagtcaccccactttgaaatttgtcttaagttcatgtgtagggggatccctaacctacacagattctggttgccatggtctaattgctaccccagtggcaggaataatagaacaggcatcatagtccataggcacctaggcttccaagcagttcacagattttggtcatgtgccaggtctctagttagtacttcactggcaagtgctggcttgaattaataaaagcagcattgaaatatctgtgggttttgtctttagcttccacttcactcagctatttttttgtttttgtagtatctttcaactgattgtgtggcatgaattcatttagataccacaactcagaatggcattccaaaggcaagagtggaaatgtctcaacttggtaaataaaaatagcaaccagattcagccatcagacggtaattagtggagctggaagctagccattccaaggactaactatccttgataaaacgcccaaggctctttagctttgcatgctcaatctctccttttctgttttcttccttcctttactcagatttttctattctatttcactcaagtaccatctgttattccttttcacacacttttcagacccttcttttattcctgcccattctgcatacctcatcgttaaaaggcgggtaattctacaaagattccaattagtgtattgtttgacggctgatcaggttttcccccttttaagatgaaccactgaataaatggtgtaaagaatgtagtcttgtgttgccaacatcttgtcagaattttttttgaagtttgagttcactattgtccacttgagttgccattaagcataatgtatatctctgtgtgaacatgtctgagcccatatgtgagcaaacacgtgaatgaagattgtatttttagatggaaagtcatttgaattctgaaagtggcaggacatgtaaggcagtaatacagggaaagtaggtagttttgaatgaaactgatggtgactggtgaagtctcccaattttctatggggaggggaagaaaggtaagagactaacatttgttgtctgcctcccacatgccaggcattgagctaggcaattttccaacatcaagccttttaatcctatcagcaacactaaatggtattattattattattcctattatacagatgatgtaattgagacccaaaggacctaaggagctacttcaaggctataaagctagtaagtagtgatgtagaaataaaaaccaagatctatctgagtccgaagctgcttccccaaggacaggaacttgagaggaagtcactggaagagaaatgaaaacacagaggtagaggagaacacacatctattttggtagtacttggcacatagtaactttcagtaaatatttgtttattgctgaatggatgcaaaaattgatcaactatattagtcagagatctccagagacatagagctaataggagatatatacatatatatgtgtatataggagagatatctatcttacacacacacacacacacacacacacacacacacacacacacacacacacatatatatatatatatatatatatggagagagagagattataaggaactgcttcacatggctatggaggctgagaagtcccatggtctacggtctgtaaactagagacccgggaaagctgatggtatagttccagtccaagtctgaaggtccaagactaggagaactgatgatgtaagtggtggaagaaagctggtggtgtagttctagtccaagtccaaaggcctgaaagtcagaagtgccagtggtataagtcccagtccaagtgtaggagaagactgatatcccaattcaaactgtcaggcagagagagcaaattctctcttaccctgccttttgttccattcaggcctccaacagattggatgaaggctaaaaacactggccatctgctttcctcagtctaccaattcaaatgctaatctcactcagaaacaccctcacaaatataaccagaataatgtttaaccaaatatctgggcaccctatgtcccagtcacattgacacataaaattaatcatcacaagtccacctctgtcaacttgtcacccatacacatctccttaagccatacttaacctcaaaataaaggcaataacaaggtcataatttcaccaaacatgatacaattatcctgcataccactaaaaatgcactaaccccttccccagaaaaggaggcaaagtctttgaaattcactcttctccttgatgtctagtaactgaaatactatgattgaaaattaacaatacttaactatgatataaagtcaatacatctgcagttacatgacaaaagaatcagagagagtgaaaatcaaagatattttcttaatacgtacaaatataattatatttaaaacatattcacattctaaacaaaataaggaggactattcataacaattacagtcctcttttttttgtaactggtcacttgtagctgatacttacagctaccttcttccactagccactctatgttccttttcccttcagcaagctccttatttggtcatggttcttcacctggtagaatgacccaaatcttcattcctgaagagtctgagccattagtagtccttcctggattgggctgttgtagctttccattgattataatcacaaggtaaggtaatactcagtgacacactaagggatctcttggaattcaagcatgttctttcttacctcaattgtggagtagcagttgaatttctcttctgtagcgaggatcagccacctcacccagtataatattataactcacttctttgcctattgattcagagtcatgagaagctcaaaggggccaggtggcaatcttaatttccagttcaatggaatcatttttgtgtctcctggtgggagcattcttcccttaggaactgagatccctaggccaccagagcataaggttatgagaacagaaagcaaaaattttgttagtgggtccctgcgggtaatagtgagtggagtcactcctatttccacctttgattcctggactcatgaatcctagttattggagaaacagcaccatatactggacagtgattcagagtatattcagccttgtagagaatcttgtccatgccctctgatgtactgccacctagctggtgctatagctgagtcttcagaaggacattccactgtttcatcagaccagctgcttcagtatggtggagaacatggtaagactagtgaagtctatgagcctgggcccactgctgcacttactttgcagcaaagtgagtttgtcagtcagaagcaatgccatggggaataccatgatggtgaataacgttttatagttatatttttccagctcacttacatctctttggcaaggaaatcatgaacatacaaaatgatcactaatcatagacttgaacccttggaggcagttgaaaaatcacccagtactggaaacttctttacaacatcccaaacagtgaaacctggtctatgcttgggcactttcaaccgtaaggtcctcagtatcccagctgtagcttctgttctgcttttgtgaagcactagttatttgaaagtatatctttcatttcaaattctaatatttgctatgcatcaacaaaagtctctgtatttatgtaagtgttctttaacctattaagtataacttagggcaatgagttccataaacttactacctatcgtgcaaagtaagattttatttaatttttccatttccttattaatttaagatctaaaatcgcctctccagttaatgtctctcaatgtatttaccctctactaactgtcagaactctcaaaccagtgttttcattcatccaaaacataaagaagcagtattagtagactgtaatattaggataaaatatagcaatattagaattattactatatagccgggcgcggtggctcacacctataatcccagcactttgagagggtgaggcaggtg

SEQ ID NO: 12261 - DNA, 36740 bp, Homo sapiens
  misc_feature (1)...(36740): n = A,T,C or G, or insertion/deletion polymorphism (see Tables 1-2)
ctgctggccggatgacgccgcttggcctgagcgtgtccaagcctcagatgacagagttcctggtcccttatgctgccctggggctggtggctgcccttcctsgatcctaagacatcctcctcacctcagagtggtgctggcctcagcggggcttggaggaggctgagctctctgtgtgggcactcacatgggtgtcagcctgacccacccacgtgtgctcacatccctgacacgtgcacatacatgcaaacccatacacgcaccctgcatagtaggggctcacagacggaaagagccaggccacttcttttttttttttttgagacggagtttcgttcttgttgcccaggctggagtgcaatggtctgatctcagctcactgcaacctccacctcccgggttcaagcgattctcctgcctcggcctcccaagtagctgggattacaggcatgcgccaccatacccggctaattttgtattttttagtagaggtggggtttctccatgttggtcaggctggtctcaaactcccgacctcaggtgatccgcccgccttggcctcccaaagtgttgggattacaggcgcgagccaccgcgcccggctgagccagaccacttctgtcttttaaggctcctgctaatttaaaaatgaagaaagtcctaaataggatgttcacaactgtggtatgtttttatttaacaaattaatgttttttaacacacacatgcacccacacacatccaatgcagtgcaactgagagactcacaagatcgtcacaagaattataaaaaatgtgatttcacattgctgtgtggtccagtgatgggatgtaagtttcaaatggcatgaagagcattctgttcttcccatctcatccataattctctggggctagacatccagcccactttgtgtactcgttgtattatgaaaagtatcaagcatccagaagggttgaaagaatggtacagtgagcacccacatactcagcacctggggactacaatgaacattttgcagtatctgctttatcacatatccattcctctgtccaaccctctgtccatctctctgcacagacagccctctgcctatccatctacctagccatccatccctccctccctcccttcattccatctcatttttggatgcatttttgagacttctgaatgtgaggcctgggccaaatggcactctcttctctcctttgcagtaacaggccctgccacacacacaagcatacccccacctctacatgtaaaccccacctgcgtacacaccatatatgacttacccatgtccccacatttatacatgcacattccatgcacatattcacataaccacacacgctcatctgtgcacatatacctaaacacccccccctccccaacacacacaaactgcccacatatacactcacagaagaccctggacatctgtaaggaaagcatctggagacctttgggaatcctcagacctgtgactgtcgtggagccggtgccaggtcctggctgtctcctccatacatttctggcaagtgccagaggctcccttgagctacctacctcagatgtcctaccttttccactcttacccatcttctctctcaacccctagtcacttcctacaaaggaaacggattccttccagagtgttactgttatgggaagcaaatcccacagaccatccactccatgcaggctgggactgtgtctgccctatccacactgcattcccagctcctggccccctgtggctaagtgttgattggaaaaaagtcaccagagcagcacagaggcacatacactgggcagccacaggggtacctccaccccacacagttacgtccatgcacacagaacaccctgtgtgtgtgtgcatgctcaagcttgcatcactgtgtgcctgcacacatatgaacacgcatcgtgtctgcctgtctccatactttccagatagagtcccttccaggacctgggtcctttcacaaaatcacctaataccactgtgggctcatctgctgacatgtgagatccagatgtggccccatgactgctcagggctcctggcttggccctgaacatctgggcgcaggggtttagagcaccagctttggaattgcattctcctgagaaaacctgggttccaccctggctctgcacatgatcactgtgcatgttccccgtatgatttatgtacaagttacctaacttcttggagcatcaatttccttatttgctaaatgggggcaatagttcctaccttaaattcatcttaaaggagataatctcagcagagtgcctggcatgttgtaagctcttaaaaatgcttgctatgaatatgattattgttactttagcctttgctctgaaatcccatgcacgctttgtgaggaaggacagccttggttggggggtgtttatggggagagcagagtggatggtgcgtatgtgaatacctctccccagatgctcccccaatcccaagctctcattatcttatatgcatattcataagggatggccctgctctgtaaatgggtcagaagcaggaaatagaggccagtacagacagcgaagcccaagggataggagggctcaaagccggcacacatctgagtcctcatggacgggaggatggtaagaggggatggggagagaatggattgggggcactgaggcgggggcaggagttcgttcctatgttgcagatttgaaaactcaggcccagtgagatcagattagagaaccttggggtgggtggtccaagaagtcagagtctgcttcctttgggaactggagttgagcatctgtctgggctgggtgatgggcacagggcaatggaccaaatgacccctacatgtttatttcaagggacatggtttacatagcattgggtggagaagctgaatcctgaattccaaccctccagtgaggctcagagtggttgggtgacttgccagtatcacatagctgctgactgtgactgtgcttttgggggtgcaagagacagagctactctggccccatgcaggaggttcaaatctgggagtaaaggctgatgggctggccaggacaccaagaaatgaagctctttatccatgtcctcacttcatctcctcagtagtcccctcagatagctggggtaaaaaaacttatctttattttacagatgagaagcatgaggctgagagaggaggagtcacccggacccagccacacagtgagttatgccctccatgctgggcgtgtgagagcccagccggccttggtcttgggcaggcaggaggccaggacagtggcagcatattaccttgctctggaaaattttagcctgaagtcagagtggctatccctttacacatacagtcatcttaatccctcgttccttgcagataactgcttatttctgagaatgtctttgcagatgctcacacatgctctgtgaggttaaacagaataaccctacctatttccgggaaggggatggacggacaccccttgtggggtgaagtggccccccaaggatggcatggggcatggtcatctgtggcagaacaagaatcccaggggttgatcctcttggtcttgggtgctttctactgttctaggtcatggatagggaggggttgggggtgaaaaattcagctcttagagcagaagtgtccaagggagctgaccctgggacgggagcatgtgaggagggctcacttgagactgcttggtggcatttcagtctaaaggatttccgtgcagaagatgactgtgtagggtatgtttttggatcagactgtcagtcacagaagaaggaggaaagtggacttatggtaaaaggtcagacattcatccagtaagcattcactgcttgactgtgtgccaggccctgtactgtgctctgggtaggagagggggtggccagagagcagaccgttcttgggtggctcacagtcccctaaaggcctcgggttagggaaggactgaaatattgctggacagaaaaataggaagactagatattgtcacctctactttttcaagggaagcagtaggacatcagggtgaaagccaggccaggttgcctttcagctctgtttcttctgagctgtgtggccttcagcaacagtaacaacaaccacagtgatcacagtcaacgtttattcgacgcttgatttacatttcgcgtgtcactacttctttgtttctcggtttcctcatctgtaaacgagtgggtggggaattaatcgacttctcagggctgttgtggggctcaaatggtaccacgggggaaagttgggcatgtgctcgggttgtttgtgaggccataagggaggcccatattgtttggaggcttgggggaatcaggaggatgttcattcctaatggaaccaggtagtgggttgggggtgagggtggtggctctcttcactgagaggtatggcatgtgagcaagcttcaaaggggagaaagagggataaggagaaggacctttaagaggagggcatctgccaggtgcagtgcctcacatctgtaataccagcactttgggaggccaaggcaggaggattgcttaagcccaggagttcgagactagcctggacaacataaggagacctcatctctacacaaaatttttaaaaaattagctgggtgtggtagtacacactggtggtcacagctacttgggaggctgaggtgggaggatcacttgggtccaggaggttgaagctgcagtgagccatgattgggccactgtgttccagcctgggtgacagagtgagaccctgtctcaaaaaaaaaaaaaaaaaaaaaaaaaagaggagggcattgtgtgggcaaaagtgcggaggaggaaaagtatagggtgtgtttgtggaacagtcctggtgcaattaatggctaagcctggcgcccagtgaatcagccaaggatgcagtcaaccagctctttggccctggggccagcttcgaggcacagagacttctttccctaacattatcttgtccagaggtggctgaggacagggctaagggtgaagggagactaattacagagccctacttctgggtctctcacacctacccctggaaagccatctgtcaggaatgtggccgcccctccccaccttctgacctccttagctagggaccagtttgggcatccctagggagtgataagccaccaagcaggggtggctgtagggagtgtgtagctcccagcaggctgttgggagtcagtggagtttgaagaacagatggagagaagggaggatgggtttagagtgagaggctggggtcttagaagaagcagtaggtgggcatggtggcatgcacctgtagtcccagctactcaggagcctgaagcaggaggatcacttgagcccaggaggtcgaggctgcagtgagctatgtttgcaccactgcactccagcctgggtgacagagcaagaccctgtctcttaaaaaggaagaagaaaacagtgacgatgggggcttacatttgtcaagcacctaccatgtgttgtaaccaccctgtgaggtatgtatcctcactttacagaccgggaaactgaggctcatagaggtgcagtgacttgccgaagtttctttatccagtcattcagcattcaacctcagcatctacgtattgagcagaggccctgcgccaagcactgaggagtcagcggtgaccacctcttggcttctgttcccaagggtgacagtgtcctggggtcacacgggctcaaaccgaggtcgatttccgaacgctcactttggagcaggatgcgagcccgggccacgattgggtcaggttgcgccgctcgcgtggccgcgggaatccccgaccggccccttccctagggtccctcctggcgcacctgccccaggtgagtctggggaggccccgagcgccgccggaaagcgtcgagcggcttcggtaggtggggcggggcaggggcggggccggggccggggaggggccaggcccggcacccggatcccgaggtccgcgccccgcgcccggcgccgggcgcccgaagccgggagccgccgccatgggggcctgcctgggagcctgctccctgctcagctgcgtgagtcccgaccccggcgcccgcccgcgcgcgccgcccgttcctgctgcgggccctcactttcttctgttctgctccgagtagtttcttctttttccttcctgcaaacttgtctttctgggccggtgccccgcctgctcgccctcctggaccttcactcggcacccggatcccgctgcccccgtccccctgctcagtcctggccggcaggcgccgggcagctgcggtcccggctcgggtttccgcgggcaggaggggagtgccctcggcgggcgccctcctgggacctggagagactaagcctggagcccggggtcggggcagctctgtgggccctcgtcgccccacttggggcggtcctcggggtggcctctgtccccgtcccggacgccctggttctctgtgtaggtcggccgggccccgtccctcctggcgagtgccctgccctacccctctggccgcctgccagtccgcctgttcctgtcgctcgggctccgcctgtccgttcgtatttgtctggttcctgtctgtgtccgtcgttcgtccgactgtctttgtccgtctgctgtcttctgtccgtctgcccgtccgcccgtccgtccctcagtctctctgcggtccctttaccgtcctcagtctggctcgcgctgcctctcaggcacttccccagctcgccccggaccatctgggccccagcgcggagactgggatgggagcggagggagccccggactttcttagctgccctcgagtgaggcgggtgcgggtcgtcacggaccaccgggcggaactctgggttgggagagcaggaatcgagggaggttcgggtgtgcgcggggagtgcccggtcgcgggttcgggacctgtggggaggccaacctctgttctgtagctgcagccgcagaggggaggggctccagcaagaccccggctgggaggcccgttctcccttccctttccccagcccccctctcctttcctcttcccctcattaaatctgaggttcattcaggcagccccctccccctctggccccacacaaagaggccctgagagggagaaggggctgcagcggctgctgaatctcgggactcgctttcctttgtccctgacgggttgtgtgtgtgtgtgtgtgtgtgtgtgtgtgtgtgwgagagagagagagagagaggagggggtgtaggggagagctgagggtctagagatttactttacagcctttttctgagaatgagatcagcatagacagcacagagaggcaagagagcctctcgcctcattaggcctccatttttcgtgtgtgtgtgtgcgtgtgcatgtgcgtgtgcaggaggaggaatcaagctggtgcctaaaatccctcccagcccaaagaattcaaggtttgggccaggtctctgccaacaagggtttgcttcctggtgagggaggcagagcttccacagtggacctgatttccatcggttgcacctggtgaggcacaggccctgctgggctggcctgggggtggagatgttgaggggcagcctgccagccctgtgtgccttggtcaccccatctggcagttgacagtaacagggcctttctcacaatgctgttgggagatgaggcacagttcctggcatatcgtgagtgctccttgtgggaattattgctaacatcaaggaaaggtgggtggagaattccatttggagacaatgcaaagccaagtgctggtctctgagttacagcattctacaatgctgagagcagataggactgctcaaaccatctgtttacagatgagaagactgccacccgcccggagaagatagctgactttcctaaggttgcacagggaaaggatgaagaactgcatagttaggatcaacatctgattcctggtccaggcttctgcccacaccttccctcccttccccacatcctggctgcctgaggcacagggctggtccagggaagaattgggagataacttagtgagtaatatcagcaagggacccggccctcccttcagtgccatccccttggggttctggcctccgacatttactgaggttctggcctctgacatttactgagccaggtactgttccgagcccctcaccatgccatctcattggctctccccacctcctctaccctatgacatcgttagcccattttacagataactatcccaacactcgcagcgtggagctgtccaggagtggcctaggccccatacagtagtgagcagtatgtgtatgtgtgtgtatatatatatctccttccatttaatcctcacaaagaccccactggggcagttaatattgttcccatttcacagatgaggaaactggctcagagagtgaaggtgacttctccacagccacacaacattaagtggtgtagttgggcactactggacaccagtaccatcctgttgcagtgaagagttgctgcacaggagtgaagttctatgtggggtttctgggcaacttcaggagggatttttttgcatgcatgggtcagtggggaagatttttgtaccctcccaggtgtgactcatctgctgattgtgcttctcagcattggaactgggctgaaggtgaactgggctgaaggtgggtcctgctttggatggggaggtaagatgggtccacaggggatggggccaccaggcaagccgccggcacatgatgactcggctgtctgcaaagatttcaggagggtcttgcacatcctagggagtgtgaaaggcctttgggtcagaccactggactcggatcctagctttgcctcttcgcatctctgtgactgtgggcagtcactttgcccatccccttgtctgtaaagtggagaaaacaatggtgtctgccccttagcctgttgtgaggattaaatgggactgaggttagcacagctgcatatttagcaccaagctggtgtgcagtggccggtccataaacaccccacagtagtacatgactcaagactacatgcaaggaagtgctgaagccagtgagacccagggctgcctaactatagagcctgggctcggagcccctgtactctcctaccccaggagaycattttacagatgaggaaactgagtcccatggaggggaggagagacttgcctgaggtcagattacaagctgtggcagagccagcattaggacctgcattcttggcactgcatgggggaagtaagtgcaccttgggacatttccggctgacctcttctctgctgtgttttgactagccctggggcggctcagccagttacggagttgttcatgaaggcggcaaggtgcatgcttgcctgggccagttttgcattttttaaactgtgacgaaatacatgttaaaaaatttactcttttaaccttttattttagtcttcaaggagtttgtatgttatttcattttattttattttactttatttttttgagatgaagtcttgctctgttgtccagactggagtgcagtggcaccattctggctcactgcaacctctgcctccaggttcaagtgattctcctgcctcagcctcccgagtagctgggattacaggcgtgcgccaccatgcctggctaatttttgtgtttttaatagagacggggtttcaccatgttggccaggctggtctcgaactcctgatctcaagttatccactggcctcggcctcccaaagtgctgggattacaggcatgagccaccacacccagcctgtaatttattttagaagacatgtatattaaaatggagatctaataaatacaaccctaataaaaattaatcccaaacgaatggcattgtcagaaggagtagtgccaactaaggcacacggtaactccagaacatcttcttactgtcagccctcatctggattactgacaacagcccctgactctcctcccttcccccaaagataccacacactaccccatgacctgtctttttgtgatcaaagtgatatttctaaaatgcaaatctgctgtcattcctcttctttcgcaatcattccccattgctttcagggtgaagtccagactccctggcatggcatacagggacattgaccaccacttccgtgacctctgtagcttttctcaccctttcagctgccctgaaaatacagtgtccctgtagctctgcatgtgtcattctctttgctgggaatacccttctcgcctcttcctgctcttctttgaaaactccctgccccctcccttttaaaaaaattgaggtaaaagatgcataacataaaatgtaccattttaacaatttttaagtgtagcattaagtacattgacactgttatgcaaccatcaccaccatccttctccagaactttttcatcttcccagactgaaactcccactaaacagtaactccccagcccctcgtaaccaccaattcactgcttttctctatgagtttggctactctctccatctaagtggagtcatacaatatttgttctttggtgtctggcttatttcacttagcataatgccctgagggttcatccatgttatagcatgtgtcaaaatttcattcttttttttttttttttttttttttgagacagagtcctgctctgttgcccaggctggagtgcaatggcacaatctcggctcattgcaacttccacctcccgggttcaagcaattctcttgcctcagcctcccgcgtagctgggactataggcacacaccaccatgcccagctaatttttttgtatttttagtagagatagggtttcaccatgttggccaggctggtctygaacccctgacctcaggtgatccgcccgccttggcctcccaaagtgcaggggttacaggcatgagcctccgcacctggcctcattcctttttaagaacaaataatattctattgtatggatatggatataccacattttgtttatccattcatctcgtccaccaatggacatttagcttgttttcaccttatgactactgtgaataattctgctatgaacatgggtgtgtaaatatgtgagtccctgcttcatttcttttggatatatatccagaagtggagggccactttattttattttattttattaaattttgagacgaactcatgctctgtcacccaggctggagtgtattggcgcgattcagctcactgcaacttctgcctcccgggttcaagcgagtctgctgcctcaacctcctgagtagctggaattacaaatgcctgccaccatgcctggctaatttttgtattttttgtagagacggggtttcaccatgttggcaggatggtctcaaactcctgatctcaggtaatctgcctgtgttggcttctcaaagtgctgggattacaggcatgaaccaccacgcccagacagccagtttgttttaaatagaaaaattcatccagccctcagctgcctcccttacccacccaacaccctatgagtggttctaagaacttctgtccctggctctgaggacaaccaggagacaatgtgaatgactcagtgacagcctgttcacataatgccaaacgactcatggctccagagctgtctgccttgccttgggaggtagtgagctccttgtcattggcagtgtgcaagcagcagaggatggccagatgctttctgggtggttcttcattggaaagagaatggattggttgaatgccaaggaaccttgcagctgtaaggctctgaggcctggggcttcttaaattctgagttctccattctgagaacctgggctggtactaagattcagccactgtaagtgttctggggcttttctgttgctgcccttgagtgcatctgcaggaagaggggagtggttgtaatcgtagtgtgggaacagctttccagtctgccttcctttcacactgcatcatgagcattattccatgtggctctgtagccagggaattcatctttctggctctgtagcattccatggagtgaaagggccacggctgtccccaggtgttagacatttaggttwtttgtagtttcttgagactccaataggctcacaaaacctaaagyttatttaagttttttctttatataaaaatctttatttttatatttgtaaatttaacttaattgaagtattatttgtatacaatgaaatgtacccaagttaagtgttacctacatatttgccccattcagcagagaaatccgttttatggaataccatgatgtattgatgggcgttttgttattttcaattttcccctaatggccaggcatggtggctcatgcctataatcccagcactttgggaggccaaggtgggaggatcccttgagcccaggagttcaagaccagcctggccaacatgagaaaaccctgtatctaccaaaaaatacaaaaattagctgggtgtggtggtgcatgcctgtggtcccagctacttgggaggctgaggtaggaggatcgcttgagcccaggaggttgaggcttcagtgagctgagatcacaccactgcactccagcctgggtgacagagccaaatcctttcttgaaacaaaaaccaagaaaccaaaaagaaaaattagctgggcattgtggctggtgcctgtggtcccagctactccggaggctgaggtaggaggattgcttgagccccggaggtggaggttgcagtgagccgagatggtaccactgcactctagcttgggtgacagaacgagatcctgtctcaaaaatttttccccctattattttcctattatgatcagtgccacaatgaatttccrtgtgtttgtatatatgtgcacacatctgcccttactccaatggtctggcatttctgtaggaagagatttaaatatatataaaatgacattttggtcaaatggaagaggttcttgtaggagccattctggggtggggtgaatggagcaaggtggacaaacatttccaaggatgctctggaagcagtgtgtgtttttctctttgacctggtctctctggctgctgatcaggcccttggaaatcctgagatttcaggcattaggaacacctggattttgatgtttaagaaccagagcgaactgaaaggccaagctctctgaaagcggaacagctttcttgtgtctcagatgtctcaaattgaaattaaatggtaacaagccagcatcaggacctgacagggcacctgggcacctggctcctgagatcagtacccactggcctcccttggttttctggtattrggttttttgttgtttgtttgttkgttttttcatcactgggatgtatttaaattaaataagatgaccatcagtgaattagcgagctggaactagtgtagtcctgtaggcagagcctggcccttggtgcacacagatctgaatttgcatcccagctcctcagcttacttgctgtgtgaccttggtcatgccacttctctgtctcagttttcccatttgaaaatggaaagttaccacacaattcatagcatcagtgaagcttaatgtagataaagtgcttatcacagtgcctgggactgagtaacccttcgtaaatggtagctgccactaatactacttgaatctcagtgctgttatcaacttgctgtgtgacctctggtaagtctcttagtccctctggtctcaatttccacgtctgtaaaatgggactaataagctgctctaactgatacccagaatgttctttatagcaggggtccccaacccctgggccatggactagtatctatccatggcctgttaagaactgggccacacagcaggacgtgaacagcaggtgaacaagcattaccgcctgagctccgcctcctgtcagatcagtggcagcattagattctcataggagtgcgaaccctattgtgaactgtgcatgcgagggatccaagttgcgtgcttcttatgagaatctaattcctgatgatcagaggtggaacagtttcatcccaaaaccatatctgccccctgccagcacccctgctgccatctgtggaaaaagtgtcttccctgaaattggctcctggtaccagaaaggtttgggaccactgctttatggcctctaaaacatttttcaggcttttcttatcctctcacccaccaaggacagccatggataggaggcaggtcttggggtggcagctgcaagatgtaaccagaagttgctggacaggtggactgtttcaatttagaccatgaggaatagtttcgtttccaaagcattttgtttagcatctgtgtgaacgagagataggygaggagcatttctagtttgggggagagtaagaggggaggcagatgcccgccagcagggtgtgctgtgtgccttgtgaccagtccagaaagaaaagcagaggtctctgaggagcaaggggcccctgccagcctgctcttttcaaagctcatctttcaattcctgacccttggctccagcccctcgagtgggtgcccacygctcttaggatgaaaaccagtgtcctgttcctgactgctggtgcctatgtggtctggccttgccagcctgtctgacctcatactcaccgctgactgtctgctcaccaagctttggccacgagggccttcttaaattcctcaaatgcccagcccctacccaccccagagccacctgtctagaactttctttcctccctttggtctggcagtgtctcctcatccctctgctctcagcttattattttattttaaaatatttctttttaaaaggccaggtgcagtggctcacgcctgtaatcccagcactttgggaggctgaggtgggcagattgcttgagcccaggagtttgagaccagtctgggcaacgtggtgaaactcygtctctacaaaaaatacaaaaattaaccaggcatggtggcgtgtgcttgtagtcccagctactcaggaggctgaggtgggaggatggcttgagcccaggaggcagaggttgtagtgagctgagattgcgccactgcactccagcctgggtgacagggcaagaccctgtctcaaaaaaaaaaaaaacaaaaaaagaagaaaagaagaaaacccttctttttaaaagatacggtctcgctatgctgcccaggctattctctaactcctgtgctcaagcgatcctcctgccttggcctcccaaaatgctggtattacaggtgtgagccactgcacctggcctgctctcagcttaaaagtcacttcttcaaggagggcttccctgacatgccaccctcaatcaaacctaggctgcattagcactcttctggcagtgggtacatgtccttcttagcgcttgtcacgatgtgagtcatgatttgtttagtgtttttcctgcttgtgtaagctccaggaaggcaaggcctatgtctgttgctctccaggctcttaaatccctgggtgaggagtaggggctgtttgggggaagataaagtttaccagaggtatctggatgtggggcctgtttctttaaaggctgggctgtggactgggctcccaggagggtgagtctccttttcaggtgtggcatagtgtgtcatcaccagcccctgaatgatttcagccaggccaggggaagggctgacsgcaactggggcagaggaccctggagagggaaagggttagaccgccacctgctgtctagtgctggtatagcctcagagccgaaaatcattccgtttatccaactggtgtttattctgcacttgctgttttctgaggtcttaacatgtgactggtactatgccaaacacttcatattccttcaacagatagcctgtaagctcctgctgtgtgacagrcactgttcgaatttctaggaataccacaatgaacaaaacgcaaaaattcctgccccgctggaaagcggaggccgacaaaacataaagcctcgctgatggcagaagtcccgcggggaaaaattaagtggggaaggggaaagggagcccaagggggctacaatgtggaatttctgtttcactctcacaactgctttgtgaggagtacataccactatgttacagaagaggacactgaggcacagagaggttgagtgagttgtataaggtcacgaaggtaatcggtgacagctggccttgtgatttttttttttaaactactctccctccctgtaagaaagaaacagcgtgacctcggctagctctcgctttcaagccacagtatcactggagatagacccaggtttgaatctgggttctgtggttactggctgtgtagccctatatgacccagcctccctctcggacctgaaagttcaatgggctggtgtctggggaacagtgtgctcctgcctagcgcagcacagatgcgccgacctctgggcaggtggtgagaggtgcgcgcttgggcggtgaaggggagagggaagagtgacagtgccctcccgcaggcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaaggtgagtgccccaggggaggcagggcggcctccagcgaggggcgtcagtggctccaggatagagggcccaggcttggggtcacagcttatccagaagaggaggcagggtgtttgggtgcactgatgatctgaggttggaaatgaggggaggagggcttgagcctcttggggggattcttctttctcttaggccacagtctccttggaaaatcttattaatcattatcgccccctggacactggcctaggggatgctcttctccctcttagtgcttaagcccaggttggggctcctaactcttcccttcatctcagtgttttacagcctagcacagacccagggggacgtgggcatcaccgtakgtgccttatacacattttagtgtgtataaagatgagattccctggggagtttgtagaaatgcagattctcagactccaccttgaggctctattccatgggagaggggccacagaatctctgttttcccaagcatctcagatggttctgatgtaggtggtgggtggagaacactttgggaaccactgctttagacrgcgcaatagtttctgaggctgtgggaaataaacartaacaagatgtaactggggagctccctcccagggcttcaggcccagagagggctaggaatggaggcggaggcagtggagatagaggtgaggggctcccctccctgtctggtccagcccctgctgggagagcctctttcctggccggccttgggagaccagggctctggtttataaagggagctgccagggttctgtgagrggtggggctttgacgctgctctgtctgtctccacagctgccctgggtgtgtgaggagggggccgggatccccaccgtcctgcagggccrcatcgactgtggctccctgcttggctaccgcgctgtctaccgcatgtgcttygccacggcrgccttcttcttctttttcaccctgctcatgctctgcgtgagcagcagccgggacccccgggctgccatccagaatgggtgagagaggggtccctgcctgcaccctgggaccttcccccagtgccttgccygctcctctgcctgtccagggatctgcagaccctacccaccactcaggagccacgggagggcacagcatggagaacagctctgagttatatccatttctcagatgaagagtaaggctcagaaagggtggcagcaagcctcaggccccgcagcacttcagtgacacagctggggctggacctgggtgaccaycctcaccactgcttggtccttcctcctgccccttagggttttttccagggccaggagagactttctgtgcctatcagaccaccagaaagcccaccctcacccctctcagcacctgctgtttgtgggtgggggctctggggccaggcccagtctggcttccagtttcccygcctgcactcagcttccttgtccattcccygaccccttctgtaggttttggttctttaagttcctgatcctggtgggcctcaccgtgggtgccttctacatycctgacggctccttcaccaacagtaggcggacttggcaggaggcmtggggggctgtggggagggaagtggggcggcaggttggaggaacgtggtggggctgctctttgctggggcacacagacccctggctgctggctaggtcctcgctccccacccgtgagacagcactgtggtgcttggccacacggcctttgtgcaacccaggggtagggggagctgtcttgcccygacccatatcctgccctctgtgcgtagctaggggctccctgagggcagggactctgttcttctcagtgtcccyggtgcagggtgtagcagaaaacgcttgttgaacgagtagatgtgagagagggaccctcctcgcctcactcccctctccccacccagtctggttctacttcggygtcgtgggctccttcctcttcatcctcatccagctggtgctgctcatygactttgcgcactcctggaaccagcggtggctgggcaaggccgaggagtgcgattcccgtgcctggtacgcaggtcagtgctgccaccctgcctccgtgtggggactcgagcctgggcagggctggggctgcctgagaaatcgagggtccttgaagctagataaaactggggggcatccctagcagccactgccttaggtcaagattccaattgtcccagggagatggggggcaccagctgatcctgggatgacttcagggaatccgaggagagctgacctggagaggccttggaggggtcttgtttgggggttcctgcagggtgggccacacacagccagtagtgtgggacgcccttttggtggtgcccaggctgaacttcaagtgacacctggtccctgaaaccccagtagcagggtgagtccctggtcctttcagttctgaacacaacgaggagaaaggctcacctgggtgctgtttggtttccacacctccctagacttgccagtatctctcagacagggagggcaggtcaacagcctgtacctcgttcagtttttgcaagactgttttgagttcattgtatttattgttacaattcccttattacaaggtagcaagtgaatcatgttagctcagggtggggcaatgactcacaaaggtgttggtgaaaggcagtgacgtcattcttcaagtggggaaactgagagctggagagggggagagctgccaacagggtccctcgagggagtagggatccctgttcctcctgccccacccactgcctaccctctcactacccctctggcccaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggtgagcctgcctgwccccccctggcctgaagccyggccccttagtgggtgggacttcttgtaggaacctgggtcctggggctagggctgtcatcacagaggcacggcctgagtgtgtgggctcccaggtcagcctccccaggttatagtcaggctctcacggcttcatgctgggtgtctttaggaggtgccctaacctctctctgcctctcaaatattaaatggagataataagacctactattggagttattctcaggattgagatcctatttgtaaacactccatgcctggcctgtagatatctctcagacattagctattattgtagttattattgttgtcatttttgtttttatgcaaatcagtagaacattaggggcagtccctgagtggtgattcctagacacctctggaagtagtgtaggaaggtgcaatttcacatttccaatccaagaccatctggaataatgggcaggagctcccagaggaactgcgtgttcttcagaaagtaccgctggagccccttgtgagtacagtggtgctttgtggtttgagatctcagcacaccggcagcttcagggggcttaggtagtcttcaggggtctttagcagaaaggctgggaacctcccttctggtcagagcctcatatcccagtaagaaaagttgaagcccagagaaggcgatgtctgtgtcccaggtcacacagcaatcagtatttatccagcaaatacctcttgagcacttcctgtgtaccaggccctcttctagatgttggggatatggctgtgaggaaggggaggaagaataatgatgatagccagtagttagtggcctcggacatgttatttgatcctcacaccatcctcatcctcactttgcagatgaggaaacaaaggcttagagaagaggcctagccaaggtcacatggggagctgggattcaaacccaggcaggctggctccagagtctgtgctctggttttcttttttctttctttcttttttttttttttttttttgagacagggtctggctctgttgcccaggctggagtgcagtggtgtaatctcggctcactgcaagctccgcctcccgggttcaagtgattcttgtgcttcagcctcccaagtaaccagtgagctgctcacctcagcctcccaaagtgctgggattacaggcatgagccaccacacccagcctaaarttttttttgtttttgtttttttgagacagaatcttgctctgtcacttaggctggagtgcagtggtatgatctcagcttactgcaaccaaccttcgcctcccaggttcaagcaattctcctgcctcagcctcccgagtagctgggattacaggcacccgccaccacacccagctaatttttgtatttttagtagagacagggtcttgcgatgttggccaggctggtcttgaacttctgacttcaaaccatctgccygcctcagcctcccaaagcgctgggattacaggcatgagccgccatgcctagctgcctgtgctcttaatcacagagttcaggttcatgtttttatgtgcatgtgtggtgaggggtggggaaggacaggcaacaggggactaggcccagtgaggtgattttgggtaatattgcaatgtggaacatgaaagagggtgtgggctgaaaggtgggtggctggcaggtgcagggctgccgtagttcaggttccyagggctccgcaggagtcctgtctgaatactgaagaggcgctgcctgtgcggagatgctgggaaggaacytgtcagagsgagggcacagcgacggcaaaggccttgtggtgggagaggctgggcagactctccagacggagagcagggaggagggggacagtgggccaggtggagatgaaggaattcagtgtgatgagatggggtttcagcaggggaggagggcaagtaatctgaggggtgttaagagaaagaagaattaggactcagcctktggttagtgaggtgggtggtaggtggcctgcttggtgttttccctaagtggggtgtggtggggtatcctaggtgggtgggagtttctgaggtcccttggctggtgtgagtgggctgggtggggtggggtgtctctggtctggcaggggtcttaccaggggtcctcttgccaggacgcccagcccaactcgggtctgctgcaggcctcggtcatcaccctctacaccatgtttgtcacctggtcagccctatccagtatccctggtaagtatgggcccaggctcaaggaggcctggcctcgttcctgggtcagtatcagtctactgtggggctggggaccctcacaggtgacagggacatccctgctccagcccattctgagactcagtcctcccatgagatgggagggccccgtctgttcctgagttgtctctctgcccttgtgactgctgagcgctctgttgctgggacttgagtggttggctgtgtatctgtctgtctattaggggtggctctctagccatcctcagggccacttggctacctaggcctggcctgcatgggctgagggtgattgtgctcccatctccagaacagaaatgcaacccccatttgccaacccagctgrgcaacgagacagttgtggcaggccccgagggctatgagacccagtggtgggatgccccgagcattgtgggcctcatcatcttcctcctgtgcaccctcttcatcaggtatggccaggtctggattctggggaaggatcrtgattgagggccctgagccagagtgaggggagggtgtgggagccaggataccaaactggaacgtgctcttcacattcaatatatccaggtcttgcattgtgcgggaggggaaactgagtccctcagagggcatggcatgagtgggcaacagaggcaggcgtgaccttgcctcctggctcacagccctttcctgcatactgggccagttcagttgggtgcagacggctgtggggtcagggaaggagcatggactggggtcagtgggtccagggtctgtttctcccctgctgtgcggcttggggtaagtggcttaacctttctgagctcctgtttcctcctcagtaagaggatgacaacctccactgtagtggatgtggctgtgaccccacactctcccccgagagaaggcagctcatgctgaagttcacatagaggttcttttcaaaggggcatcttagtaggtgcttatccatgtggactcaaatgcctgcatttgagcctggcattgccacttactagctatgtgatcctgggcaagtcacttaacctctttaggcctccatttccttgtctgtaaaatagagataaaaatagtaccttcctcattggattgttgaagggctatagatgaatcagtatgtgtaaaacacttagaaaggggccaggcatggtggctcacacctgtaacccccagcactttgggaggccgaggtgggaggatctcttgggcccaggagattgagaccagcctgggcaacatagtaagacgctgtctctttttaaaaattaacaaaacaaaacaaaaacacttagaaaggaacttggcaagtagtaagttatttgtaatccaaacactttgccagactgaagcaggaggattgcttgggcccaggagttcaaggccagcctgggcaacatggtgtctctaaaaaaaaaaaaggttttgtaattagtcaggcatggtggtatgcaccttctagtcccagtgactgaggaggccgaggtaggaggatcacttgagcctgggagtttgccaaattaagtgttgcatattattgtgaacatttgcataatattgtgaacatttgtatattagtatgagcataatattgtgaacatttgcacaactaggtagctgtaggtggtggctgttcttacaagtcactagatcataagattaggtttaattattgtttacacggatcaggcagaccccgagtttgcctccctgtggccctgcatttctccaagcaccactttccatctgcccttaactctagagggaatcttggctctgctcccctgatctccccgatccatccatcccagttccaacagcacccctgcccccaggcccctgggctagaacattttaaagctctttcacattttcttctgttttggcctttttcaaaacattttctccaagtcagttctgtacagttcataaacatctgtcttctttgtcacatttgattccttttcaagctggaaaggcttgaattacctctgtgtcctctcctcttccctcccctcccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctggatccagctctccttttccttttgtttggaaacgtgtgttggtttttcaaaaatttttatgtctcaaactatcaaattctgttaaaaacatcaaggctcatcacagaaaagcatgacatacaatcattactgttgttctttttttagtgtaagcatgaaggaaagggaggccattggtaaaaccacctgacactaataaaatggaaacttaaaatcaatggcaaatgagcgtgattaattattaacattcttaatggatgtagtacctggtatggtactttgtagtattaggtactcgatacgtgtttatggaaatggcaaaggaacaatcctaacaatagtgactgttgattgaatttatattctgtgccaagcactatgctagagaccttacatcattattccgtctagtccccccagcagccctctagaggaggtacgattatcccttattttacagacaaggaatcagaggctcagagaggttaagtgttttgctcaaggtcacacagaaaatgggagtgggggtaggggtagagttgagaggcaaagcagtttgttaactcccaggcccagtaaccgggtcgctggcccctgaggctctgggaccatttgtgtccagtgttatgagcaacgccagagctatctatttgcccaccttcctccctcccctgcagtctgcgctcctcagaccaccggcaggtgaacagcctgatgcagaccgaggagtgcccacctatgctagacgccacacagcagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagtgcgtagctggtggggcatggacagagcccggaggtgcagggtgcaggtccacacatctctcctgcggcccttcactgggttttcctgatgtctgcttaaggcttgggggtggcggtgtgtatcaaggaccctccatagagcctgccccttccctgctacagtttccccaacagtgccttcatctgctcagctcccgcaccttcactaggagactgaaccggggaaggcacagcagctggggctggacctgtacagggcaggcggggtttacaaatcaggggtcatggggtcagatttgggcttcatggttggagggttaggatcagggtgtggagtgcagaaccaaagttacaaggtcaaggatagaagtcatgaggtctggggctgggattgtggtcatttagtgtcacaaatttggtcatttggttaaagttaaaattgagagtaggaggtcataaagmcaggattgaagtggcaaggtcaaggagctaaatgacagtaataaggtcaggggccacccctaagttacaggatcaaaggtcagaatcaagggtagcggtcaggactaaggtcaggagctccagggtcccaagttcagaggctaggattgaggtcccagaattaggatcacaaggttggagaccaggagtcaggtcatgatctcatggactaacactgggctcaagatgggaatcgaggtcaggagctatgtccacggtcacaaggccgggtgttaaaaatgtcagagatggactggagttacagggtaagagccagagttgaagtcaggggtcataactgggacataaggccaggggccaagatggaagtcaccagactgggcaccrggctcatggggaagatggtgtgttccaggcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcggtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacktcccccaggggaccctgcccbcttcctggacttcgtgccttactgagtctctaagactttttctaataaacaarccagtgcgtgtaccatgttctgtgcccctcaccctcagcacggagccccactgcatgggggccggtgtggggtttgggaatagaatgttagggctgaggaggctgggacatcagggccagaccaggaggagcctcaaaggcagacagaatggcctgagttctgtcttctgggtcatggagcgcctgaggggagggggccaatgaggaaggaggggcagaccagggttttgggaaagtagggtgtgtctggtggtcagaaaaggagaccctagaggcagtggggccagcaggaggctgcccgaccatccaaccatccgagggagggcagtgaaagagagtcacggtggggaggagggggcgatgacagggccagaaggtggtcttcaggtcccctctcatcagggcctgcctcaaggtcctgcccacctctgacctgcctggaattgttaccaccgttggtacctgccctgaccagtcaagccccaggcctcggggtgctgtggggaggagcatgtgctcttgagtcagccaggctggcccagatccctccgtaccacggcagccgcggggctgctgtccggctccggatgggtccttctcttctctgggccctggttcctcattcattcaatgggaacaatgccacccctcctaggctgttgtgaggatcagaggaagcagcccatgcaatctgcctggcacagcgagttcttgagaaataacatcagcccccatctcacaagggcagagagatgtgagggagactgacaggctcctggctagggccccaaggcctggtcttgttacgatgatggactgcaggccattcatcccttccatttgtggggataaaaaataggtatgaaggtgctggggatgggtgctggggacacagcctgtctctaaggctctcctgggttctggggtgagtgactagtggggctgcacggggacctgtggggtcaccgaggaggcaggacaggcatctggaggatgtgtaggagtcagctgggccaagaggagccacagcactgagggcagggggacaacacaggagtcggagggtgtggggttcaaggaccagggagaagccaagatggccagggcacagagaggggtggggtggcgaggttagtatgagcttggagacatgggccagaccaaatcacacaggcccttgagagtcatggtggggagaccagacctaatcctgctggtagtggggagccatggagggttttagagcaggggagaagtggtgaaggtgtgggctgaccatggaaaggccctacatgatttcgagcacagcaggggcatgtcattttaagattgccattttagaaaggtttccctggatgagatagaggggagtgcagcagctgggggcaggtgccagggctcagggcagagggagtcggggcctgctggggcaggggccgaggagggcttctcttgccgctgggatggatcttgcagatgctcttgtccctggtgcctttcagctgagacccctgtcttcagagcagcctgaacctccttcgcccaaccacagatttcgcttattttctcatttcacccttgggagaaaaagcccacgttgtgctcttgataacattttctttgcatttgtgcaagtgggcaattttttttttctttttttgagactgaatctcactctgtcacccaggctggagtgcagtggcacgatctcagctcactgcaacctccgcctcccaggtttcagtgattctcctgcctcagcctcccgggtagctgggattacaggcatgcacctccacgcccagctattttttttttttttgtattttttttttgtatttttagtagagatgggttcaccatgttggtcaggctggtctcgaactcttgacctcaggagatccacctgcctcagcctcccagagtgctaggattacaggcatgagccaccgcgcccagcctaagtgggcaattttgtccagcttttgtagccttgttgctctataggttttaaattattcattcaacaaatgtactgagcatgagttctttgctgggctgggctggagcgggactggctgggaagggtcaggggccaggctgagaagctggaatgcctggctagagagctgcaggtccccagtgtggaggtcaccacctttgggaagccacctctaatcccacaggtcgggcttccccctgtgtctcctcagccctgttcttccttccaggcattggctatgctcatgaacctgctggtcgatgtcaggcctgaccagctgcccacccaggacccaggacatccacttagcctgtctgctgggtgctcccttgtctcctgctgcctagcattgtggtttccacatatcctcctgtcttcccttctcctccctcaccctcatctttcctccacctcctgttctccatcaccttctctttctcagtcacctcctcttctccatcatcctctctgtcacttctctttcctttactctccttggtcacctcccctcctttgtcagtaggtgggagaggcccgtaggatcccactctttttgtctgccagcccctgacacattgggcttccctgctggactggtaatggggaaaacgctgtcctcagccctgagggcccatgctgtgcccctggacactgtgccgcagtccccaggcctgggctgctgtcactgcagaaataccagtggcagcctcagccctgcctgtcctggcgcatctttggacccaggctgtggaatgagtatctgggcagagtgagtgcaaagcttatagatcatgtcaggaacagaggcagtgtgatgcatgtgacgagcctgccattcccaacccccgtgccctttcctgcctccatcactgaggctggaaaagccgggtggtcactttgcagcttccctcagagttagacgccttcagcctaattagatctaagtggaaatgttcatggatatttccgggagttcttgctttcgtattacacagcactgcttcttccttctcctctttggacacaaccacagtacctggggctgcagcagctgtcttgggacaatgaggcaacaagtctgaggatgagaaaccaacctggagaagatggtgttcagaaaaataggaagttggctgggcgcagtggctcatgcctgtaaccttcagagcagcctgaacctccttcccctgtaaccccatgcctgtaaccccaacactttggggggcagaggcaggaggatcacttgagttcaggagttcaagaccagcctggacaacagtgagaccccatctctacgaaaaataaaacatttgggctgggcgcggtggctcatgcctttaatcccagcactttgggaggccgaggtgggtggatcacgaggtcaggagtttgaaaccagcctgaccaacatggtgaaaccccatctctactaaaatacaaaaattagctgggtgtggttgtgcacacctgtaatcccagctactcaggaggctgaggtaggaaaatcgcttgaacccaggaggcagaggttgtagtgatccgagattgcactactgcactccagcctggcgacagagcaagactccgtctcaaaaacaaataaacaaacaaaaaagaaacaaaacacttgtaatcccagcactttgggaggccgaggcaggcggatcaagaggtcaggagattgagaccatcctggctaacacggtgaaaccctgtctctactaaaaatacaaaaaattagctgggcatggtggcgggtgcctgtagtcccagcttcttgggaggctaaggcaggagaatggcgtgaacmygggggacggagcttgcagtgagctgagattttgccactgcactccagcctgggcgacagagcgagactgtctcaaaagaaaaaaaatattagccaggcgtggtggcgtgtgcctgtagttccaactacctgggaggctgaggtgggaggatcgcttgagcctggcaggtcgaggctgcagtgagctgtgattgtgccactgcactccagcctgggcgacagagccagaccctgtcttgaaaaaggaagagtctaggtctttgatgcatctttaagtcgctacatcatctctgctgtccttgactccagatgcctgttatgtgaggaggaaaacaaaccccaatacatgcaagcccctcttagttgagtattacgttccttgcaactgaatgtattgctaactgatatgacttgtgagatggtcattcattttagtgaaaataaaaataacaaacaggagaaacctgtctccattactcagggacattggctgccaataatgtattatgtgtgcacaacctccccatatcaatgtgtatatttataaacatatgtgtattagatatgtttgtataatatacatatgtatttaccagtaggataaattatgacaaaatagttttttgaaggttttgggcctccttcccccttttgggggaagtttgtggaggtgcagcaagtaggagagrgttacctgcaaaatataactcctctcctaactctggtttccaaaagcctgggttcactgaggagctcctgggtartgagggatggggcagtgatggaggcagcacaggggcttcctggagggagaggagagagtgaggcacagctggagacctcgagagagagaagcatagtctccagcccagccctacagtgcgcctggtgggctgggacagtgggtattttggcagtaaccagtgtggattggtgtccaatggtgctgggttcttcccactctgcccactgacttgctgccacaggtgaccccaggacttttgctctgtcctggtgagggatgtgtgtgtgtcagagagaatgatgaatgggctgaggttgaatttcccaccagcatggtgggatggaaaatttggatagaaagttgatgcaaagcaaatgggccaggtgcagtggctcacgccagtaatgccagcactttgggaggcaggggcaggaggatcagttgagcccaggagcttgagaccagtctgggcaacatagcgagacttcatctctattaaacacaaaaaaatcagccaagtgtagtggcatgcacctgtagtcccagctacttgggaggctgaggtgggagggtcctttgagcccaggaggtcgaagctgcagtgggccgagattgtgccactgcactctagcctgggcatcacagtgagactgtttccaaaaaaagggagagaaaatgttgatataaagcaaatgaatgatgctgtttcttgcacacctgtgaattgtcatatccactttattgatttatttttaatttaattttatttttagacagggtctcgctctgttgcccaggctggagtgcagtggtgcgatctccactcattgcaacctctgcctcccaggttcaagcgattcttatgcctcagcctcccgagtagctgggactacaggcgcatgccatcatgcctggctaacttttctattattattatttttctttggtagataccaggtttcaccatgttagtcaggctggtctcaaactcctgacctcaggtgatccactcacatcagcctcccaaaatgctgggattatagtcatgagccactgcgccaggcctcatatccactttaaaataattttagatataatgcaagtttatggtttgtttgtttttactttttcttttttgagacagagtctcactctgttgcccaggctggagtgcaatggtgcgatcttggctcactgcaatctctgcgtcccaggtgcaagtgattcttgtgcctcagcctctcgagtagctgggattacagggatgcgccacaatgcccggctattttttgtatttttagtagagacagggtttcaccatgttgggcaggctgctctcaaactcctgacctcaagtgatctgcccgcctcggtctctcaaagtgttgggattacaggtgtgaaccaccacacctggctgcaggtttattgtttttaaataaagccccacttaaa

SEQ ID NO: 12262 - DNA, 32391 bp, Homo sapiens
ttaagatcctcttattctttcaagctttacaaagggaagccccacaaaaggacacaggtggcaaatccggggacctggatgctgggtcaccgacttcatgttcttgctgacttcctggcctcggttttcttctccttaaggctgggtgaatggaatgagtttagatccctggacctccaggccctcctgtgccccggggtggccctgcttcacagggatgcccgtaagaagacgttgcatgcgtaaaaatcatgccctgctccaccacagaggtgagatgagacaggaaatgagctaattggcgtgagaatgcttggcacttttagggaaaggagaaaccgaatcccaagagaatgacagtggcctttgtgtgaccctagtaccagggcccctgctttcgccatggcctcagatagaggccacatacagcaggtgctgggcccccagcccacccacctccctgctttcaccatggcctcggatagagaccacatacagcaggtgccggggcctccagcccgcccgcctccctgctgaaccatggaataaggagctgcagaggaggaaagattttggagtcgtgctgacctgggtctgaatcccagctcggagggcctgctgccacatctgtacgtgggcatcctcttttacgtgagtgtctcgggtcgggtcctcccagaagcaaatgctgagttggtggaaggaatgtgaaggctataggggagtggcacctgcttaaggagaaggaggccgggctgggcaggaggatgtggcacctggtaaggagaaggaggccgggccgggcaggaggatgtggcacctgtgtaaggagaacgaggccgggccgggcaggaggatgtggcacctggtaagaagaaggaggctgggccaggcaggaggatgtggcacctggtaaggagaaggaggccgggctgggcaggaggatgtggcacctggtaaggagaaggaggccgggccgggcaggaggawgtggcacctggtaagaagaaggaggctgggccaggcaggaggatgtggcacctggtaaggagaaggaggccgggctgggcaggaggatgtggcacctggtaaggagaaggaggccgggccgggcaggaggatgtggcacctgcgtaaggagaaggaggccgggctgggcaggaggatgtggcacctggtaaggagaagggcggaggccaggctgggcaggaggatgtggcacctggtaaggagaaagaggccgggccaggcaggaggatgtggcacccggtaaggagaaggaggctgggctaggcaggaggatgtggcatctgcataaggagaaggaggccgggccggcaggaggatgtggcacctggtaaggagaaggaggccgggccaggcaggaggatgtggcacctggtaagaaggaggaggccgggccaggcaggaggatgtggcaccttgtaaggagaaggaggccgggccgggcaggaggatgtggcatctgtgtaaggagaaggaggccaggccgggcaggaggatgtggcacctgcgtaaggagaaggaggccgggctgggcaggaggatgtggcacctggtaaggagaaggaggccgggctgggcaggaggatgtggtacctggtaaggagaaggaggccgggcaggaggatgtggcacctgcataaggagaaggaggccgggccgggcaggaggatgtggcacctggtaaggagaaggaggctgggcaggagtatgtggcacccggtaaggagaaggaggccgggctgggcaggaggatgtggcacctgcgtaaggagaaggaggccgggctgggcaggaggatgtggcacctgcgtagggagaaggaggccgggctgggcaggaggatgtggcacctgcgtaaggagaaggaggccgggctgggcaggaggatgtggcacctgcgtaaggagaaggaggccgggctgggcaggaggatgtggcacctgcgtaaggagaaggaggccgggctgggcaggaggatgtggcacctgcgtaaggagaaggaggccgggctgggcaggaggatgtggcacctgtgtaagaagaaggaggccgggctgggcaggaggatgtggcacagctgacacagccacaaagctcctgcccatggggcgctctgaggggcagactgcctgttggcggagtcttgtggggtggaaatggtgaggtcactgtgatgccactttgcttagtcatcggccacagggtcacctggagaagagcatgagctcagcataaaagcaaggcccaccctgcaggggccagcagctgggagctgtccactaaccactatccttgcagctggacagcgaggcccctccaaaaggccgtctccacctgccaccgggaaaggacccggagcgaaggatgtcgtgggcggtcagcccaggtgattgcccttcttttgctttggagccaggcagaacagagctcaaattccagctttgggacagtgtgtggcccagaaggctgtaactgcggagttaacactctccagtttccctagatggcccgacctggccggtgactcggggatgatgaagctcctggagcctcagcgtgctcacttgagaggtagggcagcgctttgtacttcacagggccatggggacaggctcagggcctggcactctagtgaccggcttcatgctgggtcactgactagggaatccacacacctttttagtccagactgagtaggtaaatcagacttaataaacatccagcttcctgctcgagctcagcctagttgtcctaagtctgacaagattgaactttattcacagcacgaggcataaatgatataaaggtaagcaattttaggggacccaaaaaactagggactcctacttgggtagcttagaaggggaatctctcttggagatcctggctttgctgcctcaaacccagctgtctcttcaagccaagtctgggagaatctcatgatcttatccttgctccaatttacttacaccccacatccacactaagctcttcctgcctcccgtggaatattaacttacacctgacttcagactcctgcccctatgcagacccagcagtatgcgggcctaggaggtttttcggccacaaggaactagagaagccactcattttgtcccctctcattcaccccattctgtccccatcggatgccttgggaggagagaaggaaggacaaatgggtgtcccgtgacccaacccagatgaagacagagccatttatcacagagacccagacgcatcctaactctggaaaatgggcatattgaggggagctggaaagcagaagggaaacgggcgtgggcagggaagaggtgaacaggagtgcgcacgcccagttctccaggatctcacgctcctaatcaggatcctataagactcaaaggggacgcaggaaagacctgggcctggaaattcacttccggactcctcctgtatcctggctggccctcgtttgtgtctccctccagggatgatgcccggatggaaggaggagccacgttcctccacaggtgtcctccacaacaggtgtcctcacaacaggtgtcstaacaacaggtgtcctcacaacaggtgtcctaatactcccgcagcccctcagcatctacaggctcactcccaccctacaacctttcagataggtgttatccccattttacaggtgaacgaggaaaacagctcgaagaggctgtgactttgtggtgacgcggtggcagagctgggatcaagcccgggtttgtaacgccctcctggagtctcggccgtcacagcagcttccggagagcgctgtgtgcctctggccttcctggcatgggaaagaggtcagctacctgtgttcggtcaacaagatgtccagcgcttagtttggtctcacctggatgctcctttctcctctagagatggaaaactgttgtcctgaaagcgtcaccaaacaaaacctgtggaaaggtaatggggggacccacgagcaagagctgacagaaaaatgaccacgggccgggtgcagtggctcacgcctgtaatcccagcactttgggaggccaaggcgggcggatcatctgagttcaggggttcragaccaacctggccaacatggtgaaacctcgtccctactaaaaatacaaaaaaaattagccgggcgtggtggcaggtgcctgtagtcccagctactagggaggctgaggcaggggaatggcgtgaacccgggaggcggagcttgcagtgagctgagatggtgccactgcactccagcctgggcgacagagcaagactccatctcaaaaaaaaaaaaaagtgcaaaatgatcacgaaggccaagctgggccttggtgtctgcgaattccctgcagtaggtccctcctgctgccccgtccaggcgcccacaggatgctccacatgactctttacctttatgattttcttacctccaggaaagaacagggtcagctcgtccacccagagctggagggactgttgggggaccacgccacttccccacrgtatccgcattattatggcgtggcccaggctttggcctggggccatgaacagactttcagcttctagaagcaagtggtcacagggcctccgtgaccctcggagacagcgccacagcgtcggttgcctactccttgctggacaaggctggctctgcttgggaatgcagaaaccctgagtccttgtcctgggccccacagtgtctgagcatcgaaggtccctgctctgggacgagtcaccccacagacaccccacattcgggaatcaagtcttgaggaatcagaagcagagattcacactgtggcaaagaggggagcggaggtatccccgttttcctttgcagagagctacaccaactgccctcttcgtctttacaaccctacttggggtccctttccctcctcgcttgtgcctgtgagttccaagaggtggaactggggtgagcagagcccccaggtctccaggagcagctccacctcctcacaggttacagtcgcttcctcctaccgaggttctgccttcaacccactgcccatgccagctccctcaggccagtctcccagactgtccctggctccctgcaccctggctccagctccctgccctggaaagaagaagtccaccatctggtgagggtctgccacgcatctggggtctgccatgcgtctgcactgaggttctgccacgagtctgcactgaggttctgccatgcgtctggagtctgccacgcgtctggggtctgccacgcgtctggagtctgccatgggtctggggtctgccatgtgtctgggatctgccgtgcgtctggggtctgccacgcatctgcactgaggttctgccacgcgtctggggtctgccacgcgtctggggtctgccatgcgtctgcactgaggttctgccacgcgtctggggtctgccacgcgtctggggtctgccacgcgtctggggtctgccacgcgyctgcactgagcagatattccaagcacaccacccctttccaaaagacggcatacagtgcatttctgttcctgcccctcacccacatggttccccgcttcccaattccttggggtctgcttaagtctcactctctttcccccattcatacagccccaaggtcgctccctctggggccctttcttccccattcttcccagcagcccaaagctctggtgggacaggggcagcccctggggagggaggagaggacccaggaacccggctaggagggtggcccacccatttccagtgtgacctgttcccattcccccatgtctcctcccatccctcccgccactcagctcaggctgatgagaagcagagcaacgggtgtatcggtgttttctttcctggtggggtagtggggtggggctgaggagagaaaagggtgattagcgtggggccccgccctcttttgtcctcttcccaggttccctggccccttcggagaaacgcacttggttcgggccagccgcctgaggggacgggctcacgtctgctcctcacactgcagctgctgggccgtggagcttccccagggagccagggggacttttgccgcagccatgaagggggcacgctggaggagggtcccctgggtgtccctgagctgcctgtgtctctgcctccttccgcatgtggtcccaggtaagtgatggagacagcagatgaggctggctgcggggagcacttgggggaggtgggagctgtcagagaaagaggtccggggagacagagagagagagagagagaataggggaaagggagacagcgaagaggaagagaagggagagaaaaagagggagagggaaaggagaaagagatgaatgggacaacatggggggaaggtggagagagacccagagagggaaagaagaggaagagaagagggagagagaaagaagagtggaggccgtgcgcggtggctcatgcctgtaatcccagcactttcggaggccaaggcaggagatcacctgaggtcaggagttcgagaccagcctggccgacatggtgaaaccccgtctctactaaatatacaaaaattagccggtcgtggtgggccccacctgtaattccagctactcaggagtctgaggcaggagaatcacttgaacctgggaggtggaggttgcagtgagccaagatcgcgccactgcactccagcctgggagagagagcgagactctgtctcaaaataaataaataaataaataaataaataaataaataaataaatataaaataaaataaaaaataagaagaggagaaaagtggggaagaggaggcatgaactggcagatacgggacaagatctgaggggaaagacagagggagaatgctcgaaagagagagaaaagagaacagagggccagagagcagcccggcgatgtctggaaggatccatggtgagagcccaggcttactcgcagagagaaagacaggcagagccagagcaagaggaacagagtcaaggagaaagatgtacacccttgtgtacagagctgggggtagaggggatgccaggaaagctgggtgatggagacggaagaaaactcatgtaaagctgcagggtgagaggacgagacaggtgagacgcagacaaactgaggaccctgggaatggagagaggagaagatcgggagacagcagcaagcaagggaagcgacaaggaggagaggggcaggccggccgggagggtggtgcggaggaggcggccagggcgcagagggccgggaggtgctggccgtgggcttcttacctctgagctcgggtttaaaagcctccatttgggtcacggccttgcctggggctcgtagccccggcattggccttgggctcctccgtgtacagagcygggaggggagggatgccaggcctgtgggagatgttccctcgggggcccccgtcctcttccccacactttccaggctgtccctctggcttcaggaccaagttttattctgtgtttctgggtgtctgagtctttgggggagagtctggggtccagagttcaagctggggttagagtctcagctcctgccctgcctctcagcaggctaagaacagtcgccgagggaaaatatttcttgggcgcatatttgaggagcttcctgggagtgagtcagaaggcgartgccgtttaaaggctgcaagagaagccatgctggtgaagcggacccttccacctcgggatgtttcaggactaggctgagggcaaaggaaactgccaccacctccctacacctccccaccctccagcacccccaccccaccctggccacacaaccccgctccagtgctcatcccaccgtgaggacgtggaggccggaaggagccgccacacggccctgccctgcagatgtggttgaaggagtctccacgggaatcatgactcccagagcgaggctggggcttggggcgccggggaggcagcttggatttaggagccccagkgccaagtctttgccgtgaactgttctggcccctgtgaccaggccctgccccgtgtctccccagggccccggtcccctgtgtaaaaagcagtggtgaacggttggacctcctgacgcccaagttcttgagtttccaaatctgtgatttaaagctgagcccaaatgtgctgggtaccagctggacactcagctccatgtggagccaggaagtggggtctgtggagaggagcgcagaggggcaagacctggggtgggcgtggaaaagcacgggggcgtgacccggagaaggagtgaaggactgttggtgtgcaagggcgtctccrtgacgacccgaagaagctaggcatgtcgtggagcgctgagtcctttgcgtcgctaaggggaccaagtggagctgggccaggagaggagatggtcgtggctgggagatggcacccacacatctgaccgggcatgaccagggccttggcaggaaaagcagtcaccaagggcgggtgggcagcccccacccccacagggcagctgctggaggactggcagccagccagccccgttccttttggctccctgaaggggtttacagatgacctgcctatacttgagtctagggtctgtttgcacacttgccggcaggaccctcacccaggctgggtcacactgaagcccaggccagaggaaaaacacagggtttccacaaaggagctgccgcaatgagggtttccttaaggaacagccctggctctcaagggttaaaggataagrcacagcagacagaggtgggctagacaaggacagatggaaatttggtgtctactggtcgccccaggcaggaatgactcagaaggaagcctggccgtcctggttccatgccacagggaaaggcaactgggtcgaaataggccttggtctccagcactatcagtgaccccagggaggtgacaggctggagcaagtgcagggcaggcaggggaggggacgccggccacagcgcactccacggggaagggtctttatgggcccctcctcggagaacccccggtctatctgtcagtctgggacaggccacctcaacttgccaccgaggacaccaaaactctccacagacccctctgcccctctgggaaaccccactgtgctccaggacactcaaaaggaaaggatccctggacaagaggtcctgccaggaamatcagccaaattttggccaacgaccagcaaggtgcacagggaagagcaggggctgaaactcagaggtccagcatcagcgacgcccttggcagcccagggaacacaggcaacgccttttggctctggagtcttaggctcttcatcggcraactgagcccagggggaaggggctactaygtagggttgtcatgaggatgaaacgagacagcatctggtgtaaagtagaaaaggcataaagggccgggcgcggtggctcacgctgtaatcccagcacttttggaggcccaggygggtggatcacctgaggtcaggagttcaagaccagcttggccaaccctgtctccactaaaaataaaaaattttgccgggcgtggtggcgagcgcctgtaattccagctactcgggaggctgaggtaggagaatggcttgaacctgggaggcagaggttgcagggagccgaaatggcagcactctagcttgggtgacagagcaagactctgtctaaaaaaaaaagaaaagccataaagacgtgtttgagaaagaggcctgggaagacgggggaaggagggtgattgaacccggaatggcacttgtgtcggcccagggtcatatcccttcatctaaggatcctcgtgcctctaaaaagccaccccgtgcttcctgtgggtttgcaagggctggcttggtgtattcagaatgtggcttgctgcatgaacggaccccgagggccatggccctagagcaggggctcgctccagcggacagctctgcctcaccgctccctgcctgtgagtcccgccacgcccttggtttctgggctcagccgtggaggcagaggctggcctggcagaggctggcctggcagtgcttgacacgcaagtgatttgtgtcttcattgctaaggacaagaggcaatgagaggacaagaagtggttggccttttgtacgctcaacgggtggttttgctactctgtgtcttttctctgatttcacggtgctgttaagtgcttaaaatatgcacatcgtgtagctcacagagccacttctctgaaggccaggacagagaccttataggctctctctccccctagtttcagccttttaccttaaatatacgtctttcttactgctaggctgagttcccgccccagcatgttctgagaaattgagtcaaaataactgagtctgttggcacctcatmgacgatttcttcatagacggtttttttattgttgctgttgttgttggttttttgggtttgtttgtttgttttttgagacagagtttctctctgtcccccaggctgcagtgcagtggcgtggtctcagctcagtgcagcctctgcctcccgggttcaagagattctcctgcctcagcctcccgagtagctgggattatagacgcccaacaccacagcggctaatgtttgtatttttagtagagatggggtttcaccatgttggccaggctggtctcgaactcctgacctcaggtgatccgctygcctcggctcccaaagtgctgggattataggcgtgagctactgtgcctggccctacttcatagaggtttaaatgccttttcacccttttcctggagaytctgaagaagtctcaggaactgggcatttgtgttgcacgtgaggccttgcaatggcggccctgcttggagraagggcactggcctgggttgcccgcagctccactccccgtgtatgtgtttagggaccacagaggacagacatcgactctctgtagagatgccgccccgcccaggttgcagtttaggttccaaaagtccagtggccagtggattttgggggaatttggaataagaaacagcctagactttggagttgttcattcacttgcagaatttctactcatgccagctgctctggacaggaagatgaatgcgtcacagttcctgcttttcaaagctctctaagttaagtgacttgtttaagatcatagaacccataagtgaggcagctgggactagaacccaggtctcctgactcactgcagcacacagcctttcggcaatctccaaaccagcccagcccaccgacggagggaagaacagaagcattcacacaccctgctgagacagccattcattcattcatttgttaattaaaccaccatttaggaaacgcctgccttaagttcctgacattgttctaggacacagcactggatgcacacagtgaagagtgaaacagacgtggcccagtctcttggcactaaaatcttggtgcagacagacatcaaataattacrgaaatgttctcaactgcacatgtggtaaatgcagtgtggaaaagtacagggtgtgctgagagctgcatttcgaatggccagagagtaggggaggtgcatctgactgacaagtcaggaagggccctgtgaggaaccgttctgcggggagctgaggcctgaggctgaggacagccaggtggagaaggtgccaggcctgagcaggcagaggcggagctcatggagaggcaggaaagagcttggccccttggaggacttgaaagagaaggcaggtgttagatcgcgcagggctttgcaagctgtggaatagattatgaattttatgttattttatttatttatatttttgagacagagtctcactgtgtcacccaggctgaagtgctgtggcgttatctcggctcactgcaacctctgcctccagggttcaagggatactcgtgccgagtagctgggatcacaggcacatgccaccatgctctgctgatttttgtatttttagtagaaatggggttttgccatgttggtcaggctagtctcgaactcctgacctcaagtgatctgcttaccttggcctcccaaagtgctgggattaccagtgtgagccactgcgcccggcccagattatggattttgagtaattaaaatgacagacaaggccaggcacagtgactcatggctgtcatcccagcactctgggaagctgaagcgggcagatcacttgaggtcaggagtttgagaccagactggccaacatggcaaaaccccgtctctactaaaaatacaaaaattagcaggagatggtggtgggcacctgtaatcccagctactcaggaggctgaggcaggagaagcacttgattccaactgggatcacaggcacacaccaccacaccaggacagcccgaggctaaccactgtggagaggcagccaggctcctgaggacagcgctaggctaggaggatgtgcctgccccagtgggagccaggagagatgggtggcaacaccaagatggtggagactggagatggcacctccgagaaggaggcgttggggaaaagagagttgagctggccggcgtgctgtgctcacagccggattttggtgcttcttggtttggtgctggagcttctgtggcgatcaccagagtggctgggtgctgccacaccagatgctgacagaaatgaggtcaaatgaccggtggtgggatccatgggttggggtgtgacttcggcggggatcgttggaaagaacgggtaaagttctcgccttggagtccactgtgaagggacttgaacctgggaggtggaggttacagtgagctgagatcgcaccactgcactcctgcctgggcgacagagcgagactccatctcaaaaaaaaaaaaaagataaagataaagaaacaggcaacgtcaccctctctccagcctcggctgaaggcaacaaaggccacagggcctgggatgtattccacagatgtgtaygaagtcactgctgtatgccaagtctcgtttcaggckctggagatcacaagagrtcwgttattccaagggtatcttgagttagtgtctttcctcatcttgaattctagggaartacccagtggacacaaccctggtcacagttgattctgggctgatacacaaatagcattagctccctgccaaaggcggtggggccagcggttcagcgtctgcgcgccttccgggccgcctgctgcctgtgtggggctgaatgttctcctcaaggccatccttaccgttgggcacttcccttgggcttacactgccctgcccgaggcagcctggcaaggggccccacccgtcaggaagtaattcccctccaggaaagtgaaacactgtggcgatacggcttacgggttcctcacctccagttccaggaaaaacccaagacaaacagaccagatgctaggaataagcctcaacccacagcacttagaaagccgcaggctttgtgtgtcttcagggagtggcttcacccttcttggaatctgtcttctgccagcgtcactcatactgctgccactccttctcccgagccaacagcacacctgtcacctcggcacacctgtggagtcaccagaggggccatctggggaaaacgatgcctactgccactcggccttcacatcctggagccctaacagacgtgaggcagctgtgggccgtctcccacctgacgtggttcaaggagagaaaagaactaccttgatgggagatctctggctgacgtgatggcagaggcttgacagagccttcaaggactcagatgtggggaacgtctctacctcagtgccaacgccagtgccctcctcgtccctggatggagactcytcctctgagagaatgtcttaaaaactatccgttttactcaatgacacacgtgtgtcttctcacagtgatcttgtcaccttaaggtgtcaacagccttcacactcactctaacatcatcccagaaaagagacaccaggaacattgcaaaaacaccccagtgtcacagcgtccaccccgagaatgtgcctggctcggcctcaggctcagagccctctgcatgtggcagtccaagaacttggggcaggtcagtgaccatttctccatctttgcctcagctctccatccactcggtggcagtcccagagctgarmagctcgcagcttccgagcaatggctcttaccccgagcccccggccctgctacttccaaggcatataatatcactcggtctcttcaaatctcaatttccctgcctgtgaaatggggccgctgaatctcgatttccccgcctgtgaaatggggccgctattaacaagataagctataaagcaccacatgaacatgagctgtgaacatttgtattattcatagagtcataacgtgcctacgagagaagtaaaaagaagccccacctccctggtgtgttcatcacaagtcagctgaccctcagtcactcgacccagcgcagatgcggaggctctcgctgcttgcagagagtttatattatattaaacggatagtttaattcataaggtctggtaggaagaacgtgaatttattaaccaaaactagtaaaggggaagcagccagatttctacttaaagtagctgctttaattttcagaggggaaagccttgataaggaaggcacgcaagaatcgggctgagtcctgtgtccgcatgtcttgttctggtggctcttctgggtcccagtccgtccggacctctggctgacattattttaacaagagctgtcttgaagtaatttctgggattttgcagctggattttcagatgtggtttgtctctctcaaggttttagcccctgcaacttttaggaagacatataattcgatcctcgcacgcagagaaatggaagggagtatatacagacagtaagaaaagggagggagtgtatacagatgacaagaaaagggagggagtgtgtacagacggtgagaagagggagggagtgtgtacagatcgtgagaaaagggaggggcgtgaagtctatttttaggctgaggaaaacggcctttgcagytgcctcaaggttgtatttggaaacccaagagaaaggggaaaacatgtttaaaatgcattttgaatttaagctgccggctacaaaactgaacaatgtctcccgcagaaacgagaaatcccttggcgtggccatttcttattacagaagccaccctgccacgcacacagacgcgctggaagtatctttcctcagtcacaaccagacgaaggtcattcttgcccagtggcctccctctgaggattctggtttctgacatccgtgtcacaatggcaatgccagtcaccagtctctgaccactagacccacgcccccgggacctacgcagacacccaggaccaatgccagtcaccagtctgtgaccccaggacctaccagacaccttccagggcaggcagggcaggccattttccaaagcaattcgagctaaggagacagcagcagcaaccctccctcctggccctcagagctgaggatcaacccacaggggtgyggtggaggctgagagcaggggtgyggtggaggctgagagcaggggtgcggaacccgagtcagcaggggcagtgaggaggctgccgcagtagtcaaagcgacggggaggatgtggcaaagcaaacaagaggacgcgatggggtgaacacttgggaggaagatcaacgagtactgactaggacacrggggacaaggaagagaaagaaatccagaggacccacagctttctgggctggatgtctgggggactgttgttagcatgaacagaaggaaggaagaaagcttgcaaggaaagattgacctggacctgttgcattgcatgagctaggcaggaaatccctgggagggtgaggccagcatatgggtgggaagtcagggagaagtacagatttgtaaggcgtgagagtagacgcagggtggccagagagggaggggcagcaggagagggaaagggctggagacatgtcatctgggcgtggagcgggggagagaggtggcaaggggagtggagtggagggcccgggagcgtggacggtggagcaggacccgtcagcttcaatgagggtgaggctgggtggtggcacggggccgccggccagggagagcacgtggagsggggggcgcaatacacatctgtcagattcatgaatgaatgaatggatggggccgaactgatgagacgcgtgaggactggagaaaatcgtttttgctgttgggaaggagattctggtagctctgaggaaaacggcttgagcgaagtgagtgaggtgggggcagagcgagcagtgcgtggtaaagaagaggcggcaggggaagcccggctttcatgctgctggagggacgaggaggacacagacggatgacagacttgttttaggccaacagacacctgaacatgctcacaggcaggagagaaggagaaaggcagaaagaacgtcggagacacagaggcagagcagtgagccatccgggcaggagggagccccggggccccggggagggtgcggagaaggctctgggcattgaaggagatgaagggcacggctttggttctttcagtgaagtagaaaatggagkgtcacggggagagaagagagaggagagacctgtttctctccaatatcaactctttaggcgcaaatctcccagctctctgctccccaagtttatgcgtttggccagagtgagaacaagtttcagttgtctgacaatctsacggaayctgaagggcctgacttgcatcctggtgagagccaaggtcagttcattctggccaacacttgagcagcaagaacaaggctatgagtattttttagaataaaacttgatcaaggcttcaaatttctctgcctgacaacttcagcgagatggttttggcttacaaacattgttaagagtggatactatcattttattttaagggaagtgtttctgaacgtggggtccacggaccacctgcatcagaatcactctggacatgtgttaaaatgctgatgcaccctctgccttttgagaaccactttttttttttttttttttttcagagaaggggycttgagctattgcccaggctggtctcaaactcctggcctcaaggaatcctcccgcctctgcctgtccgtgctgggattttaggcatgagctaccatgcccagctgagaaccattttcttaccaaaaatcattctccatagtctctccatccactaggatttctttctttttcttctttgtaaagataggtcatacttgaacacaggatttcttacctacaaataacctactcaagcttagtagattgagttatctgcaaattgttttcctaaacagctraataatcaatctattgcaggagtggcttcagaggtattgtttaaatgatggtgaaagacaaatgcaataactgtagttttgtcgtaacgaatgctaatctcttcctcctcacaagcccaacagattgagagattttgacagcgccttctcccctagacaataaaactatgtcctccacatgcagtgactcacttgccctcctatttgcggcagcaggaaactctaatcaacttggctcaagatgagcaagttctctaaataaagatttaaaaggaggactaccaggacacagccctgtttagcaagaattttttttttttttgagatggagtcccgctctgtcgcccaggctggagtgcagtggcgcgatctcggctcactgcaacctccacctcccaggtttgagagattctcctgcctcagcctcctgagtagctgggattacaggtgcaygccaccatgcctgggtaatttttgtatttttagtagagatggggtttcatcatgttggccaggctggtcttgaactcctgacctcaaatgatccacccgcttcgacctcccaaagtgctgggattacaggtgtgaggcaccgcacctggccgattttcagtcgatgctgtgaagcaaagagcagcaggtgagggatggggcctgtcctggatcatgcccctttgttcacaggctagggatatggggaaacaggcacactcttgcacactgccaacaggtctgtaaattggcataagctttctgcaaagaaatttggcagtctgtattaataacatgaaaaattttataacrgcataaaccagcaattccactgatagaaatttatgttaaggagatgagctgaaataatgtaaacaaaacattagacacgaagatagtcatcagggctttatttaaaataagcaatacattggaaatatcctaattgtccaacagtaagttaacaatatgagctttctctatgatggcttattatttagtgtttaggccgggcgcggtggctcacgcctgtaatcccagcactttgggaggctgaggtgagtggatcacctgaggtcaagagtttgagaccagcctggccaacatggtgaaacccagtctccactaaaaatacaaaaaattagcctggcatggtggcacatgcctgtaatcccagctacttgggaggctgaagcaggagaatcacggaggtggaggttgcagtgggccgaaatcgtgccgttgcactccagcctgggcaacaagaagtgaaactccatctggaaaaaaaaatgtttaaaggctatgtccaatgttctataagggcagggacacacacacacagtgtctcwcacacacacacacacacacacacacacacacacacacacacagtgtcacacatacatactagcaacacacagaacgggcataaagtaagatgtattaaggagaaattgcgagcagggagcagtggagtccacatgacccccgagctctcattgcacagagaggtgggtatggtggacacacagcaggatgtggtacaggagagagacctgctcctgtttaacagaaaatgggaagggtaacaacgcttccagttgggggagtggctttgttaggaaggaggccaccagagctcagcagggggagtttttatacagcaccctagattttactatggagctgagctctcccagtccccctgagccagctcttgtaggactccaaaagggggaagcaaggaactgccatccaagacataaaagatgtgcgtcttctcaggctatgtttacgaagctagtatcttgaagaaatgctcatatcaggtatggctaaaaaggcaggatacaaaattatgtatactgaataagttaaactatacatatatattttttaatttttaattttttttttgagacggagtctcactctgtcacccaggcaggagtgcagtggtgcaatctcggctcactgcaagctccgcctccccgggttcacgccattctcctgcctcagcctcccgagtagctgggactacaggcgcccgccaccacgcccggctaatttttttgtatttttagtagagacgggggttcrccctgttagccaggatggtctcgatctcctgacctcatgatccgcccacctcagcctcacaaagcgctgggattacaggtgtgagccaccackcctggcctaaactatatattttttaaagcataaaaacatcctggaaggaagcattgtctggtagcaagattatgggttttgatctttcaactataaatgttcccaaatgcacgtaaccagtatgtgtgttttctttggcatatttcaatgcagttgtacaattttgtccataaagattaagcacatcttttgttagatttatttttatgtactttttttggtcaccatcataaacactatagtcttaaaaatattttctctttcactgatatataggaatgcagttttattttgtttttaaatctctttttgagacagagtctccctctgtcatgcaggctggagtacagtggggtgatcatagctcactgcagcctcgaactcttgggctcaagtgatcctcccccctcaacttctgagtagctggaactatatgtgtgtgctactatgcccagctaattttttatttttttattttttatttctgtagagacaggatcttgctatgttacccaggctggtcttgaactcctggcctcaagtgttcctcctgcctcagcctctcaaagcactgggattcaggcatgaatcaccacacccagctggaatgcaattatttttaaaattttgattatggatatagaactttgctaataatgtatatgttygggaagtttctatgtaaacaattatgttatctgcaaataaccataggcttgtttcatcccttccatacccaaaatcacatttctgtactctcatactttttgtttaattttctcgtcttatttcaccagctaaaaccttcaacctaatgttgattagaagcagtgattgttggcatcttgtttttattcctgattttacagaaacgtttctattgttttaagtataatgtttacacggggttataattgacattgtttatcaggttaaaagagttaacgtctctttttagtttgctaggagttttaacaggagtaagtgttgacttttatcaaataactttcctgtatctgctgtggtgattgtgtctcccctccattctgtttatatggtgatttacattaagaaagcattgtctttatcttgcatttctgatttaaactcagcttgatcatgatgtacttttaaaatatttatttatttatttatttatttaagatagagtcctgctctgtcaccaggctggagtgcagtggcacaatctcggctcactgcaatctctgcctcctgggttcaagcaattctcgtgcctcagcctcctgagtagctgggattacaggtgtgtgccaccaagcccagcacacacctgtaatccaaaaaaatacaaattttttgtatttttaccagagacggggtttctctaggttggccaggctggtctggaactcccggcctcaagtgatccgcctgcctcggcctgccaaagtgttggggttacaggcgtgagccgccgcgcccggccatgatgcactttggcttgctaatattttatttacgatgcttccatgtattattactgggacttattaatctatagtttgtctttcttatcctatctttggtttccaaccttataaaattattagtagatcatttcctcctgttccaaactctgaatatgtttgtatagaattgaaattacctgttccttgaatgtctgatttgcctgtaaactcatcttagcctgcatttttttgtggggtggatagattatatatacatatttttttttgagacggagtctcaccttgtcacccaggctggagtgcaatggcatgatctccgctcactgcaacctctgcctcccaggttcacgccgttctcctgcctcagcctccagagtagctgggactacaggcgcctgccaccatgcccagctaatttttttttcaccgtgttagccaggatggtctcaatctcctgacctcatgatccgcctgcctcaccctcccaacgtgttaggattacaggcgtgagccaccgcacccggcctagattatattttttaaactgctgattcaatttaaaatagtttatagtggccgggcgaggtggctcatgcctgtaatcccagcactttgggatgccgaggtgggtagatcacctgaggtcaggagtttgagaccagccaggacgacatggtgaaacccagtctctactaaaaatacaaaaattagccgggcgtggtggcatgcgcctgtaatcccagctacttgggaggctgaagcaggagaatcttgaacctgggaggcagaggttgcagtgagctgagatcatgccattgcactccagcctgggcaacaaagcaagactctgtttcaaaaaaataaataaataaaattaaataaataaaataaaatagtttttagccaggtttttttcttaattcatttttgataaattatatttttaaggacagtatatccaatttatctaagttttcatactttttggtataaattcatcagagcactgtctcttaaattttttttctgaagttatgtacccttttttgtttctaataatcttgatatctgtgtcttttctgtctctctctctccctcctcccacacccccccccactttctttctcttgccaggtrtttgttttattttcaaagaactaatctttggcttcatttattccatttttaattgtttctatagtgagttctggtctgttactatatccttcattctgcttcctttttcttttttcttcctggtctttctagtcyaccttttttgctggcggttccagctttttgcagggaaactcagttcagtgtcgtgaccgagggtcttgcttcctttcctttttcagcctttcagtcagcacatttccaagggcattgactcaccatcttagttgttaacttcttcactcctgagtgtttccctttctttcttctcatctcacctctgcattagaaaacatttattacatttataacctgtatttatctggcatyggctggttttgctattagaggcttatctcttcttccatattgctgaaatggagctgtgccacttttataaagaactacaaaaatctttactttaaaaaaaaggacggtgctgtcatgaaacttctgctgctgacactgattttagcagaggtgatgcaggctctgaaaagatgttaattgccaagaatttacacattcagaaagtttggcccctagatagctcctgtctactcaaagcctgatgatagacaaatgctcttaattatgttatcagggaaatgaaataaggttaaaaataactgcatagagaatgtttttaaatttaaaccttatttggagaaaccaagttttgcaaattttctctaggagaaagcaggcatcgagtttagagtcctatcaacaaatctcaacctaattccaactaaaggaagtttccgtttaaagttgaagtggagtcattttggattaagccaggggcccagggacctcccagagggctctgcggttcagcccgtgcctttgtccacgtcggtttacaagtgtgtcaccagtaagcagttactattaatgaagtgcagaagcttgcacgtgagtcacttttttaacaattagagctggttcataaccattatcactcacttgagagtctaagttactgtctgaagaagagaaggtggcgaattacagtcaattccagaaagtggacttgaagctgaattcttccctgagactttgtctctctgagtatcatcttgccaactatctaggagcactgaggttgaaaaaaagrgtgggagcggtggctcacacctttaatcccagtactttgagagtctgaagcaggaggatcgcttgaggccgggagttcgacaccagcctaggcaacatagcaagattccacctctacagaaataaaaaaattacccaggcatggttgtgtgtgcctgtagtcccagctactcagaaggccaattacaccgctgaacttcagcctgggtgacagaagaccctgtctctctttctctctctctctttctttctctctctctctctttcttctctctctctctctctctatatatatatgtttaaaaagaaaaaagaaagaagtttgagaacagctagggaactaatgaaaacccaaaagagtcagtttctaagagaaaaaaaaaggcaagttttcttggtttcttcttggttcagagactcagaggctaaggtaatattcacgaagatggtatgtggctagtgcaggtgctgtgaaatattttaaacaaaaaaagccaatatttaaacattctgcctgggaaatatttttctttattwaatatctatttttattattattattattatttttattttttaagacacagggtctcgctatcttgcccaggctggtctcaaactcctggcctcgagtgatcctcccaccttggcctcccaaaatgctgggattacagacatgagccaccatgcctggcctctgcctgggaaataattttttttwaaaaagtggttatggtcaataatattagcttcttggtagtctgtgaccagggcaagagtatatgcatttaccccttgggttttttaccagattggcacagatgttaacaacgaaaaagaaaagtagaaatttaatttatttttaagaaagataatgctataattcaagttgagagagttaacccggcttatagcaggggtactgtttgcytcttcccatggagtttaacacagttaattcaccattctagtctaacctcaccttcctcctcacaaggaagacaggcgggagctggagaagaccattggctatattcctgcaactgtgctttttctaggcgatttgaagcagtgcttatcaggggccttcctctgtgggaatcctgcacccccatctctctctccttttttattttatttatttattttttttttgagacagaatcttgctctgtcgcccaggctgcagtgaagtggcatgatgtctgctcactgcaacctccacctcctgggttcaagcaattctcctgcctcagccttttgagtaactgggattacaggcacccaccaccacgcccagctatttctgtatttttttttctagtagagacggggttttgccatattgcccaggctggtctcgcactcctgacctcaagtgatccacccatctcagcctcccaaagtgctgggattgcaggtggggctaccatgcccggccccatctcttattatttttttatcccccaaatatgtacagttgtgatatattaatttttcattttttctttttatttcttttcattttttactttaagtttcaggatacatgtgcagaacgtgcaggtttgttacacaggtatatatgtgccatggtggtttactgcacctatcaacccatcacctgcatgtattagctatttatcctgacgctcttcctccccttgtcccrtccctgacaggcgccagtgtgtgttgttcccctctctgtgtccatgtgttctcattgttcaactccaacttatgagtgaaaacatgcagtgtttggttttctgttcccctgttagtttgttgaggatgatggctttcagcttcatccatgtacctgcaaaggacgtgatcccattcctttttcatggctgcatagtattccgtgctgcatatgtaccacattttctttatccagtctatcactgatggacatttgggttggtttcatgtctttactattgtaaatagtgctgcagtaaacatacgtgtgcatgtatctttataacagaatgatttmtattcctttgggcatatacccagtaatgggattgctgggtcaaatggtatttctggttctagatccttgaggaatcgccacactgtcttccacaatggttgaactgatttacactcccaccaacagtgtaaaagcgttcctatttcaccacagccttgccagcatctgctgtttcttgactttttaataattgccattctgagtggtgtgagatgatatccctttgtagttttgatttgcatttctctaatgatccatgatgatgagccttttttcatatgtttgttggtggcataaatgccttcttttgataagtgtctgttcatatcctttgcctgctttttgatggggttgtttatttttttcttgtaaatttaagttccttgtaaattctggatattagacctctgtcagatggttagattgcaaaaattttctcattttgtaggttgcctgtttgctctgatgatagtttcttttgctgtgcagagctctttagtttaattagatcccatttgtcaattttagcttttgttgcaagtgcttttggagatttcatcataaaatctttgcctatgtctatgtcctgaatggtattgcctaggttttcttctagggttttcatggtttggggttttacatgtaagtctttaacctgccttgagttaatttttgtataaggtgtaaggaaggggtccagtttcagttttctgcatatggctaaccagttttcccagcaccatttattgaatagagaatcctttcmccattgcctgcttttgtcaggtttgtcaaagatcagatggttgtagatgtgtggtcttatttccaaggtatctattctgttccattggtttataygtcagttttggtaccagtaccatgctgttttggttactgtagccttgtagtatagtttgaagtcaggtagcctcccactttgttctttttgcttaggattgtcttggctatttgggttcttttttgattccatatgaattttaaagtagtttgttctcattctgtgaagaatggtagttttcacatcctttgttagctgtattcctaggtattttattctatttgtagcaattgtgaataggagttcattcatgatttagctctctgcttgcctattttggttcactccaggaaccacagaggacacattaataactggaagtaaaactsctgccccagtcacctcaacaggctcaacaacagcgacactagagggacaatcaactgcagcttcttcaaggacctctaatcaggacatatcagcttcatctcagaaccaccagactaagagcacggagaccaccagcaaagctcaaaccgacaccctcacgcagatgatgacatcaactcttttttcttccccaagtgtacacaatgtgatggagactgttacgcaggagacagctcctccagatgaaatgaccacatcatttccctccagtgtcaccaacacactcatgatgacatcaaagactataacaatgacaacctccacagactccactcttggaaacacagaagagacatcaacagcaggaactgaaagttctaccccagtgacctcagcagtctcaataacagctggacaggaaggacaatcacgaamaacttcctggaggacctctatccaagacacatcagcttcttctcagaaccactggactcggagcacgcagaccaccagggaatctcaaaccagcaccctaacacacagaaccacttcaactccttctttctctccaagtgtacacaatgtgacagggactgtttctcagaagacatctccttcaggtgaaacagctacctcatccctctgtagtgtcacaaacacatccatgatgacatcagagaagataacagtgacaacctccacaggctccactcttggaaacccaggggagacatcatcagtacctgttactggaagtcttatgccagtcacctcagcagccttagtaacakttgatccagaaggacaatcaccagcaactttctcaaggacttctmctcaggacacaacagctttttctaagaaccaccagactcagagcgtggagaccaccagagtatctcaaatcaacaccctcaacaccctcacaccggttacaacatcaactgttttatcctcaccaagtggattcaacccaagtggaacagtttctcaggagacattcccttctggtgaaacaaccayctcatccccttccagtgtcagcaatacattcctggtaacatcaaaggtgttcagaatgccaayctccagagactctactcttggaaacacagaggagacatcactatctgtaagtggaaccatttctgcaatcacttccaaagtttcaaccatatggtggtcagacactctgtcaacagcactctcccccagttctytacctccaaaaatatccacagctttccacacccagcagagtgaaggtgcagagaccacaggacrgcctcatgagaggagctcattctctccaggtgtgtctcaagaaatatttactctacatgaaacaacaacatggccttcctcattctccagcaaaggccacacaacttggtcacaaacagaactgccctcaacatcaacaggtgctgccactaggcttgtcacaggaaatccatctacagggrcagctggcactattccaagggtcccctctaaggtctcagcaataggggaaccaggagagcccaccacatactcctcccacagcacaactctcccaaaaacaacaggggcaggcgcccagacacaatggacacaagaaacggggaccactggagaggctcttctcagcagcccaagctacagtgtgactcagatgataaaaacggccacatccccatcttcttcacctatgctggatagacacacatcmcaacaaattacaacggcaccatcaacaaatcattcaacaatacattccacaagcacctctcctcaggaatcaccagctgtttcccaaaggggtcacactcaagccccgcagaccacacaagaatcacaaaccacgaggtccgtctmccccatgactgacaccaagacagtcaccaccccaggttcttccttcacagccagtgggcactcgccctcagaaattgttcctcaggacgcacccaccataagtgcagcaacaacctttgccccagctcccaccggggatggtcacacaacccaggccccgaccacagcactgcaggcarcacccagcagccatgatgccaccctggggccctcaggaggcacgtcactttccaaaacaggtgcccttactctggccaactctgtagtgtcaacaccagggggcccagaaggacaatggacatcagcctctgccagcacctcacctgacacagcagcagccatgacccatacccaccaggctgagagcacagaggcctctggacaaacacagaccagcgaaccggcctcctcagggtcacgaaccacctcagcgggcacagctaccccttcctcatccggggcgagtggcacaacaccttcaggaagcgaaggaatatccacctcaggagagacgacaaggttttcatcaaacccctccagggacagtcacacaacccagtcaacaaccgaattgctgtccgcctcagccagtcatggtgccatcccagtaagcacaggaatggcgtcttcgatcgtccccggcacctttcatcccaccctctctgaggcctccactgcagggagaccgacaggacagtcaagcccaacttctcccagtgcctctcctcaggagacagccgccatttcccggatggcccagactcagaggacaagaaccagcagagggtctgacactatcagcctggcgtcccaggcaaccgacaccttctcaacagtcccacccacacctccatcgatcacatccastgggcttacatctccacaaacccagacccacactctgtcaccttcagggtctggtaaaaccttcaccacggccctcatcagcaacgccacccctcttcctgtcacctacgcttcctcggcatccacaggtcacaccaccctcttcatgtcaccgatgcttcctcagtatccacaggtcacgccaccctcttcctgtcaccgcccttcctcagtatccacaggtcacaccacccctcttcctgtcaccgacacttcctcagaatccacaggtcatgtcacccatcttcctgtcaccagcctttcctcagcatccacaggtgacagcacccctcttcctgtcactgacacttcctcagcatccacaggtcacgtcacccctcttcctgtcaccagcctttcctcagcatccacaggtgacaccacccctcttcctgtcactgacacttcctcagcatccacaggtcacgccacctctcttcctgtcaccgacacttcctcagtatccacaggtcacaccacccctcttcctgtcaccgacacttcctcagcatccacaggtcacgccacctctcttcctgtcaccgacacttcctcagtatccacagctcacgccaccccacttcctgtcaccggcctttcttcagcttccacagatgacaccacccgtcttcctgtcaccgacgtttcctcggcatccacaggtcaggccatccctcttcctgtcaccagcccttcctcagcatccacaggtgacaccacccctcttcctgtcaccgacgcttcctcagcatccacaggtgacaccacctctcttcctgtcaccatcccttcctcagcatcttcaggtcacaccacctctcttcctgtcaccgacgcttcctcagtgtccacaggtcacgccacctctcttcttgtcaccgacgcttcctcagtatccacaggtgacaccacccctcttcctgtcaccgacactwmctcagcatccacaggtgacaccacccctcttcatgtcaccracgcttcctcagtatccacaggtcacgccacctctcttcctgtcaccagcctttcctcagcatccacaggtgacaccacscctcttcctgtcactagcccttcctcagcatccacaggtcacaccacccctcttcctgtcaccgacgcttcctcagtatccacaggtcacgccacccctcttcctgtcaccgacacttcctcagcatccacaggtcaggccacccctcttcctctcaccagcccttcctcagcatccacaggtcacgccatccctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctcagtatccaccggtcacgccacgcctcttcctgtcaccagcctttcctcagtatccacaggtgacaccacccctcttcctgtcaccgacgcttcctcggcatccacaggtcaggccacccctcttcctgtcaccagcctttcctcagtatcaacaggtgacaccacccctcttcctgtcaccgacacttcctcagcatccacaggtcacgccacctctcttcctgtcaccgacacttcctcagcatccacaggtcacgccacccctcttcctgacaccgacacttcctcagcatccacaggtcacgccacccctcttcctgtcaccgacacttcctcagcatccacaggtcacgccacccttcttcctgtcaccgacacttcctcagcatccataggtcacgccacccctcttcctgtcaccgacacttcctcaatatccacaggtcacgccacccctcttcatgtcaccagcccttcctcagcatccaccggtcacgccaccccgcttcctgtcaccgacacttcctcagcatccacaggtcacgccaaccctcttcatgtcaccagcccttcctcagcatccaccggtcacgccacccctcttcctgtcaccgacacttcctcagcatccacaggtcacgccacccctcttcctgtcaccagcctttcctcagtatccacaggtgacaccacgcctcttcctgtcactagcccttcctcagcatccacaggtcacaccacccctcttcctgtcaccgacacttcctcagcatccacaggtcaggccaccgctcttcctgtcaccagcacttcctcagcatccacaggtgacaccacccctcttcctgtcaccgacacttcctcagcatccacaggtcacgccacccmtcttcctgtcaccrgcctttcctcagcttccacaggtgacaccacccgtcttcctgtcaccaacgtttcctcggcatccacaggtcatgccacccctcttcctgtcaccagcacttcctcagcktccacaggtgacaccacccctcttcctggcaccgacacttcctcagtatccacaggtcacaccacccctcttcttgtcaccgacgcttcgtcagtatccacaggtgacaccatgcctcttcctgtcactagcccttcctcagcatccacaggtcacgccacccctcttcctgtcaccagcacttcatcagcatccaccggtcacgccacccctgttcctgtcaccagcacttcctcagcatctacaggtcacaccacccctcttcctgtcaccgacacttcctcagcatccacaggtgacaccacccctcttcctgtcaccagcccttcctcagcatctacaggtcacaccacccctcttcatgtcaccatcccttcctcagcatccacaggtgacaccagcactcttcctgtcaccggcgcttcctcagcatccaccggtcacgccacccctcttcctgtcaccgacacttcctcagtatccacaggtcacgccacccctcttcctgtcaccagcttttcctcagtatccacaggtgacaccacgcctcttcctgtcaccgacacttcctcagtatccacaggtcacgccacccctcttcctgtcaccagcttttcctcagtatccacaggtgacaccacccctcttcctgtcaccgacgcttcctcggcatccaccggtcacgccacccctcttcctgtcaccgacacttcctca

SEQ ID NO: 12263 - DNA, 18878 bp, Homo sapiens
  misc_feature (1)...(18878): n = A,T,C or G, or insertion/deletion polymorphism (see Tables 1-2)
cacaaattccctgctttcaccaattaaccactgaattgctattttttcctttggtttttacttttggccacatagctaggtttctggttcccccacagtaggtgttttcacataagattagggtcctcttggaaagaatagttgccatgtttacagggtagttgtggtaagaatctagtttattttacatgtgactaattggtctgtgctgcatggttatatactcctggattatagattagaagtctccgaagtcacctctgtgaaaagcaagctatcattaaacatgtctgtttatcaatcaatcaataaataaaatattgtttatttggggatacatgctgaaaatcattttattgatggggtacaaaataaaaaaaaaaagcagagactactgaattagaaatatacattttttcaggcacagatggaacatttacaaccacatactaggccatagagcaaatctcaaacaaatgccagaggattcatatgtattcattttctacagctgctacaacaaattaccacaaacttagtggttgaaaacaacccaaatgtattatgttacagctctacaggtcagaagtctaaaacaggcctcaccaggctacaatcagtgatggcaggtacagctgcccctggaggctgaagggtcaaatccatctccttgccccttccagcttctagaagccgcccacatactgaggctcatggccttcttcttccaacttcaaagtcagcaacatcttgatccttctcatgcagctgcctctctggcgctgtctcctctgcctctttgccacttacaaggatgcttgtgattacactgggtctacctggataatgcagaataatcacccattgcaaggccaaccttgattccatctgcagccttaactcccctttgccatattaacatgcagttcaggggcgcagatgtcctcgggggaccaacgtgctgcctgccatgctacacagacagagtgctcgggccacaataaatttaaaattaaaataataaacaacaaaaagttaagccccacagatctggaaaatttgtaatgcatttataaatgaaatataggtaaaaataaataataacgggaaaagcaaatcaacaataatgaaaaaaacaatatagcaaagctgatgagatgtagctaaagtagatcttcaagggaagtttatagccttaaatgcatatattagaaaataagaaatttctaaattaattaagcatccaatacattagaaaaagaatggcaaagtatgccgggtgcagtggctcacatctgtaatcccagcactttgagaggccaaggtaggtggatcacttgagctcaagagttcgagacaagcctgaccaacatggtgaaaccacgtctctactaacaatacaaaaattagccaggtgtggtggcgcacacctgtaatcccagctactaaggaggctgaggcaggagaatcacttgacctcaggaggaggaggttgcagtgagccaagatcatgccactgcactccagcctgggcaacagagcaagacagcctaaaaaaaataataataataacagtgaaacagctacacacaagcaaatcaagttctaccaggctttcaaggaacagattatccctattgtatataatctgtatataaaaaaataaaaaatagcacttaaaaaacaagtggtcaaagcaaggaaaatagaatcgtgtcacagaaaccaagggaagtaataattctcatgtaggtggagagctgccagatcccacatatctctgttaaactttgcttcctggatgaggcactccctaccccttaaatccccctattaggggtatagacacctatattgcaccccaactctctccttcatagcaataatgaccattactaactaattttaattttgttttgttttttgggttttgtgagatgaggtcttgctctatctcccaggcttgagtgcactggcatgatcatggctcactgcaacctcgaccccctgggctcaagtgatcctcccacctcagccttccgagtggctgggaccacaggcacgtgccaccacacccagttaatttatttttattatgtgtagagacggggtgtcactctgttgcccaggctggtcttaaactcctaggctcaagcaatccttccgcctcggcctcccaacgtgactgggattccaggtgtgagccgcctcacctggccaattttacatttgtctttgagattatatgatcgatgtctgactctcacactggtgtgtcaactccgtcagggcagaaaccacatatttgtctgtttgtttttcatctttgtgccccattacttggctgvttcctaacacaaaatgaatgtgcaaaaaacgcttgtcaaatgaatgaggaggtctaaggggccttgagccctctgacgtttccattttataattgtggacagagccgctacagcacaaagctgagctggaccatccaatgtttagccagtgccttacgtgctaggagacactgggagctgtgctgggcttctgaggagtgggcagaggctggaaatacccatagttggtcagtctcctgtgtcacccagactggggaggtgcagaaatgaaaattacagagctgcgaggacccagaacctcattaatgagcttaactcactgtcctgaccaggtggcctctcaaagccttgctgggaaggaggctttaaggtggtgggggcagcagtgctggtggtggtcatcgaagaaagtgggagtcggggaggaagcaatggggagcaggggacaaagagggccagacaaactcagagcttcaggtgatgagactcaggaagcctaagtcaggaacagtgattgcggacatctttgtcccataacagaacttcctcctaaggaaaggtcttgcagagactggtcctgctgagcgctttaacaggttattgattcataaaaattggagaaaaaagacaaagtctgccacacctaacagccttctgtttagagctggtttagaggaaactttaagcaagtcttgtgtccaacaatttgggcctgaggcagggtacaggtaagggaacagacaggagacacggaggcaagaacaagactttagctgaaagagaaatcagagccagaggcagccacaagaacacccaacctactggaactcatgcaggtggacagcctgcccaggacttgccctgagtgggaagcaaagagcatcttatctagattttaaggagcagggtgcccctggctgacatctaggctacagtcactgggccaggtggagggttggtcaggccctctcaaaagtcatgagaggccaggcacagtggctcacgcttgtaawcccaacactttgggaggccgaggagggcagatcacttgaggccaggagtttgagaccagcctggccaacatagtgaaaccccgtctctactaaaaatacaaaaaattagccgggtatggtggccggtgcctataatcccagctacttgggaggctgatgtataagaatcgcttgaacctgggaggcaaaggttgcagtgagctgagatcatgccactgcactccagcctgggcaacagtgagagaccctttctcaaaaaaaaaaaaaaaaaaagaaccaaaaaaagtcatgagagtcctcagagttctcaagaagggctgctgtgggcctgtttctggaaaggaaagaaaagcagggagctgttgagaaaataccatatgtttttatgccccagccaggcatgggggagaggctgaccccaaaagagaaagtggttgtgtgagatttcaaggaagatgtcagcgggctgcatcccagggcctctagacaaaaggaagggcccagccaggcatggtggctcgtgcctgtaatcctagcactttgggaggccgaggcaggcagatcacctgaggctaggtgttctggtccagcctggccaacatgacaaaaccccatctctactaaaaatacaaaaaataagctgggcgcggtggctctcccctgtaatcccagccaaggtgggcggatcaacttgaggccagcctgaccaacgtggcaaaactccatctctactaaaaatacaaaaattagctgagcgtggtggcacgcacctgtcatcccagttactcrggaggctgaggcgtgagaatggcttgagcctgggagacagaggttgcagtgagctgagattgcatcattgcactctagcctgggtgacagagtgaaatggagggaggaaaaaaaaaaaaaaggaaggtcccgtccagggagccagcctaggatggggaaggctcaccagaagtggatgcaaagagtgctggagatgagctcattctatttgcctaggaaagaaaaacgtccagaaacctggccttcctcctcttggccgaggccctccaggaaagccaggcagaccctgctcctgctctgaccccctggagaagtgatatgtagaaaagaggagatgggctttggcccagaggacagcagcgttaggctagtgagcagttcccagtcggttcaaggttgctaggctcagcgaactgcaagtccctgttcgacaagtttcttcctaaaggtccccagttcctcatgattcttctgagggtctcatccaccctcccagggcctgcagtcagctagccaccccactgccccatgcctgcagtgaagacatttaccacaacctggaaatggctggtgacagaaaagtcctcagggccacagcactctctgcggtgggaattcaggtgccttgcctgatggtgacaaggctggttttgcataaacagctctctgaatcacacccaratgtggcttctgacttgagtggacccccatgaagagctgcagagggggctgggaaaagacaagagaatggagaaaatgaggagaaaggaaactacagagtgagatagagaacakatctgacaggtgtgaccacagcagtgtgacatttatgaacagtgtggaaacaacggcaaagcccctgaattaaaaacttcctggggaaataagccactccacatatcggttgctgaggaaagagtggaggaggctgttgacccgtgtgtgtccccatgactcaaagagggaaaagtctagctgtttccaatatcccgaaatcagtcttgctgggagaactgggaaaataaaaaagagatgacccccgtaggaagctacctttaatcccaagtgcccaaggctaggagagaagatgctccaggcgatccaggacaccagtgactgacacagccagaggtgggaaaggggaggataaagatggcacaaaagtgaggagtgagcaagggtctgagagggaaggccatgtgggcagtaggtggcacccacatcagagactgacatgaggattaaaggagagcataggtgatcggtcagagtgtgacagaagagaggcagctctacaccccttgcttgcaattctgagcattctgtagcaaactcgtttggccatcaaaccagacctcaattgagacaaggctatttaagcttcctcccagttggtgtaaatattcaatagttttgctgcagaaatgttgcgtttgattatgagactaccccaactccccaagggtgttttgtggtgctggtttctgtataaacctgaaaaattctgaattccaaaacttatctgacccccaaagtttcagataagagcttgtggacctgtgctcaattctggttctccttccttctttcaactgttgtctgtgaaaggagggatgcaggtatgggagacaggagtcctgcgaattcgtctgtaaactgtggacgggggggtgggtgggggggggtaacgtgggcacctttgtgcacaagtgcatgaataggaggggtgagcaactgtgtgtccatcacctttttgtcaaagaagcaggagtcagtgggctacgtgcttcatgagcaggagaggcggaaactaaggaaggctcatgtgttggaggaagcatgtttgaagagcagcaggtctcacagagtttgctctttaatactctccccagcacacggaaggggaagggggtggaggttgctgctatgagagagaaaaaaaaaacagccacaatagagattctgccttcaaaggttggcttgccacctgaagcagccactgcccagggggtgcaaagaagagacagcagygcccagcttggaggtgctaactccagaggccagcatcagcaactgggcacagaaaggagccgcctgggcagggaccatggcacggccacatccctggtggctgtgygttctggggaccctggtggggctctcagctactccagcccccaagagctgcccagagaggcactactgggctcagggaaagctgtgctgccagatgtgtgagccaggtaagagggggccttgntaagggccaggtgastggcgaaagagagaggactggggttaatacagtaaataggcgcagggtgagactgagctcaagcaaggagggaaatcctgcagctgtggggaggcaccaccttgaagagggcagagaaccagcccttctcaggccttgatcccttaccctctcctcccaggaacattcctcgtgaaggactgtgaccagcatagaaagrctgctcagtgtgatccttgcataccgggggtctccttctctcctgaccaccacacccggccccactgtgagagctgtcggcactgtaactctggtgaggtgggcaagggtgtgtaggtggggacgatggacaagcatctgggggagcaaggctggtgacgggtttgggggtgcaaggaggatgacggggccaaagctttggccttcttcaaggctcacagcaagtggagccaatgctgggaaatgcggcaccctaggtggggcatgaattaacgtgggcagacatctagtattccaggaaagggataaatagaatttgagggattggtgagaacgggtctatggataggatcaagacaataaaatgagagaagtggctctatgaccccagatttcgggcaagcaacccccaaccaataaactgactgtgttcccagagtgcacatgtgcaggttggccattgggaatttggaatacatctttctaaggaaataacaaagcaacccaataggtaacaacctttttttgcacaaaagccaatttgagaaaatgagtatgtatgtagcctgtgtttttattttatagttccaaaaaaaaaggttttttttaaactaagaagtataatatctgcagttgtgcttatgaatgctgttattatttctccatcttcgctacaatttcagaaactacggccagtatacactagaatagcaggctttaaagtggcccctttgaacaaatgttctctagcaagacactttttagaaccaggtaactgtaactattaaactacctacttgcaaaacgtgtttggtgtcactgggtctcttggtactgggttttgttttgtttagtttagagacaaggtctagctctgtcacccaggctggagtgcagtggtgcaatcatagctccccacagccttgaactcctgggctcaagcaatcttctagtctcagcctctgaaagtgccaggattacaggtgtgagctgtagtgcctggtcccgtaaaaacaaaaacaaaaaccaacaccagatgtggtggctcatgcctataatcccagcacttgggaggccaaggcagaagggtatttgcatattttgtagagacttgagcccaggagcttgagaccagctgggcaacatagtgagaccttgtctctaaaaaaattggctggtcatggtagtgcacctgcagtcccagctacttgggaggctgagatgggaagatcacttgagcccaagaggtccccaagaggtccaggctgctcacatcactgcactccagcctgggtaacagagcaaaaccctttttcacacacacacacacacacacacaaaaagccagagcagtggctcacacttgtaatcccagcactttaggaggccaaggcaggcggatcccttgagcccaggagtttaagaacaccctgggcaacatggcaaaaccctgtctctactaaaaatacaaaaagttagccaggcgtggtggcacgaacctgtagtcccagctactcagaaggctgaagtgagaagatcacttgagtccaggaagtggaggctgcagtgagccgtgactgtaccactgcactccagcttgggagacagagtgagcagagtgagaccctgtttccaaaaaaaaaaagaaaacaaaagcttttccattgcaaatcaaccaaaaaggaacgtctttaatacacaagaaatattcttcagtctacttaacttaaaaatgtaactgtaatagatgcttttctcttgacagcggccccggcagggttggaacttttcctagtcaaaacccccctactcactctgcagacccttcctgaaggtcttcgccccatactgagcccatcttcagtcccttcacttgttccaaactagcccaatccatgacccttctctgggagctcagccaatagatcccaaagtaccacagcagcacctggctgcagaaggacccccgggaaatgcagtcaggggtgagaagatgggtgggctgaatgagctcggccctctctgggccttagtgctggcatctatgagatgaggacatgcctgaagtcagcctggaattttgagcccaggttatacctggtaaatagaactcccaggtctccggatactcaccactaaaacaatagcacctcattgtttttgttttgttttgttttgttttttaattatactttaagttctagggtacatgtacacaatgtgcaggtttgttacataggtatacatgtgccatgttggtgtgctgcacccattaactcatcatttacattaggtatatctcctaatgctatccctcctccctccccacaccccacgacaggccccagtgtgtgatgttccccttcctgtgtccaagtgttctcattgttcaattcccacctacgagtgagaacacattgtttttaaccctccccagcagcttctttaacccctccatttcccttttggcggagacccttgtcatcactcctctctaccaccagtgctctcccctcctgcactgtcccaggcttcctcattcttcccttgcaggtccttatccawcatggctcacaattcctgggaagccacaaggaaaccaaattctagtagcaactcagagtcagcattcattagcaggtcacagggccataaggatgccaagaaggaatttgtccctctccttgtcctgacaaaaggcataagtagaagaaaattgttaggtttggttatgacctttgacattctctctttgacatcctccctttctgcacccctcttccacctgtcagggcacctagggctccccgggtccccacaagtgtctgccctaaggcccaccaggctttcttgcagcctgtcccacatctgggtgtcactgccttcctctgaatcaccctcctctcaaaccagccgccagcgagcccagcccagcccagctagtgccctaccacacccgcccccaggataattaacacccagccacccagcatcggacctctacacttgagcaaaatgtatattttaaaggcaaattctcacgcctrtaatcccagcactttgggaggccaaggcgggyggatcacgaggtcaggagattgagaccatcctggcyaacacrgtgaaaccccrtctctactaaaaatacaaaaaattagccaggtgtggtggcacacacctgtaatcccagctactagggaggctgaggcaggagaatcacttgaactcaggaggcggaggttgcactgagccgagatcgtgccactgcactccaacctgggcgacaaagcaagactctgtcaaaaaacaaacaaacaaaataaaggctaagtaactgtaatcaagtaactatttattatttatttattttagtgtatccacaggttgtgcagccatcaacactatctaattctataacattttcgttaccccagagaaacttgtaccccttagcaatgactccccatttcttccccccaaccaaccccagccccagccccagcccctgggaatccctaatatactttgttttgttttttgttggtggtgtttgagacaggatctcactctgtcacccaggctggagcgcagtatcatgatctcagctcactgtaacctccacctcccgggctcaagcgatcctcccacctcagcctccccagtagcttgggcctacaggtgtgcaccaccacacccagctaatttttgtattttttgtagagacggggtttcaccatgttggccaggctggtctcaaactcctgagctcaagcaatccacccacctcaacctcccaaagtgctgggattacaggcgtaagccactgcacctggctattttctttctttcttttcttttttttttttttttgagacggagtttcactctgttgcccaggctggagtgcagtggcgtgatctcggctcactgcaacttccacctcccgggttcaagcaattccctgcctcacccggctattttatatttgttgatctgctgctggttatgcctgtgagccaaatttgtacaaattcttaagctttacaatcatgcgtgcctctctgtacgtatattatactttaattaaaagttattaaagtattggggccgagcacagtggctcacgcctgtaatcccaacactttgggaggctgaggctggtgcatcacctgaggtcaggagtttaataccagcctggccaatacagtaaaaccccgtctctactaaaaatacaaaaaattagccgggtgtggtggcgcacacctgtaatcccagctacttgggaggctgaggcaggagaattgcttgaacccgggaggcagaggttgcaacgagccaaggtcacgccattgcactccagcctcggcaacaagagcgagactccatctcaaaaaaataaataaaaaataaaaaatgtatcagggagtacaagagaaagtcatataagctctttctacttttcatggtttctatgtctgaacccatgaatcttccttctgaaaggtccaactttcttctttaataacaataataatggcaaaggcattgggggaccgtgagcaaagggcaggcctttgcaggggtgggaatggaaagggaagcacgtccctagaggtgggcmtgggatgggggttgggggatgaagcaagtggaccttgaaggtctccacaggtctgagtgtcctatgctccctgggcctctcytcccccaggtcttctcgttcgcaactgcaccatcactgccaatgctgagtgtgcctgtcgcaatggctggcagtgcagggacaaggagtgcaccgagtgtgatcctcttccaaacccttcgctgaccgctcggtcgtctcaggccctgagcccacaccctcagcccacccacttaccttatgtcagtggtaagttccaggcaactctctgtgccatcacgtggggtagcggtgataccccaaccagtactccccactcctacccctagataaggtcagcctgtttctgccttcccatcccatccagcacctctcaggccttcagakgtgccctatggggtcccctgctgctactcattctgtctctgtttttccagagatgctggaggccaggacagctgggcacatgcagactctggctgacttcaggcagctgcctgcccggactctctctacccactggccacgtgagttttctccttaatccccaccgctagagagaatgcatacacgaggggccaggagggaagccagacagaaagctcctaggattagggataagaggaggggaaaaagcagagtccactgtttaggagaggagttggccaacggtggcgggtgggatagaataaggtgggggaaaggggagaggcaaggtgacaggagggctgggctgagggagccaagggctagaccctcccctaacccctgtgtgtcccctcctattacagcccaaagatccctgtgcagctccgattttattcgcatccttgtgatcttctctggaatgttccttgttttcaccctggccggggccctgttcctccatcaacgaaggaaatatagatcaagtaagagacagaacacaggcctccggtcctgcccctgcaccacaccccactggctcaaccccactgcccacgcctggaatctcactgaaacccaccagctccacttcaccagccttggtcctaccccttctctccccttagctggcgtgctcctgacacccctcccccaagcgcacccgcctctacccatctccttctcccgtctccccctgcccccactgctggccaagactcatcggatctccttctgcagacaaaggagaaagtcctgtggagcctgcagagccttgtcgttacagctgccccagggaggaggagggcagcaccatccccatccaggaggattaccgaaaaccggagcctgcctgctccccctgagccagcacctgcggkagctgcactacagccctggcctccacccccaccccgccgaccatccaagggagagtgagacctggcagccacaactgcagtcccatcctcttgtcagggccctttcctgtgtacacgtgacagagtgccttttcgagactggcagggacgaggacaaatatggatgaggtggagagtgggaagcaggagcccagccagctgcgcctgcgctgcaggagggcgggggctctggttgtaaaacacacttcctgctgcgaaagacccacatgctacaagacgggcaaaataaagtgacagatgaccaccctgcagctctccagcttcctctctgaaatcccagtcccaaaatccagtttcctggccgcctcctggctcaggtcaggatctggcagaggaggtttctcagccggttatgttggggcctgcttaagggcgggggtgagaaaggtccccaggctactgtggatcctgtgtctgacttcagatccccttttcccacagttatagctccacttttttgggacaggtggggagcaaaagggtgcagaggtcaggtcttgaaatcaccaggrgatttccgggtgaggtgggtggtgagaaaggaaacagcaagcagggctctggcagctgctgcagacggcttcacacagggacgcgggctgccatcttgctctaagtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccagtgagtctgggagtcggggagagctggctgggagaagagctactgaagccccagggtgccaccctccccgagattccagaagagcaaaggggccggggatgaccccatcgccttctaagcccaacgggaaaggctcagcggctggcaaaggaaggaaccaatagtgtgtgtggagggagggtggggactccacagggaaaatgctaaagaggggctgcctctgtggctgtggtcaggagccactgtcctacagagagggcactggcctgggagctgacacttcagaagaggaaaggactccccaggtgaggaaatcacttggaaggtgaccttgaaggcgggggaggggaaggctacccgaaatgggagaaagcagtgcaggctgtcagtgccccagcaacagtaactgtccagtctcctctctctgcggtggcacttgcttgttttctgagaattcctttgactgaaaagatagtcttttattcaacagttggaaatgcaagcataaactcctctgagcaaggcaaatccaggactttaactctcaccaagaagtatttgcctggactagcaggtgctctccagaaagctggtttggggatgacgggagaatagagggacacagaaacagctaggatcttggatggcaacttttaccctttgatgactccacagcttgagggcgggggcaggaagcaagtgtggagtagctttctggggaaggcggtgctcaccccagcctttgtctgcagagccccacccagcagaggggcagtggcgggcagtggacgtggtcctagactgyttcctggygaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcaggtaaaagccttccacctgtgtccttggtcctcccgggctccctccaccaggacagcccaggtcccgattacagccacacatactgcctcccgttggccctggtgttctcacgctaatttgccctctgtgtgtgccctgcttctccccagtggacctggtccagattccccaggccgaggccttgctccatgctgactgcagtgggaaggaggtgacctgtgagatctcccgctactttctccagatgacagagaccactgttaagacagcagcttggttcatggccaacrtgcaggtctctggagggggacctagcatctccttggtgatgaagactcccagggtcaccaagaatgaggcgctctggcacccgacgctgaacttgccactgagcccccaggggactgtgcgaactgcaggtaagaaaatgaaaagcaaggccaggtgtggtggctcacgcctgtaattccagaattttgggataccgaggtcggtggatcacctgaggtcaggagtttgagatcagcctggtcaacacggtgaaaccccgtctctactaataccaaaattagccgggcatggtggcgggtgcctgtaatcccagctacgagggaggctgaggcaggagaatcgcttgaacccggaaggcagaggttgcggtgagccgagatcacaccatggcacttcagcctgggcaacaagagcgaaactccatctcaaaaaaaaaaaagaaaagaaaagaaaagcaagtcacagaaagttttgcttttctaaagtggtaagatatggggcacagaagaagaaagggaacaaatccacctccatccacactggtcacctcagggcacccctaggccttggtcctttcttcctaaaaacccctgagtcaggccaggtgcgaaggcccatgcctgtaatcccagcactttgggaggccaaggcaggtggatcacctgaggtcaggagttcaagaccagcctggccaacatggtgaaaccccctctctactaaaatacagaaattagccgggcatgatggcaggtgcctgtaatcccagctactcaggagactgagacgggagaatcacttgaacctgagagacggtggttgcagtgagccgagattgcgccactgcactccagcctgggcagctgagtgagacaccgtctcaaaaacaacaacaacaacaaaaaccctgagtccacaagagaatgcttcgcagcccctacctgaacgtccccaggcacacagacaacctgtgttatttccaaaatggagatcgttctcatctcactgggctgccatgaggaaataagacacatgatgctattctgtacatgggtgctgtccactgtagtcttatcgagccaaaacccggttttctcccagtgaaatgctaggctgctctggtgcttcaggggtaaagctcagggatgcatcatttgttcatgatcttattagtaaacccagtacttgccctctccagctcagcacatcctcgagggcacaagaaattgagaacatgatgacagggttccccagagcccattaatccaatactctgtgccctgcttctttgagtctccaagaagaaacagccaagtccagagaaaattaggggcaaccgtcctatccttggaaaaccccagaacactctaacctctctgtggtccaacctaaatctatcctgacccattagaaaaaggtcttcatgtctgtccagtgtctaccatactcctggcatgcgtaggtatttctctctttttattccaaacctacaaaaaaaggtgaaataataatataatgaacacctatataccctacacctagatccaccagttgttaacaatttgccacattctctctcccccgactcctcatgtgtgtatatgtgtacgtgtgtattttcctctgaactgagagtaagttgcagaagataacacttgaaccccaaacgcatgtttgaaccccgaaacgcatgtttaaaccccaaatacatccatagcatgtattagtttacaatgaaggacaaggatgtaatccttcatagttacaaagccatcatgtcagaaacaaaccaaagtggggaagtagtctacccgtagcgcaggcaataagggagtgcagactgtaaaatatttcagaacaaaaataaaatcagctaaaagtcagatggctttatagtctcaccatctcccgacactggcaattctgaatattatcagtgataaaatactcctctctgctagggcagactgtccctatctccccacacgactgcctagtatgccacagatcttcatacttttagatattttttaattgatatgataatagtctcaactataaagtccagggcatggtggtgcacacctgtagtccagctactcaggagactgaggcaggaggattgcttgagcccaggagtttgagtcctgtctgggcaacatagagagcgagaccctctttttttttttttttttttaacagtctcattctgtctcccaggctggagtgcagtggcatgatcttggctcactgcaacctctgcctcccaggttcaagtgattcttgtgcctcagtctcccaagtagctgggattatagacgcccgccaccacaccagctaatttttgtatttttagtagagatggggtttcaccatattggccaggctggtcttgaactcctgacctcaggtgatccacccatctcggcctcccaaagtgttgggattacaggcgtgagccactgtgcccaacctaagacccttctctttaaaaaataattaaatgtctccaaattcaaatttctccacttgtcccaatatttttttttttactgctttttctaagtacacaattcaaacaagaatcatgcagtgcatttagttgtgctgttccttgttttaatctagaacatgtttcatagaattgacatttttgaagggtccaggctagtggtcttgtagagtatcccaacatttagatttgtctgattgttttcctcatttcctcatgactggatttaggttaagcatgtttggcacagatactactatcacatgcttttttttttttttttcgatatggagttttactcttattgcccaggctggagtgcaatggctcgatcttggctcaccacaacctccgcctcctgggttcaagtgattctccacctgagcctcccaagtagctgggattacaggcatgcgccacgacacccagctaatttttgtatttttagtagagacggggtttctccatgttggtcaggctggtctcaaactcccaacctcaggtgatccacccgcctgggcttcccaataccacgtgtgtttttttgttttgttttgttttttacattttttttgagacggagtttcactcgtcgcccagactggagtgcaatggcgcgatcttggctcactgcaacctccacctcccggattcaagcaattctcctgtctcagcctcccaagtagctggaattacaggcacctgccaccatgcccggctaatttttgtgtttttagtagagacagggttttaccatgttggccaggctggtctcaaactcctgacctcaggtgatccacccacctcggccccccaaagtgctgggattaccggcatgagccaccgcacccagccaccacgtactttttaaactattgtttctagtcttcacagcatccttgcttaagcaggtgagcttggtaacaccaagtgacttgtcaaaggtcacggagccagtaagtggaacaaccagggtttcagagctttttctgctactctagtagttcttacctgaagattgatggtaactcttaattttgcatgtgtatttttcctggtgggagatccatagctttcactaaattatcctagagtaagtgatcccaaaatggtgatggccatcatgtgtaccatgctacctttccagagccccatttctttgtggttccatgtgatggaaaataagctcaaccggcctgtcaggcgaggaagaggcaggtgtatgcccacaacatgcccacagcttggagatcaggtgacctcaaggaggaagtagcccacaaatcacccctcttttcctcttcacagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctca

SEQ ID NO: 12264 - DNA, 261922 bp, Homo sapiens
  misc_feature (1)...(261922): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtggggagagtaattttacagagcagaaacctcccaaacaccacagccaggtgatgaacaaggccaacatcaacagtagtaagtcatggggatagcagttactcttgatatgatgggaagaaaatggcacttcacctctgtggtcttcctcccaataactcataacccgagtattttctatgaggaaagacgtcagacaaattccaatactaggcaacctataaaatacttggcctgtactcctcaaaactaacaaggtcatcaaaaataaagtgtgagaaattgccacatttaaaaagacatgacaacttaatgtaaagtggtatctgagatggaatcttggaacagagaaagggcattgaataaaagctaagaatctctaaataaactatgccattttaaaaataatgatgtgtcaatattggcttattaatcataacacatgtatcatactaatgtaaagtgtcaacgatggggaaactgaatggaaggtatctgggaactttctgtactgtctcctcagttgtttctgtaaatctaaaactgttctaaaaaataaagtttgttaaaaagaaaatatccaaattcttgtgaatattcttgatctcttttctactgattaaagggtatattagttatctattgctgcataaccaattgccacaaacctagtggtttaaacaagacatattcattgtttcacagtttctgagtattaggagtttcggcttggcttacctgggtcctctttaggatctcacaaggctgcaaagaagttattgggttggtgaggctgttctcatctgcaggctggactggggaagaatctccttcccagattagtctgattcttggcaggaccatttccttgcagctgtatgactggaagcccagctttttactctcttattccnnnnnnnnnnnnnnnnnnnnnnnnnnnnnnnnnnnnnnnnnnnnnnnnnnnnnnccagctttttactctcttcttccgggggctgtcctcagctcctagagggcaacagcagttccttgccaggtgagcttccccatcaaggccacgtggcttcatcaagccagcaagaagagtctcttgagcaagttggctagcaagatggagtcttatatgttgcatgtaactataggagtgccatctcaacaggtttaccaaattctactggttagcagcagggcacaggcacaggatttcaccaaagtatgatcaccaggaggcagggattatcatggggccacattactgtctttttgccacaagcctttattcatctaattcacatccatagtcatgaagggaaccagaagaatggagccatatactgcaggccacatccagccccaaagctcagcaacaaatcccaagtcccacactccagcattcagtcccacactcgcagctcaaaagccaccaagaagtctttggatgagcatctggttccagttctgaaagtctaggtctatgtatatactatactttgatgaaaagtttttaaaaatgttgggcatatgtcatcaggacctcctgaggttgtatcacaggcacgtccttaacttttgcaaaataaactttctaaatttattgagacctgtctcagatacttttgggttcataccttatatgtatcctttctcaggaaactactggaggatgttttccatcaaaacaggaaaggtaagcaagagaaagacatgggatccaggaaacccaagatctaattcagaagagagaagaggataattcccagaatgaaagacagtggagggggctcaagaaaagaactgagttccagccgcacagggaactgatccagttggaagaaaagactccctgagagatctaagaagaggaaatgggtagaattatagaacactacttaatgtctttgaaaacaccaagagcagacttgacttagccagaaagtttgaggtgttagtgctaaaagtgtctagaattattctgcccaataccatcgccacctgctacatgtggctgtttgagtttaagtcaaataaaagtctaaaaattcaattctgcagtcacactaaccacattttgagtgttcaatagccacatggggctagtggctactgtactggacagtgctggtatagaacatttcaactattgcagaaagctctctcagacaccacttgtctagaaaaaaattaagccaaggaagaaaataaaagaaatggagaaaaataccaacttccagaaaaacaagcccttgtagaggaaaagaaaaataatcataatttatagggttcagctgtgaatagccttttgctaatcataaaaatgtaaacattgagttctgaattatatgtgtagaactttattgaggtgcaggaggtgaggcttgtggtttagatgaaagagaattaaagcctcatcttcccggataggagcttaataaatgatgcctatgaatgaaaaatcaggaaggagcaatgtagacattttgttaaatgtgtaaaggaatataacaaaagattcagctaaatgagtccaagtgatgtctccagggaggggaaaaaggaatagaggaaacaggaaatgttgatttagtagcaagtcttatgaaacttaagcttgattcttaagctatgttcatatagaggttgatcaaaataatgaaatcaaagtaatgacaacaaaaactgttacaatcccatctccccttatcatgtcttttttggtctccaggcatgacacttctatattttcatatttagggaagccttatctgaagttccgatattggcacctaactgccctgctttggtttgtagccagttgtacaagcttctagtcagatgcctgcgtactcataaattcttagactaactattgtctgattttagaagcttcaagatatttggtatttcagttaaatacagagtaaagcgtgaagcttccaatataatgtaaaaaatgataatagtaaaaataataatagctaacatttactgaacacttaccatgtgcaaggcatataataagaacctaccaataaatcagggtgccaatgtactgtcgttccatagaagaggtcatagataggccaggaaaataaagctgttctttcatctctagagagcatcattccagattagaatctgcagaatttagtaaggaggtggcagtgtttttctctagtgtgactaggaggtaaatataagctgcttgctggttcactcacccctgtgtaaccatggtaggaatataaccagctctcctgtgagtctcttacttctgatggctttgcaaattattagggcaacctgcagcaggccagtttagcaggggctttggggctttcttttaggaggaatttatcccaagagatctaagccagggtaatttcatgtgaactcactcttgccccaccccccaccctaactttttagatgcacacttcattatgaatggagtttgaggttctgctcatctgtagcacttctatttactatcatagtggtttcaaaagtaatgtataaagagtgtcttagtccatttggtctgctataacagaaataatataagctggatggcttataaacagaaatttacttctcatagttctagaggctggatgtctaagatcagggtgctggcatggttgggttctagtgaggactttctttcaggttgtggctggccatcatccccctgtaacttcacatggcagagagagtgccaggcagctctctggggcctctttcataagtgtactaatcccattcgtgagggctccacccttatgacccaatcactttccacacatcggggggtaggacttcaacatataaattttggggggacacattcagctcagatagtaatgatttttcagtctaataatccctaaggatattgagatgtgtatacataggaaccctcattctctgttagtgaaacataaaatagtgtaaggattttgactggcaacttgacaatatctatcarttttcaaaatgtgcatatatcttctgcctcagtatttctatttctagaaatttaccttacagatacatttcatataagtatacaaaggtaatgtacagggatgcttactgtgtgttttgtttcgcattgttttgctttattttgtaatagcaaaaacctcgaaacaacctagatgtccattaataatgattaaactattatactctatccaatcaatagaattatttgtggaaattagagtaggatatgtttatgtgatgtttcataaaaatgtctattgcatattaagtatatcgatttatgtcaatatctatattgaaaatatctgaaacttaaaaatgactaagaaggtcaatgctcattttttactttatataattttgtactctatgtttttaaagtatgggcctgtattattttttaattcaacaacacattttaaagcatgtaatgactagtaagtcacaattctagtttgcagctaccaagtgagtgatctcatattacataaatatcctttggtcataagacctgtgagaacatacaagatgaacaggtataatcagttaagatgataaaattctgttagattttatttactaccatgtgaatcatggagggggaaaaggtacatgtatttgaaatatgagattactttctcaaactcctggcctcagacaatctgcccgcctcggcctcccaaagtgttgggattacaggcgtgagccaccacgcccagcgagattactttctaatgtttaacttaaaaaagaaaaaatattacaatatgtttaatctcaaatccatatcaagatataggtgactcacagggttttgcctgaatacaggagcaacccagagaaagagcagttctctgtcacataagagcctgtgatttctgtcgctgtgtgtaaggacagacagacagacagatagaattagattttaaattagaaaaaatacttcaggagcaaagaaagtgcaagaaagacatcaggcaagttttaagaaaatggttagataatttttatgaaggaaatgtcttacgttcggatttgccaaatagggcattattttctcctgataagttactgatttccatgttatctgctcttgctgttcagaaattgagcctgtttgtgtccgcattcacacgttgcttctgggagccaggagtcatctgagttaatagaaaaatcactaactcggttacatatgagagaggttctgtattcctagcagcttgccttatctaaggagggagaaggtgctaaataggattttggtataccctcttggtttagtaacagaaaaatgatggggtctaatctttctaattacaccctgtggatatcttatttagtgccattgtcaaatattttcacctttaacttcactcatcacatttttaaaaattgcttttgtcaacttgatgtttactgggtcttattcctcagtttctttcacactagcaccagtaacttacctgtagctcacctggtgaaccttaccagagtgagtacatttaccaccatgactggacaaatgacatgaagaaagcagtcacggaagggttaaagcctctcaaagtcatgcttattttctactaaattcttttgcatgaatatgacattgaatggggcctcagtaaatgggaaattcaacctaaaattgaactgcataggctggaagttaggtaaaatttgattccatttgaattgttctaagcaagcaatttgttaccctttatcctttagtggaattgatgaacaggtggttttcagaagatcacttggtaaatttagcttctgaaatttgagcaactcaagatctgattggttgctcttgccacatgataattcggagcccaggcatcacgctggcttttgcctggggttctcaggaggggagagttgggagaggctttgctgctgaggaaatttatttggtagattgaaggtaaggccagtttatgactttttctgtaatactctttcaggagatgctccacaacttccctcgaagtatttttcaaaggtttgggccataactgaggaaattagtggtagaaatatggctaggagagtttaaccccattgccctactaaggccctactaatatctgctatgtaccgtgtgtgattagagtcaagtcctttgctaaccaatttattgcttgactgaattggctctcttgtctaacatttttttgcctttgatatttttctctaaatatattagtgtgaaaaagaagatacgctgctctacgttcctatatttatcctgttctactgggcttcatttgcctgaggagtggcagtttcgctagcttaacaaaaccagccactgcagggtattggtttacatggcaaacatctttggatgaagggacagctgttccaactcatcatccacttcatatcaagagtcttactctctggcgtcaaactgtagaggccttgagagatcctttcgctgttttctgcattagaagcttaggctaaggactgacaatcctatatgtacctcaatcaatgctttacaactttgttatttttcaggtttgaacgagagctacagaaacgaaagaaaaagtctgtataagccaatggtgttcgggaagaaaataaccccattgccttgaggtttctttttttcttttaaaatttattgacagatgtatttttatgggttccaatttgaagcctaagatatattgcaaacagtggatcagggcagtatggaaaacaagtcagccctcttagaattttggtgctgggggataaatttcagcttcttctgaaacccaagctgacctttcactaaaatttttgctggaaaatgtcttytctctaagtgtttggaagtttaaattctctgttccctgagtccaaactctctcacttccttacctcaatttcgttttacaattttaactaaactgattatgtagaagtagcaattcccaacactgaaggaataaagagaaagaaatttgaagcttctgctgtttatacttgtattttaaatgtcttctctcctttagcctgcaacaatatatgaatttgtacaatagtttagcttcaaattctatttttataatgtcataagataatttctgtgctgggaatagactctaatatgttttcatttgtatggaatatgaaaagtttgtaggtgccactactactctggaaaaatggcagatgacgaagactatgaggaggtggtggaggtaagatttaaaaaaaaaacactgacagcaaactattttatgtagtgacaatcaaagctgtgtaggtgaattaatcattcgaaaaatacattgtctattataacttcacaaagagtcatcatttaaagcataagaaaggaatattttatgttcagtttcactataattatgtgggatttagaattgacaggaaatatcactgtttcccacttttgcttttctttaagctctcaaaaaaccaagttggagtaaaggcaggttttaattcgtcttctaaaactgctttcttccccacttcccaaccccgatgttcaaagggacagagaygaagagaaagttctgaaaatggaactctgtctcttagtatctgtatagcaatagaagaaaagatctactccttattctttgcttcaactagctaatcatctatagggtaacatgggttagatattcagaataatcatatgtatgaaattatatgcagatgtgagactttatacataatacatacacatgtgcacagacacacacatacaagcaaatataaataaaggcatgaaggtcacagcgattgttggagccacaccttcctaccaacttcattatatttacccaagtcaacaagactagcttttgcttttgaattttgaataagaacaaagactatagtgggtatcttgaaaattttccttccaattattagtggacatctaacacattttacaaagctgttaatcatttattttatatttattttacatccttttgtttttatcatcttacggtttttcctcaccggctcttgcctttagcttcacattctagaaataaaatctaaaggcttggaactataatgcacataaatacagtgccatgaatctgaatgtgcttaataattaccaattaatgatgatgatctaaacacatgaaaatctccaaatgcctaaggcacttggaggcagttttgaaaatctgtgctttttaataagactgaaattaactgtaagagctacccagaaccaaattttaggtggcagtgccaaaatttctctttggaaaattattttagtgaccagtctatatttagatgaagaaaattttatttattctacaaataaaatagcttttattactgaaggatatgagggaaaaaatagaatgaatctcgtacaatgtaacactcagcctctctggcttaaatgctgataccacatctttcatgctgatattatcactagtgtgcattttacttatgtacctaagggtcagaaatatcactgtcaaacactaatacaattataaattaaattgtcttccctatgataataatgccagtaacagtttttactctccaacttaaatatcccttgtctttcttaaaataattgtgtacctttgccactggaaattgtccttagtgctagacttgattgattcaactagatgtcataaaaaaggaggtggctatttttagacatcccatcsctaccattttgttcccattacagcatctgkgtctgaccagcaggtgataaacgaatagactgcctgccagaaagtattgaactgagatctctttgacctcaaaaaagatcatgagcataagagggtggtgcattcgaaaaaatggccagggaagattttagaaaacagagaggaactagctttaaaaatatgcagaaaacagagaagaactggctttaaaaatatatctccttgggatcttggacatctgaaataaagttttactgttctctctactctaacttaaacttgaaaagaaagagagagaagcaaggatgcactatctaattagtggcrcagctctaaaaaaagagtgagatttggcatacaagttaatgccaaccatttaaataatgttgcctcttttataagcgtatttctaagatggatttaccaatggtgagagcccagcaaaggtaaaattgaatggtttccaaggagctgcttttaaacttggatgctgagaaaatccaaaatagttgtgaatcttccattttattttaatatttcttctgaagccactgatgttttgtgtgactggaggaatgactctatgtggcgtcagcatcaaacaatattttctagtgtccaaatgatatttctcatgtgctgaaaagtcacaactgtaaaaaagcaaatctctgtcctgtcagtgcttgtgatttttgttgctatgtgtaacgacatacaggcagaattagattttaaattaaaacaatagctcaagagtaaagaaagcacaagaatgaggaacattaggcaagttttagacgattgttaacgcaggtgaaatagcacaggcggcctactgacaatggttaagtaatttgatgacacttcactgaaaagaatgcaggccattgagggaaattttgcatcttaatgttttcccttcccttgagtgctgtatgttttggtgttaaagataagaaaaaggaagcataaagtgttttacatccttttttttttttttttttttttactaagaaatgagccaagtgtttcatctttatccctttcctcatgtgcttggcctaaacgagcctctccttctgttcaccctacagagcagggtgaggctaaggacaggattcctctctccttacacatctgaaaccaagtgtcaaccagttcctttctgcatctatttattgctggtgatgtcagaagtagaacaaaagtagacttggtttcagatccaggctgcagatccatcatgcaggccatgatgacctcagagccactatggcaaattgcagcctacctttcccacactttgtgatgaagaatcttctcattttccccttcattacttggcatttaccagttttcatattagcaccactctgtttaggacaatcacactattgaaagggactcacccatcactccagaagaaacttattacttactaatcaggagggtataggartaattgagatgtggatatacyttgggatcttattatttccatgatgcaatccatttaaaaatgtattcacactcgagtttctgttttagtttattgttagtttgcaaacagtgagttttatcacagttcctctctgcccaacccacacactcaggatcttcttattgtattctcttctcagcaaattctatcttggggaccataagaaaaaaatttccatgtcccagtaaagtaaaatagcttctcttgattaaaaaacagcctcatacatttttctcagccctctgcatctctttgtccatttggatggcattcactttagctttcctgaagtattacaaagtgaagatgggttccaaaatatgaacaggctccctcacctacccctttcccacagacattccaaatcaaccgagctagtgcagtcacctaagtggttcagctgaggcagaggagaggtggtttctgctttggttctcttgccaatgcctttgtgctctatttacagtactacacagaagaagtggtttacgaagaggtgccgggagaggtaaggcccagcccacagctgcataaactgcattctcattaaagcaggaagagctttctcctttcttagactcccagggccacaaagatggcaaaagggattatctgacagaggatcactcacctacctgtgcccagaagctggtgtgaaagcacaaacattacctgtttgatggattatttcacctttttttcctattcaaaaaacgcaagatggcagggggtggttccccctatttcttctgtgtgatatttttgtgtagatgaagctaattagaataatgtcagtggctatcaccattctccaacagcagcaggagggatggtgacaacaagccaaggagccttggctttgtgattggcatagggacaagcagttttactgtgtggagttataacttgtaggacaccatctctgccaccagggatggtgtctccagggcttcgtccctratgatgcattgaaatgctactcagattttagcacattagcaattctaaataacctattaccataaatattccacgttcaagctctttttttttcaaggtgaaatacctctctcatgctttattttctgcatgcagctgtttctctttgagcatgacaaacagtgatatggatggttaatcctgaagcttgttcagagagcctgtgactgcataaaaactagtatctgtagatgctgtaatttggttagtctctcacagtcaaccatgcctaggtaatcatgggcagaaaacaacctattagcaatgatgtgacaacactagagggggtttttgtaaatgtacaatttccttactaggttctcttttcataattgatgctagaattctttggtacagatgatattagctgtgaagggaaggatactgtgaaatggattgaagagttggctgcttatctttttttcttacatgcattatttttaaccttggattagacccaaactttgggtcttagtgtcttccactacagcctgctgtaagaaatagtaatttctcacctactacgtagataggactgttgtgaggataattaccccattatgttgtcatcattattcttgtccacctaagcatttattagtgtaaatggcactccrgttcacattaattaactgactaagccaagggaatgaaaatctcttataatattgatgcgattcatttttttaaagttcattattctttgtctcctactacagtggagaatgcctaaatccctgcagaacaaacgaccaattttcccttagtcatttacaagttaatattaaagtcaagaatttgagctttgtttgattatcttaaccttttgttccccgaactcaagtttgcttttactttacccaggcaacttaagattttcaactgttttaaaaaaatagtttattgccaatttcccccccactactttgaagtgttcgagtgtctttctgcaaatgcaaacttaaggcaatgttgcaaagtaataaggagtaaactttttattccacgcaatcccaacaatcagcattcagatttgtgtacataatgtgccttcatacggctacagtgtgccatttcctgctttggcttactttagatatggagaagtaacaccaggaatgtatatctgacttgaagttagactaatatatactaagatcacagtagcacagtttttactttcacaacaatgttgaactgcatatcaaattttcagacaataacaaaaatttatgagactacgacaacaaggacatctgactatgagcaatcagaaacttccaaaccagctctggcacagccagcactggcacagccagcatcagcaaagccggtggagaggaggaaggtcatccggaagaaagtggatccttcaaagttcatgaccccctacattgcacacagtcagaaaatgcaggatctttttagcccagtaagtttcaaacaacttctgctaacctggcttgattattaagaaattactkatctcaactcactctgttttggatgctggctggatttgtttctcaaacctgtatgaaacaaaaacttattttgcaaattataggctcttgtgactgttgaattttccttttatgtaattcatttataccattgcagcataagaaagcattcttattgaaatcattcctgcaaaataagcataaggccaatcataaagcatttattggtatttaatcactattagccaatctagaataatgaaatcataaatacagatttaatttaggccagttcacagaagctacttaacatatttaaacaatgtcagcagaatagcttcttagtagactagctaacagyatataaaaaggtatgtaaagaggtgtatagtgaagaagaacatttattttaaaaatccaagatcagactaagaactcatttgaaattgaggatctgaatgtttggctataccttaaaacagtggttattaaccatggctgcacactggaaccccctgggaattttaaaactaatgatgctcaggccattctagtttaatttgttcagagttgggactgtgcagaaaggtttttttttttttttttaagaaacagaatctttctctgtagcccaggctggatcaagcaatagcttgatcacagctcacttcagccccagacccctgggctgaagcaatcctcctacctcagtctccctagtagctaggactacaggagcatgccaccatgactggctaattaaaaaaaaattgtagratctcctaattattttttcatagaggtagggtcttgctatgttgcccaggatggtcgtaaactcctggccacaggtgatcctcccaccttggccccacaaaacattagaattataggcataagccaccatgcccagccctgtacaaaaggattttaaaaagctgcccagatgattctaatgtgtacccaggttgagaatcactgctctcaatggtccctggtccttagattcccatgcacagttctgtaagttacactgactgattcagacagattcagacacatttcaatgggtctaatttgtttattgtccatggtgggctgaggtctcactgggtggcttgattgcatgtcctctggaggcttaaaaaaatgaaatgtagcttaagagaacattggattatataagactaaagtttatgtcaaaagcatcctattgaggttgagcaatacatactcacttttcattaaatgatagcagctcactgtttggtaaaattctagttcagagccttaaataatctaagacaggtttctagaaacaagattttcttaacttctttagtgctgcagtattcagcaaggatagaattttttgtcaatatattgccatacattcttattaattcagatcccatgaacctagaatttctgatgttctgaacagaatgccagcaaaggtctgtaatagtttttaagtggttagtaaccaaatcaatagtataatttagattgttcactactccacttaagagtactcccaaaacatttataatgataaattatgcacattatcattaaagcaagaattcattgtgtattcagcagaaataataaaatcacattcctaaatttacagaatataattcagacctgccattaattcagctggtgtctcagctatctgaactactgaagtttagctgcaacttctgaattgaatatttttgcattgtattagcactcaaatcttttcagaattaactcaatttctatatttattttctaaaataattgagatttaggctttttatgtatgcattcagacaaaaaaaaagattgaaagaatcattttagggtatttccaagacaatagtctataataaatttgcattgtctccaagatccaaccatgtttaggagaagcaattatcaaatctattttagtttttgctgagagttggggtaggggacaaaaagaaagctattataattgataattgctataacttgaaggatttttttttatcaaatggggtgagtatgttgcctgaaattttcactgctgtcttgttaggctaatatctgatattcttttcagaataaatacaaggagaagtttgagaaaacaaaaggacagccatacgccagcacaacagatactccagaacttcgcagaatcaaaaaagtacaagatcaactcagtgaggtgggctgcattgctgaaataaaggagagggacatttcaaaatacacctactgctgggaattgtgggctctaaatatgtgctgtgagaatgagcagttgarttactatgagctagttcacaaatctagaaaagcatgaaccatagatcatgttgctgtaaatgtgaacccaaagaaacttctaaaagcttggcttagcaacttagcttaagaggagactatgagatggaagctccaactcactgtggttctccacactgtagcacagtaaggccaagaagcagcaggctggagatccagccaggaaagcagacaagcagtaaatgcaggtgcttctttgaagatcacatttttccagctaaaatgcagaaactatgctttgtgatgcagacctagagtcattggggtaatgctctgtggttataagaaattccttaatatactcacatgtacatgcctgtcatgaactctaactgtgcattatttgggcaggttaagtatcgaatggatggtgatgttgctaagrctatatgtcacgtagatgaaaaagcaaaggatattgaacatgcaaagaaagtgtcgcagcaagtcagtaaggtaaggcaatgatatggatggctggggtactcagtagcatgtgcatcacctctgcattgtcttataggagaaaattggacaggcctgatcctgcccaccagcctcatgggcagtgtgagttcaatacctgtattcatcaaggaggctgcacagatgactgagtggcctgtagaacctatgggtggatggaagagtccatgccctgcccaaagaggcagctgtgactcggctccaggctgttgctgcatgaagtcccagtgtcaccaaagaagctgaggagctaaatttttaattgaaaggaattagaattttcaatcaaaagctgactattgtaggaaaagtattataggatgttggcatggtcaatgttttcctagtaacccattggcaacctctgagcaagcatgccttcatgagtctccctttgttgtttaaatcctcatgcctttgggtgagacctcaagccacagatcctctgctccttctgtctaggttttatacaagcagaactgggaagacaccaaggataagtacctgcttcctcctgatgcccctsaacttgtccaggccgttaagaacaccgccatgttcagcaaggtaagggyctgctccattgccacttctgtcttcctatgtcatcccatcatatatttcatgtaatacttggtgaactcttgatcatctggaatacaattccccaatctttttatgagtagccttgagacatgtgagactgcagggatagggcttggcaaaaaggaactgagaggaaagctcctaggcagagtggggagagggtcctttgggaacctgagcaacctgggggcagaggggagtgtctgtggagaataaaggtgctctggagaaccagctgagagagccacaaagtaatatctcaaaattgtctgtagaccctttggtatactttggatgtccctggctattactctaattagaggtttattttgtgccccttcttgcaagtgtcctatattgccctgaactatgtgaagtgcttcctggctccttacattgtgttagcacttgtaagtgctattaataaacaatgacaaataatgaccaaaaaaaaaaaaaaaaaaaaaaaaaargaaggcaggtagagtcacagagaaaagttgaaacaaaatcagacacatctgcccctctgaaaataagaaaaagcagggcatgctatcagtaaaaatgacttgggttggatggaaagtgggaagttatctgtgaatttcatttacctttgctctcacctggcccttggttctttaggttattaatggatgaattcaaaactatgtattttgtgtaaacgtgaccctacttcctcctaacttttcactcttttttgatttagaaactgtacactgaagactgggaagcagacaaaagtttgttttacccctataatgatagcccggaactgaggagagttgcccaggcccagaaagctctcagtgatgtaagtgaaatgcaagtggcaccacttaggtgtgcagagtcaggggaacttgaattacatattctggccagatggtcactgcaactcttctgtataagagactaaatgttgtatttcagaggagtatgtctagaattgttataatttatgatgtctcatttaaattagatataatttacactttatattaaatataatcttgtccagttccctcttcttataggtggcaaacctgaatctggggtcacattagttagtggcagagcccaggcttgtgagcccaagactagtattcttcccattagagcatgagtccttctttccccttggctctggttgaagttgttctgtgacaacagaatgacaatttttaaaaacctattgtaatcatagccaccttcccaaatctattaagtaaacaatgttatggaagggttgtgccttactattctaatcatcaagtccaaattgtggtgtgtctccctttttctgtgtgtgggacctgactagtgtacttgttaaaacatatttgtggctggatgtggtgactcaccccctgtaatcccagcagtttgggaggccaagagggaggattgcttgaagccaggagtctggagatcagcctgggcagtaaagcaagacctcatctctacaaaatatatttttaaaaaattagccaagtgtgggggtgcatgcctgtagtctcagctactcaggaggctgaggtaggaggatcacttgaacccaggaggtcgaggctgcagtgagctatgatcaagccactgcactccagcctgggcaacagcgagacctccatcttaaaaacaaacaaacaaacaatgaccacaccaacaacaactaaacaaaccaaaaacacatttgtatagttatcccacaaagagctcttgctatcagaagatacttcagttagtgaaaaatcagtgatcccacttgccggaattttggtatcctagaccttgaaaactgtatgttagaggaacttaaaaggcttaacagagtccttaggcttgaaaccagcagcaacagcagcagagagacccacttgggcctaacactctcccttattttgaggtactttcttacatgaccattggatttgcgggaggccatattgaaaatccagactgctactccagtcttcagcagagcactgtattataaagcgacaagttatttgacattcaattgtcagttagatccctggaacctcttatactcaatttggacttagtaagccagttcagactgattgggatttacttctaatggaatctatggtctgatcttgccatgaaccaaaattatacacaccartttgatggtgtctccaacttttgaggtctaatttttaaygccaccctcttcatatcacctgcaagtttagtggacatctttttctatttcactttctatgtaattggttaaaatataacacagatacagtcgtatccttccacaggtaagttaggaaatagagaaggtgtaacaaaattttgaagtcatctagcacatgataccaattttattgtgtgagtacttcttgcttctctttcaagattagctttttgattctgtatctcacagattcacaatattgttacatggctgttaccaagtgatcaatagttatttattggaagtctattatgcatgcacacctggcaggatagaaaagtactacaagcagttttcatcctttcctcttagaatttataatcaggctgataaaataaaagtatgatatagcaaacaacaagaaaaaagttaaaaatgaaacaaaacccaacagtctaatacttgctacaagacagacagaacacgtgtgagtaatcagagaaggccatgtggaggtggtggtcccgagggcatgggtggtgatgaagaaaggcattttgagtagagggagcacttgaacaaggggacacaggtaaaatgaggtctgagttttgagggacaaggaaaatgaatgatgggagtgcctcatttggagggcacttgtgagaatgccggcagcaggaccttgaaaggcagacaaaattgcttcgacatggaacggtaataaataagaggcatcataagattttggagcggaaaacagcatgataaaaatagaatctggagtaattttgatgagcaatatgatagattgagattaggaaatacaggaaaaactgggtaatttggagaaatctattttagtaataattagggcaaaggagaggaagaaaggaatctgagggtaataagtattaataggcatgaatggcattggatattggagccaaaggagagaaagaagccctagaggagcttctgactgtagactggtggtctgggtgagtaggggcacagctggtaaaggtgcgttaatggaaagagaaatggagttgagatgattgaaggaaacttcagatcaaggcatcctatggataaattagaaagttccattgctcaggtatgagaacagggcaagaaattaatatttgagagtcatcagaacaaagtgatagccaaagacatgaacatctatgagggaagcagaagagtgcatggccaagggcagagttttggaggacacccacacttaggactgaacaggagccagcaaaaggatgagggaacaaacagcgaagttgaaaaggaaccaggaaatgccatgtcatgtaagcctgggagaggtttccaagaagacagttaatctcctatctcccttcatctatcaaatggagagatgaaggattaccttcataccattctaatgctatggactttgaacaatgaaagttggccacatgttttgagcaattacagtagaagatgtaatgaaagagaacatacaataatgaagtaaagtcttccctgctattcctcaaaaagatgtgacagttaaggcatagcttttattttaattgcagaccaagtgtgcactcagtatcagattattgacatgcctattaatactgttgtcagtactatgaacttctacaattattgggcacagagccctaagcaagctgttgtttgcagaatgcaccatgggtaggcacatagatttctggctaagggcttgggcttagatgctgttgctatctctcctgtactatcttcctgtgtccttcttaatctacttatcatgttttccttattaactaagtagagacaaactactttgcacacactaagagtctttaagctgatgcagaatactgaactttttttttttacttttttaaaaatcagattattctccataacaacagaattctaactaaacagaattctgaagaaggttcctgagaaattaggacttctagatctgatttgtctgaaacttcttggcaggatgtcatacttaataaacatttatcctattcaaatgttgcttttaccctaaggacttaaccagccatgaaawatcctgttgtcctatgcctaaaatraagtcttcagtttgtatttttttttttttttttttgagacagggtctcactctctcacccaggctggagtgcagtgatacaatcttggcttattggcttattgcaacctccacctcccaggctcaagtgatcctctcacttcagcctcccaagtagctgggactacaggtgcacaccaccacacccggctaatttttgtatttttggtagagacagggtttcaccgtattgccctggctggtcttgaacctttgagcaattcatccgcctttgcctcccaaagtgctgggattacaggcgtgagtcactgtgccttgcttaacttatttaaaagaaattaagccaggcttgtttgtggaatttgtgtaaatacatttcaaaatctgtcttttgtatcccaattgatttgatgtccatgaaagcttttggtatargcactaggtagatattattgggataagatacagttagacttggttaaagtataaagatgattgggaccttgggattattcaactgctttacttgataaataagaacactgccatgaggaagggaaaataatcgtagaaacttcacagttgtgtcacggaagattagaaagataattctcctcttgagacattcccccatggcctcagtgtgtaagacacacattgagatgtcagtcattgactcttgctctagctaggtactatgcaggccacaagggttcccaaggataggacatcttctttgccatcccagagctcacagtcaagaggaaagagacatgtagacaaaaaattacagtgtcatctgacaacccctctaaaggaggtaatggccaagttgagtgagatcccaggagaaggtcatcacgtctggctcaggagtcagggaaggcttgagaggggagtcatggtgtcctgagccatggagaggaaacagcggtttgcagacagatggggagagggaacagcatgtacgaggccgtgaagcatctgagggcttcatgtatctggggatctatgaatagytctgcattgttggaaacaggggccaagtctggtggaacaaaagaaccagaggaatcagaaatgaagagagaaaggagggcaagagagaaggatatgcattatttgtgggcaccatacttattttaaggtgatagaagtcttttataggctgaagggaaggagctaatgaagaaggagagtttggggttgtgagaaagaggagggatgactgagagagctgggtgcaaaaggatatgctggaaagggcagcaccctgggtgcaggagtcattccctctgaaggatgtttctcctctgagccagggaaggggtgggagacgcagggatgaatatggagaagayaagtgtgtagcgtttcttcactctatgaaagaggaagctgagagtaaggtggggttgattgtgggcttaaggacagtgttggggttttagactggcccctgagagtagggactaaccagagactcataatgggctgtgaaagtttccttgaagacaaaatggcattagtataccatagggtcatagagtattgggcacagagccccaagcaagctgttgttcacagaacataccactgggcaggcatgtagatttcaagctaagtgctggggttcagagtctccctgccctgtaccttcttcctgtgtccttcttaaccctactcatcatgttagcattgcctaatccatggagttgcaggttttcttctgtggcattcagcatcctaggcataagaacagaggaagttggccaggcgcggtggctcacgcytgtaatcccagcactttgggaggccaaggcaggcagaccatgaggtcaggagatcaagcccagcctggctagcatggtgaaaccccgtctctactaaaaatacaacaaattagccgggcacggtggcgggtgcctgtagtcccagctgctcgggaggctgaggcaggagaatggcctgaacccrggaggcggagcttgcagtgagccgagatcgcgctactgcattccagcctgggcaacatagygagactccgtctcaaaaaaaaaaaaaaaagaacagaggaggtatatggtcaagtcgatccaaggctgggggtttattgaatgtgataaaaagacaaggggttgggagttgaagatgctggttaagagaataattgcagttgcaaaccatggcatggaaatgaatggaagaaagcagatctagggccatgagtcttgaggaggagggaagaaaattcagcaaaatagaaatcactagcagtactgagagcaatggtatgtaacatctaggacaaattataacatgttacactaaaatttaagacttcaaataaagatgaaagcataatcgtttttaaaatacatccctgtcttttatttcatcaggttgcctacaaaaaaggtctcgctgaacagcaagctcaattcacgcctctggcygatcctccagatatagaatttgccaagaaagtaaccaatcaagtgagcaaggtaagtaaatagagctgggacaytgccgcctcccttgaagactctgcttaataatttcaaccatcagagagggttactaaaggtgagactgaagataaaacacaaacactaggagtatttttacatatgatccccaaagactctacagcaaaagcaatacatccataaacgtcaagaactgtgttaataaatgtttagccagcttgatgactcagtaattgataaatgtgaaaatcaccttttgaaaacagaagccatgtyctaatgtcacttgacatttttacttatgacagtaatactacagagtcaccaaataaccacacacttccgtgaagagctggtttaaattcactgtgaagaccttggatagttctatcttatccgtcacacttggaaaaataagaatgtgtctcagacatagcttagttaacagcagtgggcagtggacctcataacttttaaggccctaacaaacagcttagtctacctatatttaggcagtaaactagctctgaggaatgtggctctgatgaggaatgcagagagacagatgcttagctgatgaataggcccatgctaaattcctattttaaattggtccaaatcagaccactttctcctgggatactgctgcttttaaatactttatcttgccctctgtggagatgagtgtcagtttgttctgcttgaattttgatgaaacctcaagatttttatcttaagcattttctgggtaaagtatctagtagagaagaatgatgaaatgatatggataatgatgtctattcagtgatgtttattagtgttttatattgtagattacctaactgtgtaactatgagctgtttggataaaggatctagtaagtatagtaaaatttcaccaataggaatactatcaatctgaaattttgcccaaggctaagcagaaattaactttagaactgtacataaatacatgatccattgaaagttttgatattggccaggcgcggtggctcacacctgtaatcccagcactttgggaggccaaggtgggttgatcacctgtcaggaattcgagaccagcctggccaacatggtgaaaccccatctctactaacaatacaaaaaattagccaggcgtggtggcgggcgcctgtaatctcagctacttgggaggctgaggcaggagaatcacttgatcccgggaagcggaggttgcagtgagccaagattgtgccattacactccagtctgggcaacaagtgtgaaactgtctcaaaaagagaaaaaaagaaaaaaaaaaagaaagaaagtgttgatattgtaaataagacgggagaaggacaatttatctttttggaagaaaaataaaaaggtgttttcaagtggtcatttagaaagaaaaaggaatctatttttaaatgtttatttaaagtctattttaaaagatactttactaaggaaacattcttttgccttatttaaatatgcagtggggattcttaaaagtgatttttgaaaatcactttcaaactcgtctataatcattctctccaccaatttagacttgccagttggtttagtgctacactctccagtacagtagacactagccaaatgtgactaggaagcacctgaatttgatcagtataaactgagtatataagtcagcttgggcttctacaacaaaataccatacattgggtggcttaaacaatagacgtttattttctcacagttctggaggctgggagtctaagatcacggattcagttcctggtgagagaccccttcctggcttgtagatagctgccttctcattgtgttctcacacattggagacagagagccagctctgatctcttcctcttcttcctcttcttataaggatgataatctcattatggggttcccaccctcatgacctcacctaaacttaattgcttcccaaatccccttaccttcaagtaccatcacatgcttgtgagttaggtcttcaacatatgaatttggggggtggggatatagacattcatcccataacacttagtgtccaatatgtgagaaatagacactggatctgaatatttaattatgaagaaaagaatgtttcaaattaatatttttatgttgattacatgttggaatgttaattttcagatctactgggttcagtaaactgtattattaaagttatttmccacatgtttccttctacatttaaaaatgtggctacaagaatgacttgcattatatatgcattggatggcaccactctaggtgggcaaggtgacagtgttgggtactttgaaagcattgccagaactggctttgccctgtggagtaataatatgagctaaggggaggtggctgtggaaaaaggtcactggatttggccatggtgacattatttattcccagtcttaacccagatttctgagttcttaatgactattgtgcatccaaaataatagttgtrttagggagaaatgcttgtgattggtagaagtccacccaacaacaaaccatccaacaagggaggcacagggctgccaagagtgacttacctttggtactatcttccctcctcactctcaagatgcattggcccatgttgcagcaggatcatatcttctttctccctaaaataggataaaaatctcctttatctaccctagaacttaaagtataaaaaaataaattttttaaaaaacctcctttatctagtcactcacatgcatttaaactcaatatccccttgttgaatcatgtctcccagatccatctgttggggccaaggggtcctccttggcccactgaaggttggctgaaaaatcagcttgcaaaaggcagattaattggagaaaaggcatacaaatttatttaacatgcacacacgggagccttcagaatgaagctccagctccccagggggtgcagaagcttatataccatcttgaggttacagaaagactatgaacttggatcctggcaaaacaggttatggggagtggggagaagaggaattctgttgaggagcaagaaatgattactagggagaattcaatgggtttgaagaacatacaatagtctggggtgaagtctgttgggcccacaaagcgaacaatggtttatgacagtagtctgtccaggtttctgacagactttagtcttccctcctgcaatataggttcagttgaaaactcagggaaggggtcagagggaattgttttcttttttggtaggttccggaccttagacagataaggaaacttgagcnnnnnnnnnnnnnnnnnnnnnnnnnnnnnnnnntgtgctttgggagagttggaggattgagagacaggatgggggtgggaggttagcggggaaacaatttttcttcttagtgggtctgtctggtctttatgtagaaagaagtctcttttagcttccattaatctctaagggcctttaattcaaaatactcattatactagggagccatattttggggtggagttctctgttcatcctcacacccttttcttacagctcccagttcagatggtaatgattgcatatctgcagtgattacactaatgttaccttccgtttgccagccttccttactacacctgtcagaatcaattctctcacctttgtctttggccaaagccattagctacatacttccttctgtctcagctgtattttgtagctctaacatagatgaacagtcagagttgttcatagaaacaggccttccaggtggggaagctatgcacaccatgaccagctgaaagtggggccctgaatgcgacactggaaagtccctttagtttctctgtacctgcctctctgctcccttccagatccacaaaagaaaaaatatgagatttcaggttggaatttcccactgataccaactggagcctaaattttttttaaaaaactaatctttcagtgacatattgttacacagcatgaggataccaggcccaggccctctaaaaccatggarattcttccatcacatagaattggraagatttccattgatttcaccagaagagatttgattgagtcaagcaggcagtgttaggcccactgtggacaataaaaataccagctgggttctttataccttttctgcagggataacttttctatgaatggaaccatcaggagtcccagtgcttagcccctcacagaaaaagagaagggtaattaactggctttgtattcctttccatttggtaaccacataaaaattacagattcagatgttgaaagtagataatgaagctatatgtttaagcaagacaaagggtacccagtttgtggccccatggaagtcccctcagctgacctctgaggaggagggaaacaatcttactgtatctatggacacatggtcaccctcttacccagagaaggtgtcccagagcttggaattggcctgacatacattcctctgttaaacaaaccaaaaaaattctagagaagtgaaactgactctttcttccaagtttccatcgttcaactgcaagtacaacagattttggaggaggaaaggtttccccctaacctttctctccaactctgttgtgtttggatgttgggaaggttgaatgttggaccctgacgtgagtaacccgtctccatgtattgtacaaaagctctggcctcactctcagacttgcagagtgggaccccttcgctggtagagagggtcccacatggacacatacctctctcttcctctcactccttcacctatggacccttgtcctttcaaattctctcctactcacaaatgagacagaaggccataacttcctcagtagccagcaagctccagcctcctcctgtgtcatgaaaaatcttcccagacttggcagtgctcgggagtggattgtgagagctcgatctcccaccctgacccatttcagctgctggataggaggaaataacatgtcgtggtctgtgaagattaagaaggaaggaaggactttggatgagggggttgagtgatcttacactcttgttttgcatcttgttttaatatcttcttgaaaaccagacatctatctctcactgtgagaattaatctcctgctcaattatccttaacaaatctacatatgcaatgcctatttcttgataaatgcccaacatttagacctcattaagaatatctgctaccttctcaactttaaattatatttcaaagttctctggatctcagttttggggatcaggcccaattgccccttcccaatcctaaggtttttctcctttgacaacaagcaagaggtagggccatgtctctccaaaaaatgatgcattaggagatcctarcctgaggtatgtgtacatcaagaacctctgaagttataactgtttgtgagcattttatagctttctcagtttcttgaagaggtctgtctccaaaaaaaagatgagaaacatttctataagtagtcttagcaaatccagaaatcaattttattgacttctgttctttaaatcttcaaaacagagtgcaggtaaatcaatcagcagtatagcacaaatcttatctcagcaaagatttccattgaagagttgttccctccccgcacatacaattttctttcttacagagtttctttctgttatgatgatgacaatagtaataactattattattattacaatttttataccctatatttgcttagcactgtggggtttacaaagcactctttagcgaatgatcttattaaacttcctagcagccttctctgtaaatattattgccagcacttgtggctgagaaaacaatcatatttggtcaagacaaagtcaagtcttggtcccagagtttgaacccaggcccaggactctaaaatttatagctacgaaaaccagttggctatttatttacatattaaccttttgagaagaaaggaaattaggcatttgagtgagggctaagtttcctctaacccaagctcgttgactctgcacatcactcaccttctcttaaaggtataccagaaagacattttctttttccttaaagggtattgtggggatgtaggcatatgccagygccttgagacccattagttatgtctgttaacacatttttatgagccatggagggagaattgctctaactcagcttgggctctagctcatggacccaggtttggggttggcttggttaattctgctccaagaacacttcagccaaggtatttcaaaaccgcatatcatggtctcagtttagtgtagttgaacaaacatttatgatgtaacttctgtgtgctgcattttgtgttgggttctgaggctatgaaagtgaagaagacataccacttctctcttccaggagccttacagcctgggattcagatggagtgggatttgggagtcagatggggcaataattcaatttttgaattactttccagttcctattaaatttaactctaaaggcgaagatctattcgttagcctgcaagttgaattttattgtggttgtttctttctggaaaactaggagtgtttgtaaagcttagaaattaacggctaagttcatttggcatagaaatctcaggttgataggttgtattgtaactgaaatataaatagaggatgacttctgactctatttctttaaacatcaggggacatctgcaacttccgaatgaatgaagtccccaaactcagcaaggggagggggcgttagtaccctctttctccattctctatccctatcgcccaactttctggttgggtaaattgacagtacattggaagatttttttwaaaggcatttattaaggacctaagaatggcttgctgaagatatttttaaaagttaatcattatttcttaatttgctgtcttatttgtcaattcatgagttatgcttgtcttattttctttttcttttttctagcaaaaatacaaagaagactatgaaaataaaatcaaaggcaaatggagtgagacaccttgctttgaagttgcaaatgccagaatgaatgctgrtaacattagcacagttaagtgggaagggatggctggttggtcatcctgggagggagacccctttccttagtgacttctagctacttgctctacctgaatgggtgccagaacacttgaggcccctcttcttggggcaagacctggtgcagagttccttttaagaaagaaatttcccaaactctctttccttttgagaaatattattttggccacatgccattatttctacctcaatttttacaacacattatggtaagaccctcttactgactgcaaagtgagattagtacaagttaaagggactctttttaattattctttgcctgaggagccaaattgtacagttaygaaattgattaatttagcatctcctcactggaaaacataagtctattgtttttcttttctcttaagttccctgctcctggcccttaagagatctttcttggtagccaagaaaagcctttctaattctgtttttagcctattttaattgttctaaatctctgttaagttgctaatcatttctgtaatggtaccacattctctaattgtaatctgaccagcctaaaccaaggacagggtggcattgtgtaacttttccaaatccctgtgtcttctcatggaaattcttgcatagttcatttccacagcagttcttcagcttgtctgatgtcttacagaggaaataccaggaagattttgaaaacatgaaagaccagatctacttcatgcagaccgaaacaccagagtataaaatgaataaaaaagctggtgtggcagctagcaaggtatgaggaaatcatcccatttatcttgatggtttgagtgtgggtaaatttcttataactttggctcttgtatataattagtwaaaaaggggaggagtggttcttgggggaactaccagggctgagaccagtggatgtgaggcatttgaaaaagagtagaattgaaacaacaagaacaacaacaaaagtactttggaattataatggggctactaaaaatgttttgccatgtatgagcattaataacatctaattacyatcttcaatatttcctaatttattatttgcctgaggaaccaaactgtacatttatcaatttgatttagtgtcttctcactggaagggccttttgctgtttagaaggagaaagattgtaatcttagacagcaggacttctccccccaggaagaggcaattggtggccttatatgaagataggcaatcatacatgcaacactatcattatttttcttattttcccactgactatgaaaaaacctggtcgcaggttcataaatccatggatatttccatatgtttgattgagtgactttggtgaatggcctgagtccttagcattctaaagcacgatggtcactaaagagagcataaacttcgaagccaaacacacttggttctaaccctggccttggctatgctggagaaagcaggattacatcacttagaaggctrttacagcatccacgtgtaagacggtgttttggaccaggagggtagcagggcaggtgataagaagtcttttgaaagcacagctgacttgatttgctgatggattggatgacacgggttttggtctaagcagttagatgaatggggtttccctttattgagacagggaakactatggaagaagttggtaatttttttggaggacagacaagagctcatcttcagatatggtagatttgagatgccttttagacatccacatggaagtgtcagaggtcagtcgactacatgagcctgaagtttcaggggagatatatggaaagttgtataaactggggtgtcatcaacatacagagagtgtttcatgccatgagtctggagagcatcaagggagtgagtgtaaacagaaaactttaggggctgarctctggggtccttccatgggaacatatatgtaagatgagggagaagcaaaatcaggagagggcaatgcgttgggaagcaagtgaagggggaagggagtcatcaactgtgtcaaatgtctctgaaatggatttaccaatgtctggtctctggtgacctgaacaagagcaatttggtggagtctgcttagagaggattcacaagtgaatgaaaagagggaaattgaagatataagtatattcaactctttctaagtattttcctggtaagaaaagaagaaaatgggcaagtagctaatgaaaaactgggtaaagagggactttttaagatacgaaacaaaagcatcatgttgatggaaagaatccagtagaaagggaagatttggtgatgttggaatggggaagaatgtctggagtgatatcctagagcaggtggaaggggaagagatttggtgcttaagaggaggggatggctttgccacaagccctgacagttcatctgcataacaggggagaaggctgtgtatcccagatgcgggtagggggagagtaaagtttgtgaatctgctttctggtcgtttccatttttcaaggaaacagttaattctctaaggtggaaaagtgatctgagtctcccattactgtagcatactgtcgtgatgctctgtggaggctgaggggttgatgcctctgtgcttcccttgtgtgtctcttgcctttggataccaagctgattgccttgttttctgagttcataagtggtagatttatctaggattccttgaacttctgtgcttatattgcctgaataaagggcttacactggggatcatggtgggaaccaggatcagtttcttgttctaatccctgtggacaggctcctgatgggggcttgtgaaccctgccttccctattctcccccaacacccctcaacttgctgcttctgccatagctggaattaaaagtgcaaataggaacagcagaaggaaaagcaaggctccttctccctgctccatcctcctcctacttgtaaattgaatacatgtgtgctccatgcacagttgcaggtgaggcataaaagcgtggattagtggtacttccagcttcctttctttaggagcgtgttggcaggtaggtagctgggggttgagagctgagtgaaggttctatagcagcaggtatctgggacattatgcatgatcactatttggatttctttctccctcctattatttctgtatctctctctttgagggcaaggaccatgtgttctttcttatatctgtccccaagccagaaacagaattgacaccctatggataattttgaatgaataaatgaatgggaagaaaaagcatcctggaaatttatgcagtttctctgctgcttttaagagttactatgagtattttgtttataaaatgtcaagctgccatttttctaaagagaaaattgatttgtggaartatgtcatattcataatagagacgggggcaaaaataacccatagagttactttatcattttatttcactcctacaggtaaaatacaaagaagactatgaaaagaataaaggaaaagcagattataatgtgcttcctgcttcagagaacccacagcttaggcagctgaaggcagcaggagatgccctaagtgacgtaagtatatttttgtcaaagtgtttttaaaccttagctgcaaaagagrtgaaaattttctcctttaatgactaaatgaatatataactttgcaaatacattaaggttatggagtggtaggttcattggaactatgtaaccacagaaaggcatgagtccctctgagtacaatgtgccttactgtttgtggttctgtggggttaattcaatgggcagggaaattctcacttgcttaggagctctgggcacctgggcctccatatggatgtgttgcttatgagctccgggcacctgggtctccacattgcagacgtgttgtgattttgacagaagcagaaggagactttcaaagatagatcttggccccagaaaccatcatttgccaacaacagaacttaaaagatgggcccctaagtcttcacaggactttctaattgtgyaattattaagagcccgactaagccgttcaatttaaagcatattaggcaaacgagactgggcttgggattaaaggactaacagcctgagagagagagagagagattgaatatgtgatgatttgagtttatctcttacggttaggtttgcattaagctttcctagcatttgtggattttatgtagctgtctgtgtgggttagttatcttttctttgtcccttgaactaagtcagcagcataggaaatatgtgtgtgtggttggggagcaggtgtgggaaagtggcaagtgagagggtataaatggatctgcccaaatagctctgctgggaaatcactgtaaagcacgtttgctttcttttaaaaaacattttatttcagtcattgttggggtacaggtggtttttggttacatggaaaagttctttagtgttgattgctgagattttggtgcacccatcacctacagtgtacactatgatcaatatgtagtctttactccctcactcccaccccaacattccactcaagtccccaaagtccattatatcattcttctgcctttgtgtcctcatagcttagcttccacttataagtgagagcatatgatatttggtttttcattcctgagttacttcatttagaataatggcctccagctccattcaagttgctttgaaagacattatttcattcattttcatggctgagtagcattccatgctgtatatataccacattttctttatcctctcgttggttgatgggccctcaggttggttccacatctttgcaattgtgaattgtgctgctatgaacatgcttatgcatgtgtctttttcatattatttcttttcctttgggtagatactcagtgatgggattgctggattgaatggtagttctattttcagttctttaaggaatctccatactgttttccatggtggctgtgctaatttatattcccacccatagtgtaaaagcagtttgaagcagttttactctctaagtgaaaaacatccttattaaacatctaaaagcccaagttcaaatctcctttgttgataaagacaggaatataaaaatattaaacatgaatagcatcatttacattttgaaaacccagaatgaaaaaagtgacaataatctgctttatcagctgcatatttaaaactaatcattgcttcttcttgttcaagctaaaggtaaatcctggcagagaagaagagttagtagtaactcttagtaccagttcatatatatatatataattttgaaggctaattgtttgtataataagagatttcttataggtataggagggagggagattgcgtatttctcaccttatataastttttcatgaaggtttgtttaaaaaaattaaacaacttgcaattgcttaaaacctgtgtttgctgtggtgctatcagtgaggaaagagtatgtgagctaagagacagagagggcagcaatttacaaatacacaagaatctctgctactaaggacgtggtcagaggtggcatattggtttcttaattttttgagtttggggaggagccaagatggccgaataggaacagctccggtctacagctcccagcgtgagcgagcgacgcagaagacgggtgatttctgcatttccatctgaggtaccgggttcatctcactaggsagtgccagacagtgggcgcaggtcagtgagtgctcgcactgtgcgtgagccgaagcagggcgaggcattgcctcacttgggaagcgcaaggggtcagagagttacctttccgactcaaagaaaggggtgacggacgcacctggaaaatcgggtcactccctcccgaatattgcgcttttctgaccggcttaaaaaacggcgcaccacgagattatatcctgcacctggctcggagggtcctacgcccacggagtctcgctgattgctagcacagcagtctgagatcaaactgcaaggcggcagcgaggctgggggaggggcgcccgccattgcccaggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaagagtagataaaaccacaaagatggggaaaaaacagaacagaaaaactggaaactctaaaacgcagagcgcctctcctcctccaaaggaacgcagttcctcaccagcaacggaataaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaagtatgggactatgtgaaaagaccaaatctacgtctcattggtgtacctgaaagtgatggggagaatggaaccaagttggaaaacactctgcaggatattatccaggagaacttccccaatctagcaaagcaggccaacgttcagattcaggaaatacagagaacgccacaaagatactccttgagaagagcaactccaagacacataattgtcagattcaccaaagttgaaatgaaggaaaaaatgttaagggcagccagagagaaaggtcgggttaccctcaaagggaagcccatcagactaacagcggatctctcagcagaaaccctacaagccagaagacagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagcttctgaaggaagcgctaaacatggaaagcaacaaccggtaccagccactgcaaaatcatgcccaaatgtaaagaccatcgagactaggaagaaactgcatcaactaacgagcaagctaacatcataatgacaggatcaaattcacacataacaatattaactttaaatgtaaatggacttaatgctccaattaaaaggcacagactggcaaattggataaagagtcaagacccatcagtgtgctgtattcaggaaacccaactcacgtgcagagacacacataggctcaaaataaaaggatggtggaagatctaccaagcaaatggaaaacaaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggaacacccagattcataaagcaagtcctgagtgacctacaaagagacttagactcccacacattaataatgggagactttaacaccccactgtcaacattagacagatcaacgagacagaaagtcaacagggatatcaaggaattgaactcagctctgcaccaagcggacctaattgacatctacagagctctccaccccaaaccaacagaatatacatttttttcagcaccacaccacacctattccaaaattgaccacatacttggaagtaaagctctcctcagcaaatgtaaaagaacagacattataacaaactatctttcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagaggggaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaatagatagactgctagcaagactaataaagaaaaaaagagagaagaatcaaatagacacaataaaaaatgataaaggggatatcaccaccgatcccacagaaatacaaactaccatcaaagaatactacaaacacctctacgcaaataaactagaaaatctagaagaaatggataaattcctcgacacatacaatctcccaagactaaaccaggaagaagttgaatctctgaatagaccaataacaggagctgaaattgtggcgataatcaatagtttaccaaccaaaaagagtccaggaccagatggattcacagccgaattctatcagaggtacaaggaggaactggtaccattccttctgaaactattccaatcaatagaaaaagagggaatcctccctaactcattttatgaggccagcatcattctgataccaaagccagggagagacacaaccaaaaaagagaattttagaccaatatccttgatgaatattgatgcaaaaatcctcaataaactactggcaaaacgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaagtaggaaaagaggaagtcaaattgtccctgtttgcagacgacatgattgtatatctagaaaaccccagtgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattagccgggcatggtggcaggcacctgtagtcccagctactcgggaggctgaggcaggagaatggcatgaacccaggaggcagagcttgcagtgagccgagtttgtgccactgcactccagcctgggcaacagagggagactccatctcaaaaaaaaaaaaaaaaaaaattaatgaagtactgatacagggtacaacaaggatgaagcttgaaaacatgctaagagagaaatcagaaagaaaagatcacatttcatgattcagtttaaccatttcaaagtgtataattcagtggcattaattacatttacaatgttgcacaaataataccatctcattccagaattttttttaatccccccaaccataaacctcatacctattctcccttctttccaggccttggcaactacagagtttttggtgtgtttttgttttgcttttttgagatgatgaaatgttttaaaattgattgtggtgacagttgcacaactctgtaaacatactaaaatccattgaattgtatactttaaattggtgaattgtgtggtatatgcattaaatctcaataaagctgttacaaaaaaaagaaagaaaaaaaatttttttgagtttggaatgtatgaaacttaggccttataataattgctaacagaacagtcttataattcatgacattccgtgttcgattgtcaggtttttttctttttgttttgttttgttttgttttgttttgagacggagtctcgcrttgtcgcccgggctggagtgcaatggcgccatctcggctcactgcaacctccgcctcccgggttcaagcaattctcctgcctcagcctcccaagtagctgggattacaggcacccgccaccatgcccaggtaactttttgtatttttagtagagagagggtttcactttgttggctaggcttgtctcaaactcctgacctcgtgatccgcccgcctcggcctcctaaagtgctgggattacaggcgtgagccgccgcacctggcctcaattgtcagtttttaagacagttgacaggcgatatcttttcttcatcttttgtttagtgttagaaaatgtaagtgttataatcagcgtgggagtgacaggaatctactttaactgaattttttttctttgacagaaactatacaaggaaaactatgaaaagacaaaagcaaagagcataaattactgcgagacccccaaattcaagctcgatactgttctgcagaacttcagtagtgatgtaagcaatcctwctgtcactctttctgttaaaaaaagaacccattatttcaccaattaataaatgaagtatgttttgtcttgcagaaaaaatataaagattcctacttaaaagatattttgggacattatgtaggcagcttcgaggatccataccattcacactgcatgaaagtcacagctcaaaacagtgatgtaagttctaagacaattgtttgactttccaaataacatttttctcagggcatgaatacaatggctgcatcttatgcctaatttcttctcctcatagaaaaactacaaagcagaatacgaagaagacagaggcaaaggcttcttccctcagaccataactcaagaatatgaagcaattaagaaactagatcagtgtaaagacgtaagtctgtagtctgaactttgaatgtgactgccttccatagcatctagtggtcaggatatgtttaaaatgttgccacttttacaaataaatgtaagccaggcaatcgcaagaaatgaagtctattttgtagtaaacatcctattttcccttgttgacatccctacattttaagaggtaattctagctcattttcccaaagaagagttattggaaacccgaagatataggaaagtttctcatacagatataagagcacctctcaaactacagtctagttagaaaaaaatatattttattaactacaagtttcattgctttgtggggcatgaggttctatttgcttggcctgtgggccaccttggatctgacaggtgatactactaaaccaaatgcctttgcttccccacagcacacctacaaagtccatccagataagacaaaattcacccaagttacagactctcctgttctgctacaagcccaagtcaattccaaacaactgagtgacgtaagttcctctaactactcaggacacccaattatgagggataacatttcataactctatacataaaatccaatgacttatcaagtttattcaaaaggctaagtaagtattagcaagtttaaacagtatacatttgtataaaaatatatttctgcattttcttgggtggataaaatttacagtgaaacaattctgtgaaggaaacaaatgtagcttaaagcaatggaaagaacatgagttctagagtcaaacaaaaccgcattcaaatgttagctctgtcattgatgtctgggtggccaaagatttaacccccctctgcctgatatttccattttataatttgtggctgttttgaagagtaagtgaaggaagaaatatgcactgcacataccctggccaacagcaggtattcagtacatgaatttctctctccctagtaagtttctggaaattggaatctctgagacaaattttattatatgagctttaagtgtggatttccaaagctgtgttgaactaaaaaaataaaagtgacctcaatagatgaatggccagaaatgaaggctccaattagagcatcaaaagccctgatgtctgtgagaggactcttaatcagatgaaaggaaagtggctctggtacgtgagcactgacagtgacaagagagacagggcggggcccctctcagaacctgcagggacaattgtgctacgcagggaggggaacatgtttgacagagccacctcattcccttagggtcctaccatggtgacagatgtgataatagctgccaagtgtcctgcacacaggwtcagtaatgcagatggcctacccaagctctagatgtctcttctgatctcaataatgctgtcactaactttacaaaatgtaccacacaagaatttttgtattctggaacaattcttctgaactaattggttctctctctgtcatagttaaattacaaagcaaaacatgaaagtgaaaagttcaagtgccatatcccccctgatactcctgcttttatccagcacaaagtcaatgcctataacttgagtgatgtaagttccttatgccctgtaccatgtgakgtactgacaacctgtgcttttatgtttgaactrctttgttgcaattcaatgaatagattaatgttaaaaatgagaagaactgttaacatttgtatcatgttgctatgcctctgccagtataactgaattcaccttacaaaatatgtgtagcaatcttataagtaatttcatacaattagataatcgtaatatatagtattgtaaccagccctcagaatgctacgtctcrtgtatgcttaattgcaaattttaatggtagatcttttagccatatattcatttaaattatatataattcatttattccctgggcctataatgtcccttatttcacacaaatgatacttatttctacatatatgagaacttgcatgaataaagatataggggattgaaagggcagaagtccagatacccatttctatccttcatttttcaaacttaattttatagaaaagttaaattatccttggggttctcaatttcttcaataattctataaatgagtactaagattatctggcatcactgagtattgtaatgatttatgaaataacctttgcagagaacttaaaggtcaaatgaaagtgatgcctttatatcataaaaaagtaagttaactgtagaatatatgtgctactctataaaacattcagtgttaggaatcaaatatgagtataatagctagaattaaattaatttgataaaaaattctcatggggagtagagaagcccaatcttggagaattaatagctccagcttgagaagaaatatttaaaatatgcatgatttcctagacaataaaaagggcccatttattttatattaagataaggtatttagttacccaytagtctttaaaggtcgtgacatgcatatcacttttgccaattcctttgctgaatttttttgtccagaatctttataagcaagactgggagaagagcaaagccaaaaagtttgacattaaagtggatgccattcccctgctggcagccaaagccaacaccaagaacaccagcgatgtgagtgtggcctggggacctggacaggctggcttcggggacatttcctcttgagtggaatctggcatgtgtgatgtctttgcaggtgatgtacaagaaagactatgaaaaaaacaaagggaaaatgattggagtcctcagcattaatgacgatcccaagatgctgcactccttgaaggtggccaaaaaccagagtgatgtgagtttctttgtaattcacccctattttcagacgtggccacaaagttgctgtttaatataaccttggatggacgttagcctaactgaaatcttggattcaagatgacraatcacacatgaaagcttcacccaggtgctaaaggaagatgaacttccttattcttgttgatgcctttgatgccagtgaatactgcaaattttccttaatctccttaatgccctctgttttattaggaggaaaaatattctgccaatatcattgtttttattatttttcctagaaacgagcttaatatacataagtataggtacatgtgcatgtatatattcacccaatgccctgaactgattaaggtagtttgcaaaaatatatatataggaaaatgaaaagaagtaaagaaattaatktaagggcaaagtaagaaaaactacataaggcataaactcaaaagcaaagcattttattttaagaaatttatagaatattgatcttattttaaagactttaacatacttattaaaaataaaatatgacccagcaatcccattactgggcatatacccaaaggaatataaatcattctattataaatatatatgaacacatatattcattgcagcactattcacaatagcaaagacaaggaatcaacaacgatagattgkataaagaaaatgtggtacagatagaccatggaatactgtgcagccataaaatggaatcagatcatgtcctttgcagggacatggatggagctggaagccattatcctcagcaaactaacgcaggaacagaaaatcaaatacctcatgttcttacttacaagtgggagttgaatgttgagaacacatggatacatggggggtgcaacacacactgttggaggctgggggtgggggaggcgggagaacatcaggaagaatagctaatggatactgggcttaattcctaggtgacaggatgatctgtgcagcaaaccaccatggcacacgcttccctatgtaacaaacccacaatcctgcacatgtacacctgaacttaaaataaaagttggaaatcaaacaaaaaaataaaaaataagataaaactcttcacagaaattgctttcctaattcctagcagaaaagaaatacagacaagtaatattttcatttattattgctctaaagaaaactgttaggtcttaatgttaatagccagcttccggaggtgttacaaaatgcgttttcaccaagtgctcaacagaatactcttccaggactgtgcttaattatctaaggttcaccttataccctttacctcattttgcatcaattcttaaactcatttttctttccttctttgttttttgagacaggctctcgctctgtcatccaggctggggtgcagtgtcacgatctcggctcactgtaatctctgcctcccaggttcaagcaattctcctgcctcagcctcccaagtagctgggattacagacatgtgccatcacgcccrgctaatttttgtattttyagtagagacggggttttaccacattggccaggctggtgttgaactcctggccttgagtgatctgcccaccttggcttcccaaagtgctgtgatgacaggtgtgagcccctgcacctagcgaaactcatttttctttaaacatattcaaatgaattactttaagacaaaaaattatttaaaaaaagacagcattggtgtgcgtttttcagtctgaaaaaatattaggaaaagtaacataaacatcttcatgattattagcagatgagattatataaggcatgagcctctaccacatctattctgcttttctgctttgtggaaaattgatggtgagaaaacataaattttgccccttcagttaaagtgcagcaaagacatgaatgacttttactttatgagatatatatttctttctttttggtttaatttatttttcctttaacagagattatacaaggaaaactatgagaagacaaaggcaaagagtatgaattactgtgagaccccaaaatatcaacttgatactcagctgaagaacttcagtgaggttcgaaaagccacggttacctttcgggtaggagggctttcctactgtttgacaaatgattgttaacttgaattacatttgttttatttttcaggctagatataaagacttatatgtaaaggatgttttgggacattatgtaggcagcatggaggacccatatcacacacactgcatgaaagttgcagctcaaaacagtgatgtaagtttgaagacaatggttcatgcctcacagtgacattgtttgagagccrtaacaatcatgatctatttttggtttttctcattatagaaaagttacaaagcagaatatgaagaagataaaggaaaatgctatttccctcagacaataacacaagaatatgaagcaatcaagaagctggaccagtgtaaagatgtaagttagctgccctgaattattgaaattgagcttgggattcctgtgacatctagtggtaaatttagcaggagtttacatgctaatatctagtgattagaaggagataattacattttacattttggttttggggtggaaccggggaacacaacaattatgttgaggaaggccatttgctacaaaatttcagatttttataaatcttaattttcattagtttatatctacmcgaatttggggcaaaagaaggacatgcagatttaagataagtgttcattatttaacaaattctatgtgagaagccatgctgggccaggcactttccttggtgctgagaaagacagagaaaaagccagccacctcttgagctcccactggagtggaggagacaagtaataaacaaaggaaggagcacagaaataagaaagatatcaagcaataataaggaaactaatacaggatgatgatacagaattaaaataggacaatgtgtgagacagtgactggatgggcgtcttaggttgggtggtcaaggaaggtctaaaacaggcatgaccagtcaggccaaggtcaggggaacagcagcagggaagaacggcctaaggagagaacaagctcagcatttaaggaattgaaaggatggggtggctgaaatttactggggaggaagacagtagtaagaggtgaaatggttggagatgaaggaggggatggattctgtagggatcataagccaacgtgcagttgaagctgagtaccaagttgactaaagagtcactgtgtaaggcttcagcagggtaaggttaatctggttgctgagttgctgtaggcagaccagaggcaacttgggaagtggggattaaaggaaaaagagagagagagagagagacagacagagaagtgagaatataaacgcatcaactaagttttcaggaacaaaataaactctgttttgacctggaaccattttttatgttagcgcatgtataaccaagaatatactgatatttcattaaagaacatcttcttttctagcatacctacaaagttcatccagataagaccaaattcacggcagtcactgattctcctgtactgttgcaagcccagctcaacacgaaacagcttagtgatgtaagtgctttgatttatgcaagcgtgggtgacccagagtgctttgctcatttaaaatgtaagcatttacatgcttaatcttcatgggctcatctaccatcccaatattattatttttcaagatttgtttaataaaacacaaatgaggctgctagattgaattgcagcctgaggaaagttgtgttagacaataataaaaataaatattttttaataactcactgatttttagtaggactatcttacttattcattaggatctgtcacatgcacactaaaacttcatgccaacttaaataaacagtgacaacaaaagcatctatttgtgtaggacaaggcaaatatttccgattcttgaatttgctaacaaagattttgcaaaaagaaagggcacagtaacaagacagacatcaaacagtgataagaaaactaatatagaatggtgctacagaattaaagtgggatgacatcaagaactggatgggcactttagattgagtggtcaaagaaagtctaagacaggcgtggtccagtcatgccaagatcgggggaaaacagcagtgcttctcagacctccacattcatgcaatcgcctgctgaccctgttgaagtgcagattctaattcagtagatctaggggactccatattctgactttctaataagctcctaggtgatgctgatgctgtgattggtaggctactctttgaacagcaaggtgctaacatagctaagtcctagagagtagtacatccttctcaagataggtaagtgaaagatacagtttgtcctactataaaatatattttaatgacacaaattagctcatacccaattagtaaagaggagaatggcatcagtataactcagaagtcatttcagctcgtgtgccacttttctgagcatcttaatattttgtgtcccaataaagaacagctaaacactaacatcactgatctagctgaactcagcaagctgcagagaaatacagtgctgtatgtggtcacagtcactatcaatcactcttcttattggcttaggtgggcaatggactctgccttggaattacttcttgcatagttctcaatcttgtgcrtttttgcctttggctccaaaattaaacagcctcatccgttctttacactcccttccttacacctaacgtcaccttttaaaaaatttaaataaagttctgtgtttaataatttaaataagaattcacaggcaggtgcagtggctcatgcctgtgatcccagcactttgggaggctgaggcaggcagatcagttgagcctaggagtttgaaactagcctgggcaacatggtaaaccccatctctacaaaaaaataaaaaaattagctgggtatggtggcacatgcctgtagtctcagctactgaggaggctgaggtgggaggatcacttgagcctgggaggcggaggttgcagtgagccgagattgtgtcactgtactccagcctgggtgatggagccagacacggtctcaaaaaaaaaaaaaaaaaaaaaaaagagtatatatctttttaactgtgctagtattttatttagaattattgttgtttttgttagtgctttaattacagaagttcgtgttctccagacacaacctagcagtatagactggaaatgtgttcctgtgtatataacagaatctatgcaatggcagctggcagcccaaagtatggttacacagcaatcccccttatccacggttttgctttccataatttcagttacctgcagtcaaccatggcctgaaaatatgaagtggaagattccagaaacaaacaattcataagtcttaaattgcatgttgttctgagtagcatgatgaaatctcacaccatccccctttgtcccttctttatcaagatgaagggtgaaaacatacagtaagatattttgagagacagaaaccacatccacataacttttattacagttttgttataatttttctatttattagttattgttgttaatctcttactgtgcctaatatataaattaaactttatcacaggtatatatgtataggaaagaacatggtatgtatagggttcagtgccatctatgatttcaggcagctactgggggtcttgaaaagtatcccccaaggacaaaggaggactgtgccacagtccctgaaataggggatgaaagtttgaatcctgtgcgagactttgactgaattgagtatctctttgaggcatttttctaaaaacagcactaatgccttagctatatatgctgccctaaataaattcaaagaagttcccctgaaccgttcaaatatcctttgtttttcagctgaattacaaagcaaaacatgaaggtgagaagttcaagtgccatataccagcagatgctccacagtttatccaacacagagtcaatgcctataatctgagtgatgtaagtaccaaagccacagaagcctatgtttggtgtacatgaaaagagaaaatgttttaaattttaaaagacaagacaaggaattgtgcaaataaacaactttaaratggttactttgtaagtggagcttttaaggccaaaatgctcttaagactcctacttatctatcagatttcattttctgtggtctctgttactatcagaagatctccaattacccgtctactattccctggagttttacaacatctttcccatgtaaatttcacatttcaccttctccaagtgagtgtcactttatagcatccttatgtaaatcaggacagcagagtgcttagaaagtttacagaacattaaaaagagtagttgatacttatttagtggtagggagaaagaaactggatgatagataaatcaatacttatactacaatttgataaatatagtttttataggagaaataagtctatacatacacaaattttcaatatgtttttatttttttactggattacactgttgttcttatcattcctttgctgaatttttcttgtccagaatgtttataagcaagactgggagaagagcaaagccaagaagtttgacattaaagtggacgccattcccctgttggcagccaaagccaacaccaagaacaccagcgatgtgagtgtggcctggggacctggggacctggacagggtggccttggggacatttcctggtgagtgggatctggcatgtgtgatgtctttgcaggtgatgtacaagaaagactatgaaaagagcaaagggaaaatgattggagccctcagcattaatgacgatccaaagatgctgcactccttgaagacagccaaaaaccagagtgatgtgagtgtctttgtgaatctgtcttgttttcaagatggactccctgttacgatgcccaagggtagtagtgtggaaaagaatttcatgagcatgggctctttcacatcacattcacaaaagtactgctgtagagaacttcagaatgatgccctggattattgtgcctcccacatttgaggggagaaattactgatttgtacttgatgtccatttcactttgaaaaatgtatgcattaatatttaatagaatattgattgtattcttaaaaccttttggaaaacatcactagatattttcatattttcttctaattgaaaaayaatttttaaaatgataattttcaaactgtctttactttggaagacatttatgagtcacaaaaatcttaatagagtatcgttcttcattgactttagtaatgagtttggtctagatccaagaaaaagactccattgattataaacccccctgagactctgataaaagatttgaatcatctatctagaaaatgaacatttcttttcatgccttttgcctgaattttggtgaactcatgggttgcttaaggctcatctatgggccatgtaacattttgcagttaaaattcttactacagagagacaaacatctactactgcaaattatagtatatattgtgtataaaatgtttagagaatcccttaagagtactgagaatgttcagtgtagcttgcagatactagtttttttaatgatgaaagagaagggtatttgtatcatttagatttaaccatgcttttatataatgatctatacatacctctttaattcattttgcatctattctgtcattacatagcactttaaaacttctaattctgtaattttctctagtaacttcacagtgaattatgtcagtatatagtgctcacttatattactatcttgttcactagttgagtcttttcaactcaagaaggatataactccccattgatagcatgtgtatttttatcttttgtttttattcctatcacagaacccagcagtaggcacataataaatgcctaataaatatttgttaattgattgatgtagatgaccaaaacacatagcaaatgagtcattctcacataatatccaggcaaaatgctaagctgcagacacagaatatgaatggctttttaaaaagaatcttttaaagccatttggatctttgacaacattttatatgtactggtatgtgtcagctggtgtgaacatgaacaaaacagtaacaacaatttcttcaaaaatacttccacacacctattgctgttgcaatattgctttatcagtttatttctaacgaagacaaactgttgttttcaatgttgttgcaaactatcacaaagtttgcatactttatttttataaaccagggtctcaattttatagttaaataataaatgtattcagtgaaaatgatcacccacaaaatatgagaaggaagatcaagttcccttagaaagccaaaagatcagatcatttgcaaaaggaattgttacagaagatttgtagtgcacatctgtacttgccagcttgggtcaccgtctctaacacatatgtgaccatgggaaactaggatgagtttagagttttctgaaaggcagtgggtcaamatttttctgtcaaagtaattggtgagtggatacaatgaagctgggaatttgacccaactagcaccttgtctaaccattccagaaaaccagacaatgaagggagtccttgaggcccagccaggacatttggtttataatgctgtacggaagggccaacgttattttaatggctcagtttctcaaacttttctcctgtgaagtcttttaactgctgcaatctgaagcttcttttaaattgttgccccaattgaacttgatatgaaaacaacctttgagattctcagtggggttatctcctgtcaataacaggttaaaaaaccagttgactatccattcaaaaatgactctatacagccaataaactaagtctacagccctgtgtatgaagtagtcattttattaaaatccaattgtcatatggttttcattacaattaaaaaatgcttctttactgaaaactcttcataggttaaattacatgaataatagtaacacttgttagtggtccttgagaaaccctggtttagaataaaatcattcctgttcctgactgaagcagaagctgtggcccgctgtctgctgtgacccagacagtttctcattgatttgagaaggtctgcccatgcgtgctttttgggggaatttcaatggtatgtaacatatgaacacatttttgggcaaaataactactcagatgtttgactctttctctaacttgtatttattgtttatgaaagatctctgtcttttctggaaatccatcgaggatttgtgataataaatgataatttcctattcacagcgcgaatatcgaaaagattatgaaaagtcaaaaactatctacacggcacctcttgatatgctccaagtcactcaagctaagaaatctcaggcaattgccagcgacgttgattataagcacatcttacacagttacagctacccccctgatagcatcaatgtggaccttgccaagaaggcatatgcgctgcagagcgatgtgagtaaccagggtttctgtagcccctcttttaaaaagatggaaactgaaatggactttgaagttgagtgaggtttttgcacttcttagaggtatctgcattgtcctatgtatgtaagcaaacgacccttgtggttctataagagcatgcccttcarggttaggaagaactgatctggcttgcaccctatcactgtttccctctgggaaatatrtcaaccttgctaagtttagagtcctcctctgtaaaatggaaataaatcaaaaacattgtttggaggatgtaaatgcatgcaaaatacttagcatggtgccaggccctggtgagttctcaataaacattcagtatttatcatcgctattatcataatcatcacattcatcattatcaatgatttttacatagattactatctgaaaagaaaatatatgatttaacataaatatttataacgkttttttctgcagatcagaacttctttaagcaaattcatttgtccaaaccacacaactgaatacttcatcctaacaattctattttttaaaatgtgacaaaatacatataacataaatttaccacctttgcaattttcaagtgtacagttcagtggtgttaagtatattaacattgttgtacaaccaatctgcagagccttttcatcttcccagactgaaattctgtattcattaaacagcaactcccattttccttcttcccctagcttgtggcaaccaccaatctacgctttgtttctaagtttgactaaccctagatacctcatatatgtaaagtcatacagtatttgtctctttgtgattggcttatttcacttagcaaaatgtcctcaaggtccacccatgttgtagcatgtatcagaatttccttcatttttaagggtgaataatattctattgtatcgatatgccatattttattcacccattcatctgttggtagacatttgggttgcttccacctttaagctattttgaataatgctgctatgaatatgggcatgtgaatatctctttgagatcctgctttcgattcttttgggtataaacccgaagttgaatagttggatcacatggtagctctattttttatttgtagaggaaccaccatactgttttctgcagcagctgcaaaattttacattcctaccactaacaattctatattatacattgttattctacttgttattagtttgattttgttatgttttttcatctcaaatagatcataagcctctgacaggcaggaactaaatgctttcttgattttccattctacttaaaatgcccagagtaaaaaacaacagtttgaattttgtatctaaaacgtaaatttttggtaccacctatggtcagacaayaagagtagcattttaatagcgtcaagtaactgtgcctcaactaggaccaattccaaataataaccgccctcttatgcaaattaacgagtgcaactgttttaaagtgttttgttagccaatgtagaaacactccaaagttgaccagtacacatgaagggccatgtgtgcaaatacttagtacgaatagttctattaagtcttatacaattaggaaattagaaaatgagcaaataacccaccttcaatgtggccttctattttaatttgatagaaacataatacttaaagttccagggaacaaacgtctcacatttggttaactgacaatttcacttactctttgaagtgcagctttgactcgarcattttccaggttggaattagagtaccacagacttccattaagttggaaataaggatgaaatggaacataacrccagttagaaggaaagcaaaaatcgaagagctgttactatatctcaccaaagaaatatataaaataaccttaatgtctggagtaaggaagctggtcagaaatctcaaaaacattgttttgggtaaaactttgatgattttacataatgaggatgacacagcaaagaaatgtaacctttctcttggtgttttaggttgaatacaaagctgactacaatagctggatgaaaggttgtggctgggtgccttttgggtccttagaaatggaaaaggcaaagcgagcttcagacatcctcaatgaggtaaagccactgggtgtgtcagagggagagtggtgactgtgttgtgttaaagctctcaaaagcatgggcagtgctccttcattgcttcattctcagtcactgttgctgaggaaaagagcttaccacgtgcacaaattacccagggagaccagcacaaacctttatattaccaaaatcatttatgttaaccattccttacagaaatatttttaacaattttattaaggtataacttgttaaccatttacgttaaccattcatttatgttagccattcattatagaaatatttttaacaattttattaaggtataacttgcatacaataaaagtaactcacattaagtgtacactttgacaagttttaataaattcatataattgtgcagtcatcactgcaattgaattttaaaatgctgcaataccccaaaaagtttccccccaaaatttcagctctcatcttcagccccaggcaaccactgatttgcattctgtctctaaagttttatcttttctagaaatttattttgtatctggcttctttcacttcatgtaatgtttctgcttgtaatttggtttttaaaaattattaagtaaatcttttgtatggatttattaggttggtacaaaagtaattgcagttttgacattaaaagtaatggcaagaaccacagttacttttgccccagcataatacacaccacattgttattattgcttcaccggttgggggatatgtggatggtttctatttttttgtgattatgaataatgcagttattatagaaatcgtctttgaagaattattccatatgtcatattctggttggctttgaagtaatgtataaattataattcagtgtaagaaaaaatagtgatgatcttgaggctcataaggcagcaagattatctgtccctcccctgtgacagttgaagagtctcactgctgtcaggtgagtacatcctcaaggagggcagactacacaaaggacagaggtgtggtatgagggttgtcttccacgctcaagttttacttcttgttcggtgttttgttttcgatgaaaaccattttgtctgctcaaagatcttccagaagaaagttctgggttagtggtttttagaagtctgaagccgaaagagtgatgatgctaactgggatgtacaacatgcacaaaggaagaggactgggaaaataaatagagacgcgtacaggaataaggtagctagaagttgccagctcctagtgggcacacctacccagggtctcctctgcagtgccccttcagcgttttggtgataacttacgtactaaccacattaagacttgcagagcaaaagtcctgtctctcttaataattcctagctgttggcctagttcctcaattcctccttcctcaaccggacagcttcttgatgccatttgctgatggagtaacagggaaaaagagaacttgtttgtgccatgcaaaggcactccaatctccttgcttgcttttctgttaaacctttagaaaactctgtgatgtttccagattctgcttagctgagggtgtcttgtttcatgtcataggcaagaaattaagaaaggagtctgtctggttcctgagagcagtatatgtgtctgtgctgtcccaaactatccacaattaaatggatttttaaagatattgacttttgtattgcattcatcaagccaatcaagaatctagtgtttttgcattttaaaatcatgaaaaactcttccttttcgcttcaaaataaatttcaaggattttgacgtattaatcttcagtggaaaacaagattgtttttctctttttgatttrccaaacagaaaaaatatcgccaacatccagacaccctcaagtttacctcgattgaagatgctccaattacagtacagtctaaaattaaccaggcccagaggagtgatgtaagtgttaatgctatctatatgttaatagatgttaactaatacaaatacatttgtatttcaaatgtactgatcacctctagttattatacaatatgaagagacccaattacacaagcatctgtagaattccccagctgttcattaataaagcatgcctaattcatatatttacagtaatgtatattgtgctgactgtccttttagccatttgacatttctttctaaggaaaaggtaagagggacttctcttaatgacaacaaaaactacaagcctttttctaggaaagaccagaaagaatgagtatatcaaatggggagcagttatattttaagtcagtgcaaaaaaaaaaaaatcatatataatcaaaaccatccctaagtccttttaattgcccacaaaatataatataggtggttggtgtattccaccctattacactttcctgagctaggcccagaggttcctactgcaagttccaagggatctttgcaaaactgaataagcactgagacagtatcctaagcaactgcatgtgtgaccttgaatgcctacagatatttgcacatgaatatgcaaatgcacaaagagtgtccttcctaaaaccacctctgtgaaatatgatccattaggaaatwattttctggtgccattaaattttctttctactttatttgtttgtttatgcatttttttctctttcagatcgcttacaaagccaaaggagaggaaattattcacaawtacaacctgccaccagacctgccccagttcatccaggctaaagttaatgcctacaatatcagtgaggtgcrtgggtggactcacgggctgatgcgtatgtccagactttactaacacagtctctaagttgtacttaaatgacatttttctttcagaatatgtacaaagcagacttgaaagacttgagcaagaagggatatgacctgagaactgatgcgmttcccatcagagctgccaaagctgccaggcaggcggcgagtgacgtaagtccagctgtggtcatacatgggcaactagaaaatgtgggtggrtgggcttggggtctgacgatgacccaaaagtctccatgcatgcagtccccaattggaagcaaatctgattgaaaactatttaggaaataaagttccctaaatagatttaaattttctggagggaaaagatttgtataaccttctactgatcagttctaatcaagccccctcatttaaaattctcatgtatagttctacactaactcacattacttctcttgtggagatccagaagtgacttaccatttaagtcataatagcctcctgatggtaaaatgttatctcaaaactttattaatttatatgatttccttcttcccctttcctctccctttttccttcgttacttctgtagacaggtgaataggcctcaatttcaccacctgtaatagccagtctttgggttctattacagttaagaattttatttcttatcctatttatctttaaccaagatgtgaactgaagtcattttgctctttgagatttaaataaaattggctcaagcccccatctgttattctatagggagtggaatccccctccccatgatttctgtggagtctccgaggtttttgtttctctgcttacctctggctcctggctggcttgagctcatctgcgccctcctcctgcgggtctcctcttgctgctctgtatgacccagaaatgaaacacagccccttccttttgacttcccagagtcccaaacaccactttactgattgtttgaaattaggtttacatcgcaccagtgtaaatatgtgatgattgaataacaaatgtcctcgttctgaaatgcccctgtcccacccgaagttctcacccaccccctttctctgtgggtactttcctccagctgcccctgccccaactttccacgaaccttccctcatgtctctgcttctcagtgtcccacagtgccctccacatatctctgaggaagctcagtccccctcactttgttatccagagccagttagtgtttaccccctcctggctctgggtctccctttgaatatccaaggacttattaaattctactatcattratattaacatcctaccactactactaaaaattctaaaactaattaaatatccagctacttgtactctagtagcacaatgtaattggtagagattgtgacatatttatcttttcatttttctctaccaatgtctaaatgcaaaggaagaatataaagatctgttttgtcactgatacaaattatggtaatgccccatctcaacctcacttggataggcagaaacagctatagacaatcaaatgggttccataatacataacatttttattttaagcaggctacatttcagagcatatgcaagtgaattgttaattgtttggttattgaagtacagtaatttttgggaagctcaattacttcaaatcatggcctcattgtttagtaaagccctcaaaactacattttaaattatgcccacctttgtttacaataggttcagtacaaaaaagactatgaaaaggctaaagggaaaatggttggcttccaaagtcttcaagatgaccctaaactggttcattatatgaacgtggccaagatacaatcagatcgggagtataaaaaagactatgagaagacaaagtccaaatacaacacgccccatgatatgttcaatgtcgtggcggctaagaaagcccaggatgtggtcagcaatgtcaactataagcattctctccatcattacacctacttgcctgacgccatggacctggagctgtctaagaacatgatgcagatacagagtgatgtaagtgtcatttacttctcaagaaacccccctattaagttcagagcctgccatgaaaagaaccctgtcctaggccctcactcctcttttctccattgctgtagaacgtctacaaggaagactacaacaactggatgaaaggcattggctggattcctattggcagtctcgacgtcgaaaaagttaaaaaggccggtgatgctctgaatgaaaagaagtacaggcaacatccagacaccctcaaatttaccagcattgtggactccccagttatggtccaggcaaaacagaacacgaagcaagtcagtgatgtgagtacaataaaatagagaggacagaggatatggaggaagctttttagaaaagtaaacagcagcccaatatattttttttctgggccaatatctttccattttaaattattttgtttatttaattttttaaaaattacagttatgtgtagtttgggcactaacattttcttctctcttgctttttatcttcctttttaaaaacttttcctttttaactgtctttgaaatattgtgttattgaataaacttgacatggtgaaaaaattctattctaggactacacacatacacatgcaaacacatacatacacagaatttaagcttaaatcccagacactttattgtggcagatttgttgtattcaattctatgttaagtttctcatattttcttttcatatataagacattaatacagagaagtaatacatatgaatatacgtttttgctcctaagaattcagcatacacaattatcacagagactttttaacttacatctgattgaggtgtgtatcgtttgcctgcctgtccatgagcagcgtctatgctctggctaaagtcaaagtttctaaaggaaagtttggtatacagaagatcaaaagcattcactcgtttatttatttaatgaatgctttttgaacatttaccatgtgccaggcactgtattacctgctgatggcataaagatgaaatagatgaggattcatgggatatagaaattcacaagaatgtagggtaagagcataagacaaagacatggctacaaacagagcattgtcatccagagagacaaatgccgcaggagaggaaaatgttaaatacaagggaggtgccttgtacacaggtaactgcctaccagagtttcccaggcaagtgagagaagtgagcattcctggcaaaaggaacaatataacagcagtagaaaaggaatgaacaatataacagcagtaggaaaggaatgaaaaagtgtaaaagcaaaaggttcaggattgtaacctgattagtaagggactcgtatgctaatttttagagtctggatattagggggtaggtaagaagagatgttgaatatgtttaatcgatggagccgcattatcaggcttgtgttttaaaagacaatgctggccccaagtgtggagactttggaaagaggagagactggaggtgagaagatgaattagaaggctgtcaccgaaatccaaggaaggcttaattggactgaagctaaggcagtagcaatggcagagaaggagctgtgtagaaggtcgaattcatgaatctgtcattgcttagatattgttcttaaaggcaatgaggacttagaggtaactctttgggtcctagaagaaattatttattatttggggattaatttagctattagccatgtcagattttatcttgggtacatgcataccagtttacatgtcatattccatatagtcatgccttggaaataaggatatatatgagaaatgagaattatgagattgaaaatctacttgtgattctggctctattttagttttaggaactaagtaatatatttctaataccaggaggaggatgcagtaagatttctgcatcacatactttgacatctttcagtcaaaagtgtatataattctttaaagtaacaacatagggcaaatatgaaatagtgagccttttgagtatgctagattcatgtataagcacctctacattatgaggaaattattgtatgctttcactgatacaattataatttggaaagtttttagcagaagtgaaaaacttattctmwctagggmtaatactttctctctagggataaaaaaatagaaactaacaaaaatggaagagctattaactcacaggcaaataataaattgatttggctttggtgaattctattattcttgctagggtttcatggttgaatttaccttccattcatcttgggcagtgaacaatttctattttcttaaggattttttctccttctattttaacacacaagacttgttggtattaaagataataagatgcttgttttatttaaaaaaataggaaaatkcctttgatgatttttaacactagaaaatcatgggtgattgtgctaaaaataactctttaaagcaaacaattaatagattttcctttttgcactatgtgaaatgcattttattgcagatcttatacaaggctaaaggagaagatgtgaaacataaatacaccatgagtmctgatcttcctcagtttctccaggccaagtgcaatgcttacaatataagtgacgtaagtagggtctttgctgkgatgtgaaattcggacctgacaataaaattatagactttaagagtaggatggtgccttgacaatttatttaggcccatttctcacaaatcccctactggaacatatcccataaggatggttctttacctcttcagttggccttttcaaatgtaggacaattttaaaggacataacattcttctctatttaggggatggtagagctcaccatctattcccctaaaacttctacttggttttcctagttttgcatgtgggggaggttattatcctccagaaacataagaataaatgagctcccttttaaaataacaacsctaaaatttctaaagctgaccaccaggtcttctcttgacattcctttcatgagaatgaacaacttcattgtctctagttggtcctcacataccatggtttccagaacctttatttgtttttctctggatccagtctttcaatattcctctcttcaatatgtgtcaaaaccagatgtaggtgaataattagtgcagagtccaatgatctcatgctacacacagtgtgacactttgccaatgtgatttcctaaagcagtatgtgctatgagggattccttcaacttctgtctggaaaagaacaaaacaatcccagcagttgaggaatcacttacagatgctgacattctgtttgcttttctgtccaggtctgttataaacgggattggyatgacttaatagccaagggcaacaatgtgctgggcgatgctattcccatcactgcagccaaggcatcgagaaacattgccagtgatgtgagtacaaattttaggtgaagtttaggtgtttgcctttttgaaaagtaatcaaatgcttgtttaaattgataccttattgaaagaaatatgttaaattaatggcatttaaattctcaaaatattgtttggaaaaacctgtcacttttagaaacatttttgtggttcttttcagttgaccccacttggtagagctgtcataaatctgacagtggctttctcctttgattcatagcccaaattaccttcactgacacatttccctgacagcccacatttattttcagtgggaacaccctgactgacattaccacattaaattcaaatgactgcctgcattataattgtattaaaaagattgaaaagatgttatataaaatgtacagatttttataaaccaaagagggaaaagtccacttttttaggatataattttgattcatgtaaattgatgtccatttcctgtaacagaaaaagtatacacttctactcctttccatctttgaaaaacaaaattttggccgggcatggtggctcacgcctggccaaaatttcagaagagcggatcacgaggtcaggagatcgaatggtggcgggcacctgtagtcccagctgctagggaggctgaggcccgagaatggcgtgaacccgggaggcggagcttgcagtgagccgagattgcgccactgcactccagcctgggcgacagagggagactccatctcaaaaaaaaaaaaaaaaaagaaaaagaaaaatttttagaaagcatgcatgccctgcagagttcactgttacatgctatcccagggaataaaatcttggtttgagaaaagagaagaaagaaaccaaccaggtatacagaccacataggaaatagaggtgtaaaaactctgctactttccttgtaggaatgatactgaaaacatcttcctcggaggtctgcacacaatgcacatcactatgaaatacatttctagtctaagtagaaagtgaaagtctacagtataactttattctttttttttctttttttttttttagcacttacacagtgatttttcacatgttagaaattacttgacgatccttttgcctgctaaactcttatttatgaattaaggcttaaatagcaggagctgaaagtctgcagggtttaagtggatttgaattctcttgcataacagttgaggttctgacctgttacaagattgctccaatttatatcacattgctgattccagcagtgagagactttggacagcagaactttttccattaggtttttattgatgggaaaaccccacagcaggtccttactgtggctccttaatttatttgcagctgtttcagcagtgagcttggaaagcagctgctgataaaaggagtcagtgaaggcccagctatcctatagctggtactcatatttgtgatgtaaataacatattaaatcgaaacctatgaaaccctatgaaaccaagagatattggccttatatttagaatgtgtcatgttcatattaagtgtgaaaattcagtttgtttaaaataaagttccacatgcaaattatctgtaggagtcatagcaaagaaaataaactgatcttgaatttatcgtgacactcacttgtaactccaatatatgttttcactgaactttttggagggggttgtggtttgcattttttgtacactcttgagaaagtcacaaagctctgagtgtctttatatgtgaatgtaattgcagcgctaatgctatcaatgcctaggactttgctaacccaattctgcctccacagtataaatacaaggaagcttatgagaagtcaaagggaaagcatgtgggtttcagaagcctccaggatgatcccaagctggtccactatatgaatgtggcaaagctgcagtctgatcgtgaatacaagaagaactatgagaacaccaaaaccagctaccatacccctggggacatggttagcatcacagctgcaaagatggcccaggatgtcgctaccaatgtcaactacaaacarccattgcatcattacacatacctacctgacgccatgagtcttgagcatacsaggaatgtcaatcaaattcagagtgatgtaagtatgtgtaacaacagacccagagatgtttgcacttaaaggatgatcacttctcgcttttattagacttcatactacagtcagctatttgacaaatgcactttagaataaacaaccattactgaaagactaccaaaggcatggtagacaagctgtttttgcctgctttctgtgcttatatcrtaattattgatgctgtctttattaacttatggataaaagataaaactatattccactaactatgagagccactttgattcacagcaagaggagatgggtattcctgatgggttggctgcaatggtgatagatacaaaatgcaaaaatagaagaattttctatccttcctgaatttgggaaaggtgttttttttttttcctttattaactcaaggtcacaatgtcatccatgtaaatctctgtaatgagtcatctaaaattaaccaggaaggttttgtgcttgcaacatgattcatggagagttgcatggaaaggtgtttaacattcagagcctctcctgctgcaggagccagatttctgttagaattgtcctctgtaaaggaaagaagtgttatacatttattggcactcgataaaaatattgctccccagatgagctcaagcatagcctaggtggacagtatggatgtaatttagttttgaagtcttcagtggaatcaaaaggaaagcccaatttattgtcaaaagtgacaaaatsctttttagcagcacccatagtgacctggattcccctctgtgttgcataatgcagtctaaagcatgatcatttctattttattaggcttcataatacagtaagtgacttgaaaaaaaatgctttaagataaacaaccattatagaaagtaccaatttattgtcaaaagtgacaaaattttttttagcagtacccatgaaaatatgtgacctagattcccttctgtgttgtataatgcactctaacaacagaacagcttcttcttattaccacactccagataagctctgtgacagacagtcagacatgagcatgctgaagagttgctattcatttcccttggatagaattgcagatcccagaaacatcccttgaatattctccagggtatcttctcatattagcttacccttttacagaatgtgtataaagacgagtataacagcttcttgaagggcatcggatggatccctattggttccctggaggtggagaaggtcaagaaagcaggcgatgcattaaatgasaggaagtatcgacagcacccagataccrtcaagttcacaagtgtgcctgattccatgggcatgrtgttggctcagcataacacaaagcagctaagtgatgtgagtgctttcctttcaaaatgatttgcccgtaaataaccacacgtgtctgagccgctcctccgtccttcttaattcaatgtgtgaggatgcatctatgttagcaaataaactgctttcataggtatgagagaaagggctgccttttgaggcaactgggatcttgaacatgggaaaaacagggagatgaaaatgggggactattccaaatttgctttgttttccaaatgtagagagcctgtgctattcataagcagatacgcattatacatatgaaataacattattactatcattatctgtggctctgtatgaattgcaaaacaagctatttattgctcttggttgcaatatttctacctagccacatagggaagaggcataatgtcctaatcccctcgcataatagctccatgttctgagaggcaatcttagaatgaggcctctagggaggagataagcagtttatttgcagtcatctgggatctcattctgagaccacgtctgtatggactcttacaccgtggactcataccacgtctgtatgtctcattctgagacacgtctgtatgtctcattctgagacacgtctgtatggactcttattctttctgtcagaagcgaattacaatgctcagggcctcacatgacttgttaattttagagttctgttaaaatgcctccaccagaaagagacgggtaagtaaaaagcaaagaaagactttttgtattttagccccagattttggaaggtggggaaatgctttgcttgccttggatttgaagatctatggattttagctcctgcccccacattatcacagatgtctaagggttaattctatcttaggagtaataactggtgtcaattctttttcttttgtactgagcgagatgtcacttctcatggtgtttttccagttagctaggcaaactgtacactcactatataaagtcttccacatcacaataaatgccatcaacatctacctcgttactcaagctggaaacttggcagtcacggttaacacctccctgtgtgaactcccacatgcagtacctctgctgagtcagcttcctaaatatctctcagccagtctgctctcaaatgccaccaaccctacttccagcttctgtatggctcgtgtggacaactgcaataacctgttatctggactccctgcctgaggtctcaaacaatcgcaagagcctgtcttaaaacacgaatcaaatcatgtccctcttatgtgtaaaacctcttaggaatttcttgaatgtgaagtgaaatctaaactcatcaacttgacaaaagaccctcttctctgtggcccttctgcaccttctgtctaatactgctccacccccacgtctacccaggcacattccagccctgtgacttggactgctttcatttcctcaaggtggccaggccatttccagcctcaggtcccgaaygctcttcctctgcccctctctccaagtttgagygtaaatgttacctctgcagagtggctttactgaccatccttgtttctttgctacaatgattccattgacaacacatcacaaattctagtgatagtttgtagtttacatgttttatgtctgtcctttctattggacagtaagctccaacaggacagatatgccttcctcacctctttaaacacagaacttaccaccctgcctggcccacagtgctgtccaataaatactggtagaatgggaacataaatgcatctaccagggcccctcccttatgacagagtaggtatttgtctcgtaawtggaaaacacaaatgatagccttccgttttaaaggagtctctgcttgatgaaatttatattatgtcagctaatgatatgtgcatgctgtctcctttgtttttagttgaactacaaggtagagggagagaaactgaagcacaagtatactattgaccctgaattgcctcagtttattcaagccaaagtcaacgccctcaacatgagtgatgtgagtatttggcccagtgctaatattgcgtatgcgggcctctcctttctggttctttgcaactcttgcyctgagaattgtagggggcgcaattcagtgtggaccctgagcctccacattaaacccttaaccatgcaacatgagcctagggggcggcaataaaattttgcttaatacaggcttttccagactatgggctgtggcttattagtgggttgtaaagtcagtcaagtaagttgtgtcccatttaaaaaaaaaatggaacatgagacagacaagattggaaaacacaagagtgcctagtctgtagtatggaaaacattgctttttacaacttttaattatttattaaaacatccaaaaaagtttagttttcttcacaaaatctttttttgtatgtaactagcctttctcttgagtggtctagacatctaattggtggtaatgtttaaatccactattatgaattgtttccttttttaaaaaaaggatattgataaatcctaatttaaaaacataataaaacttggataaaattgttaattttttaaaagatggcttattcattctttccaatgtttttaggctctgtttcatatccaactatacattcctgtgcttttgtttcattaaggggaaagatttttctaagtaatatttaagcattaagatcaattaaagctgagttgtactacatctggatttttagttttagtattcatatcttcctataagcttgaaatgcttcattacaagaaaygtttttccaaaagtattatatatttattatagaaaagttggaaaatatagaaaattatgacaaataaatgaaaaccttctgttatccaacagtcaaagcattacctttctgttgctttgttatgcaagcatatacattttttgatcagttgagattatactgtgtatacagtttactgatccttttaaataaaatcaattatatacataaaagacaaactaatagtcctaacttcatagattgtcttaatagaaagggatctattacgacatgttttataagaaacattttggcattctgtttcattcctcttttaatgatgtcaaataataaaataacctctacttttttgaaggctcattataaagcagattggaagaaaaccattgccaagggctatgatttgagaccagatgccatcccaattgttgctgcaaaaagttcaaggaatattgctagtgatgtaagtctaacttaaaagtaggaaactttctatctaaaagacttcaggagttcaagaccagcctgggcaacatagcaagaccctgtctctacagaaataaaaaaaaaaattagccagatgtggtggcgtgtacctgtagttccaactatttgagaggctgagatgggaggatctctttaacccaggagtttgaagctgcagtgagctgtgattgcactccagcctgggtgatagagtgagatcccatctctaaaaaagaaaaaaaaatctatatgtgatgtataagattgtatcaactacataaagaagcaagtaaagaaattataatataaaaatatttcctaaaatcctaattgccaattacgttatttatattgcctcacttaaaatatttttcacatatttaaaagcttaataaagttgttagaagaaaattcttttttaaaaactgtgacgtacttaaaactttcattagtatcattgttatgaacttaaaaaccactttttatttggattttgtcatgaaaaaagtcatgatatactaaaatatcactaaattagaaaagtctccaagtattttaaaataattcagtgttttaattttataatttccatgaagaaaaaaaatccatggaaatagaaatatggaaaaccagaaaaaatattttgctgattctttctggtttttcgtatttctatttccatggattatataacaggattttagttaattacataacaggattttagttaatttttttttttacaaattaagttatattcctatatgaattgacataataaatgccttgatagagaaaaaaggcattaatttcaagattaatacactaatttgtattagggctgaaatttactcatacaaatacgttttaaggtaatacaaattaataatggaaatatagtcataaaaaagcatacattgaccagacatggtggctcacacgtctaatcctagcactttgggaagctgaggagggagggccccagaggctgcagggagtcatgactgcaccattgcactctagcctgggggacagagcaagaccctgtctcaacaaaaaaaccaaaaaacaaaaaaagcgtacatcaaatgcttcataagccaacttctcaggaacctttgagtatattcaaataatctacttatgaagagtattaatataaactattccattattccatttttaatgatctccagggcaggtctcaagatgagccattaaaaatattttgctaattgtttattttaaaatacaaaaaaaaacttygatgttacctagattcagactgaagttggcttttgcttaatttgttgtataaattcagtttatatcagacttctatgctagccaacttctgtttgccctttgttttcaaatagtgcaaatataaggaggcctacgagaaagccaaaggcaagcaagttggatttctcagtcttcaggatgatcctaaactggttcactacatgaatgtggccaaaatccagtctgatcgtgagtacaaaaagggctatgaagccagcaagaccaagtaccacacacctctggatatggtcagtgtgacagctgcaaagaaatctcaggaggttgccaccaacgccaactacagacagtcataccaccactacactctcctgcccgatgccttgaatgtggagcactccaggaatgccatgcagattcagagtgatgtatgtactggttaccaagttgttatccatttctaatgggtgggaggraaaaacaggagccacttactccatcccacacctggctgcactcactgtaattaaggattccctccagaactcagagttttaggatttcactcatttgaactataggtggctttgttgttaattttatatatatgcatacaaatatatttaaaatgttggtattagacccaaacatatgatgttgtctatgaaaaattaggaggctcagatagatgttatataattttccttccagtgcaaaattctgttaatttttcatttattttcctcaagaaagttaacttgttaaaggaattgctgggtcaggatttcctgttcaaaaccactatgaatgcaattatttttataattaatttcttctgaaagactgtagggagtaaaaagcagattattctccccctcccagcttctctttttctttttgattgtaagtaaatcayatagccaaagaaacacaagccctgactctttctgaaatgaaattttttttctcattgtaaagaatctgtacaaatctgacttcaccaattggatgaaagggatcggctgggtgcccatagagtccctggaggtggagaaggcaaagaaagcaggagagattcttagtgagaagaagtatcgccagcaccccgagaagctgaagttcacttaygccatggacacaatggaacaggcacttaacaagagtaacaaactgaacatggacaaggtaaggactcacctgccagcctcgcccagggaaccctcatggtgttcatgacattgagcctggcagtgccccaatcgtctcctacagtgtttctttctgatcgtcttcgtgccggtggtgggagggggactctattgcttccattatgtttagagcgttctctttcatagtgacccctcagatcatctctcaacagcatgttaagaatgtgacagaaccacaaaactccacatggttgtgcggtgggggcaagatggtatttggtgctttggtggtagagggttgccgtattcaacaatttttttctyattgtgtatttagtttacttggcccatctttttgttatttcatccattttctaatatccatttaacctcttttaccatggagttgtaaatctcttcctcttgctagcattgggtcaaacttgtcctgctgtaaaatcatgcacctgactttctcattgcagaggctctacactgaaaaatggaacaaggacaagaccaccattcatgtcatgcctgacacaccggatattttactctccagagtaaaccaaatcaccatgagtgatgtaagtaggttaacaacagcaaaagctggggagaaggttaaagggaactgatacttatgtctgcattctacataccaaccactttgtagtcaggacctctattctaaccccaataacaagatgctgttgtttttctattttattgtttagaaactgtacaaagctggctgggaagargaaaagaagaaaggatatgacctgaggcctgatgccattgcaataaaggctgcaagagcctctagagacattgccagtgatgtaagtgcttgcactgggcctttttggggttgagcaagtaagaacaaatgcgctaagcttgtgtgtatgtaggagcagtggtcagctccattcagggttggtgggaatgccatcccatgtgacacaagacacctcccttcaccccatccaagtaccctctaatcatctgttcattatttaatgtaagtagtgactgagtcttgttaaaataagtagcctttagagtctattcaaatcacttacaatcctaagcaaatgtaaagatgcaatctacrtgttttaccaggaggcccatggccaggccctctctttaaagatgcaccatgagaaatcctgcctgcagccttttctgtcacttagacaactgagtggggaaatctgctttctaaatctctctaaaccaatttatttacacatctcttcgattaactctgagattattttctttccatggactcaagtctsgggaaaaaaaaaatgaagtaaaaagagtttgctccctccctctcacgagtgcctcccttccaattttagagtagctctaaaacccttcatctaagacaaagctcacatcacctagcaaatggtactttgttctcttttaccattttcatcaccataatttcttctctgtccacagtacaaatacaagaaagcctatgaacaagccaaagggaaacacattgscttccggagcctggaagatgaccccaagctggtgcacttcatgcaagtggccaagatgcagtcagaccgggaatacaagaagggatatgagaaatccaagacctccttccacaccccggtggacatgctcagtgtggtggcagccaagaagtctcaggaagtggccaccaatgccaactacaggaacgtgatccatacctacaacatgcttccygatgccatgagctttgaattggccaaaaatatgatgcagattcaaagtgatgtacgtgaaaaccacatttgcagagcgtttactcyggataataagcaaccatgagtgaccataagcaatgacgttttgaaaatcctgaaagaaattcatctgcaatttcccaacatagtgtttcatttgttaccttagattgaattcatgtcctttaacaaaaggagatcaattctagaaactaaagtcttgttttctactattgttgctgggagcattgttggattctgaattccacaacagcaaatggaacttcatttcagaaagagtgtattgaaagraatatgtctagcaaagatggtcaaaagcataataggcttttaatagaggaataaaagggaaagtaagaaatcagataacctgatagctccagcccctccctcccaaccgggtttcattctaccacttctaactttgcaattgcctgccttactaatgaaattttgagaaggtgatgactgaggcagcctttagactaaatataaggaagacagagaaagaatagagccaagaatttagctaaagagtccatttgatggttggagaggtgaattaagttacaaacccaaagcagacgaaagcaaggctacatttctctttgggaatgtgagggctgagctattaattgtcagggaggtagtaagtgcctgaatgaaagcagccatggcacaggtgtagagagaaatgtcaaagctgaggaggaaaaaatgaaatttacacaaagtaccaggaaggtttctggcatacctgagggaattgtaatggtggtggttgatcaaagacagtgaaagagaaaaatggggtttccatagtcatctgttaaccaaggggacttgggaatttttataagaaaggtcagcatagttgcttttctcaaggagataacagtcacctgggagatgaatctatgtggtatttcttagtactttttctttatgaaggcattgagaaaaacaagtcacaaagacatttctgcttatttttaatttatcatgcaaggaaatataaaaaggataaaagtttagggaagaaatggttgaagttcaacatgctattggttaaataccaatattcaagcaaatattgaagtggaaaagttacagaaaatttacaaatgaaatggaagttacagaatgttaaacacacacttaggattcttgggaagttccagtttcttctcataatttaatttttcctcttttgcagaatcagtacaaggctgactatgctgacttcatgaagggcattggatggctccctctgggctccctggaagcagagaaaaacaagaaagccatggagattattagtgaaaagaagtaccgccagcacccagacactttgaagyattccacactcatggactcgatgaacatggttttggcccagaataatgcaaaaattatgaacgaagtaagtctttcaataatgcagtgtttcatatgcatcagagagaatccaggtataatttacatttaatccacaggttttgctaatacagttatagggcatcacacttgaggttattttacctagaaaaagagtccttgtcgttaaaaaaaaaaagaataggaattatttctaannnnnnnnnnnnnnnnnnnnaaaaaaaaaagaataggaattatttctaactagtagtcttcaaatcttcaatgaaccatcctatctcattgacataaccaaataaatagggacttttttcttttactgcacctcttgaaaatgagtcctgtttgtctaaggtgaggttgaatagacattcatgacactgaatcagcagatttcctgatggtagctggtgttggaaaccacctcccaaaccccagcttgctttctgctttgatgggatcaaagaaaagtccaagattacatgcctgtagcagcatttcaaaccaggacgttctctgggtaatcttgagggcagttgttctacatcagtgtttccttggttcatgaattattccagcttttagaaaagacttactctatttttacattgatttgcaataagagatcaagaccaacaagtacaatcaaccttgaacatctgtttttgaagttaaaagtaataaaataactgcagcagcactggtggatcaaaatgagaaatgcctttgataacagagaaaaggatgatttggatctaaacgtgaaacagttgcagaaaataatggccatagttgtgctagaaagatagaactgtattatgctaagccacggagcaaaccccctggagtcttcagagaattgaatgatttgtggagctcaacctccttgaaagggacctgcctcaaagacaaggcacaaatttctgtgcctcttttaagatttaaatctaaactacatgaggatatctatttttttcagtgttagtgattaacatttcaggataatgatgccaagaggagaatcatagaactagcacgtactggcaccaagagacatcttgatgaccatcaagttgaatcctcccattgcagagttgagaaaagaacagcccagagaagcaaagcacctcccacacagcgggtcaacagcagggtctggactagaacagggattctgataactagtcaccactctttccactagcatttcactgtccaatactattactactagccacatgtgttgatttatatttacataaatcatattaataattcagtttctcattcacattagctacatttcaagtactcaatcggcctatgtggctaggttctaccatattggattatgcagaacatttccatcattacagaaagttctattgtatagtgctggtctaaaacagagttcagaaaaatgactgtttttgtaaataaagttttatagtgacacaaccacagctgtttgttggcgtgtggtctctggctgcttttggactacaacagcagagttgagtagctaatgacagcaattgtttagcccacaaagcctgaaatttaaggaatttctgtctatacagaaaaagtttgccaatctctagtccagaaaaaggttattcttattttaattaagatgggctaaaacaaagagatagcatttatcatctattgcatttgcaaatattaaatagctgtgttacatgcaatatctgtaagggagtttctgttaaagcaaacttttaatgggccatttgttaatgttcgttaaaatttaaaactcaggtatcattaccctatagaaatccttatatatgtgtgcaaagatatacatacatacatacatacacacaagaatatgttttgcagtttagggtttctgaaaggagaygctaagatgaaaattggagtacagagtattttttagggatcctagtctttgggaagaaggactaggccggaggagaagttgaacagtgatgctggcatgacaaagtcttggccagtcccacagagggctctcaagtgtctctgtcagtagagacctgcactgaactgaaatggctagatctttgtacccccacttcgatgagttgttgaatgtggttatctgggaagggcatactcttgagtgagacagctggtgactggagactatttgccaaaagttggggaatcaggtccttccttgaatgagtatattggtggcacatctccatgtccaccacaaggatcatgacattgcttgtagcagaaaaaggctagaggccataagttaaatattcatcaccagagaactgattaaattaattagattatacctcctaatgaaatactacgtagctctaaaaatgaatgaagtaaattattttaagaaggttcaaatatgtctaacctatattattaagttaaaaatcaagatgtagaacatgacttcatgtatatttaaaaaggactatatgtctgttttaatttacacagaaaattttaggaggcaaatgctaccttcatgctgtaagataaggggaaaaaacatttttactttccatcttacatcctccctgctgtattgtttgaataagcaacttttccattaaaatttttttgggccaggtgcagtggctcatgcctgtaatactagcactttggaaggtgaaggcaggtggattgcttgagctcaggagtttgaaaccagcctgggcaacatggcaaaaacccatctctacaaaaaatacaaaaattagccaggcatggtagtgcatgcctgtagtcccagctactcaggaggctgaggtgggaggatggattgtttgagcctgggaggtggaggttgcagtgagccataattgcactactgcactccagcctgggtgacagcgcaagactctgtctcaaaaataataaataaataaattaattaatttaaacctagctaataaaaatacatgaaatattgatatatatgtacaatgatatgtatgtactaagtgagcttcttttaagattttaaacactaatttacactgtttttttcctagcatctctacaaacaagcatgggaggctgacaaaaccaaagtccacatcatgcctgatatcccccagattattttggcaaaggcaaatgcaattaatatgagtgatgtaagtatagttccccctgttgtcatctttctctccagcagatttgaaccagtaagaacaaattaattaatatctctctcagttatgagagtgaatgttttaaaaataatggtggaaatccacacatgagactctttctaattttgctttgcggagttggagtaggactgtggatggggttgggccaagcagttaagaatttgaacggtgtgattggattttgttctaggggggcactccttattaaattgagagatttggtagaaagaaacaggctccggggccaggagaagagaaaaaggaaatgagagtcctagaatttcgttcttagacagcccttccatcaagcctttgagatggttctaaagaaggggttaaatggaaagggaagaagaacattttgaagaatctggggcaaaaccccaaaacaaagaatgtgcaaatgtattgatattttatttcatttcctttttcatcctaatcatagttgctaggaaatcctctaatcctatttttatcatttctttgtttgaattccacagagatttggaatagctgacctttttttttaattgtagattccacattattatacaaataaaagtgctgattctaaaacagagatgttttcttttgatgtaagaataaggctgttttgtagtcttcctttaactcttatttgcatcaataagaatctctgggactttcacattttttaaagtatatttacaacctaatagagaccagtaacttttactttttctggtattttcttgaaaatatgtttaagtttgttatagattgtttttcaaacacagttatgttrcttgtaagaacattcagccactgaagcaccaacgaagcattctgctcaaaaacaaaaaaaaagacgccacagtggtagtttactcttctaaaataaatccaggctttcatatttagaagaaaactcttccctttgcctctctttacagaaactctacaaactttccttggaagagtctaaaaagaaaggctatgatctcagacctgatgcaattcctatcaaagctgccaaggcttccagagatattgcaagtgatgtaagtccaaaggaaacggtcacctggctgggggtttctaaggaaccgaaataataagggctgagttctggaaacactgagtggacacaatatgaaaaacagtgggtctcactctctgtgaatgcttcttaaccttgcttttgtgttttctctgatatttctgaaaaaacaccaagctaaccacatggtgaccctcatagatgtcagctccctgactcatgagatctagataaacttactttgaatctgtcaccaaggctatggcttatagaaattcaaagcccttcactaagctttcttggtgaaagtcttgtgttgttcttgcctcctgcttcttcggatctgattttctaacaggatgtctcatgtatgcaagggtgctgatcatttgggctcatgatagttgatgagtaaataatcaggaatttttgcaaaccagttgttaaactatcggtggcttgatatcagctgtgacgggcatatttacaccacagaaattggcaaacactacaaagtgaggctttccctgcgctggccggcaaaaaagcaggtgtaccaacacatcactgtcatgacatgccacctatatgaaactcaattctttcatttggttgtttccacaagaaatccactcacagggaacatttaatgacttggaggtcctgggaggagcatatttcaaaacaatctctccttggtcacccatcagttttactttctctcccatctctrttcttcatcttccctacctatccagcccatcccattctctcttattatcctgagaactccaaattcttctcccctctattacgctggagtaatttggctctactagcttctacccccaacttgcacacgcaaccccaaaaggagacaggcagaaaaagaagctctccatggatcaagatctcccctctgtagaagaaagttgggatgataaatagtacaatttcttccccattatagcagtttagagagtcttaaaggaaaaggagctccacgaatataaagctattctaaaattacactgtgtgtctcataattgaaacttttctcatcagtaaatgactgacagaataatttctcagggcagcattaagagaaatgttctgtttttttgcctttttttttttcatcttctgtgttctttttacctactaaaggcctctttagcactaacagcaaagtacatgcataagtcagtgtgatgcatcatcacaaaatctgggttctaatcctcagtggcctcagcaggttgctcagctctctgggtctcagcttattcatctrtaaaatgaggagagtaataagaacttttctatctacctcacaagggagagttgtattcagttacatcaataaatatgaaaaattagtckgaactatagagctctatacaaatataatttttaattatattttataattatacaaaaataatatagcatattgacactagatcgatttttagtcaaaggaattgctctgtgtaaaaactcawattttcttcacagtataaatacaagtacaattatgaaaaagggaaggggaaaatggttggtttccgcagtctcgaggatgatcccaaattagtccattccatgcaagtggctaagatgcaatctgatcgggagtacaagaaaaactatgagaacacaaagaccagctaccacacccctgccgacatgctcagtgtcacggctgcaaaggatgcccaagccaacatcaccaacactaactacaagcacctgattcacaagtacatcctccttccagatgcaatgaacattgagctgaccaggaatatgaatcgcatacagagtgatgtaaggctttcttctacttgggtgatggttggaatcctagcatgggaagggagatcacagtctgtttacatgccatggtttgtgtctaaatggataagataaagtagaatttgcttatcttctttatagaatgaatataagcaagattacaatgaatggtacaaagggcttggctggagtccagcaggttctctggaagtggagaaggccaagaaagcaactgaatatgccagtgatcagaaataccgccagcacccgagcaacttccagtttaagaagctgactgattccatggacatggtgcttgccaagcagaatgcacataccatgaacaaggtacagagaacagtggccgtccacacagctcccacgtgaggaaaggctagcaggctctggttcttgtttggagaaatctaattaaggtccatcattcctaggctgtggcaaaccattccagatcattcccctacaccatcttcttctgcccatctcttattttttttcttctcttgaccttctagttgggttagaaattatttatgtttttaattattatatcttcaatactttcagtccattgtagaaaatagaaaatacttaaaagattttttttttaaatctgagtttgtttttagggtcttttctgaattatatgctacttagttattacttactacatcaaattgagtgcattcaagtactaatatataaatacatatttttctttcctgcttgtcccagttattcaaatttcatgtctttttttcccacttcctagcatttatacaccattgattggaataaagataagaccaagattcatgtgatgcctgatacaccagatattttacaagccaagcagaatcaaacactgtatagtcaggtaaakttatataaaaattaattttaagttttgtattgaaacttatgaacttataaaataatgtaacagtaaatactgatataaatgttgaagcaatggaagtttggaaatgacacactgattagcccaggatgttgcaaaatagagtgcttaagagcaaaggcttcagccacaactgtatgctttgtggagcaggttctgtgtctgtttatctctgtgttcattgtgcttgataccaagcaggaaatcaatagaaaattgttgaaaawaaattgcatcaaacagccaggtgtgatgacatgcacctgtagtcccagctactcaggaagctgargcaggaggatcccttgagctctgaagtttgaatccagtttgggcaacattgggagaccctgtctctaataaataaatacataaataaagtaaaaattgcatcaaacagacttggtatgagttttggctttgccatttttgagatgtatagtactgggtaactcaattacctatctaagtctcactttcctcatccctaaaattgggaccataaaagtgcctatgacattggattgccatgaggactaaatgggaaattctgtataagattctcaatacagtrcctggcccatggaaagtactggataactatgagctatttttgttattacccagttttaacacacatacatccattcaatcagtaaagtcaactcagaaagattgcaactaaattattgcaatttataaaaggcatttcatcatttattgcttttatcacttagctaattaaaatgttgtgacctgtttttctttttattagcaattatcttaatatctatcttcaaaatagtaagcccaggcggtattaaacagcagtgagaaagatacgtgatatgcctgatatgaccatattgtttctgaacagcagaagctatgataaaatataccaccaggattctcacagccaaaaaagattaaagccaggtcatatgatgctgagtcagtgctttttcccctcctttaaacagcttgttttatttttatccatatctttaaagatagggtagatgatgttcgatctgatattcactctgtaggtaaacttttccctaataatctattgatattctttatatagacagaataatgctgaagaatatctttaattttcagaaactctataaacttggatgggaagaagctttgaagaaaggctatgatctcccagttgatgcaatttctgtacagctagctaaagcttcaagagacattgctagtgatgtgagtactagtttgagttctataaggctatattttyatctgaatcaggtgacttaatgtcggtaactatttttatggatagtctttacctttcaaaatataatgcttccttcattttctcctaccctcttcatttatccggagttcactcttctctttcactgttcatatgtcaaaagggcttcctgaatagaggtcgggccagacgacctctaagatccattagagtaagatgctctacttggagatgttacaaaggacccgagattgcaagttttccctactttgcctgaaaatataataattttactgctttctacttgtctattttagacaaattcaaagtgccagatgataaatcaacctcaacaaactgatgctgatagattttatatgcacatattttaaaataggctgtcagttatttcagtttagcccattttgcacttatataattgtaataaattaccttgggacataaaaaatccaagaaggtccagaaatttaggtttaagttcccaagggcttacttaactcttctttctgaaaatccaatctaaagttcatagattcactctcccaaaggtagattccagttatgattagaaacggtagcaaatctggtgaaaaactaggtattgtctctatttaggtattgtctctattggttaattttttacaagtattttacttagatattctgcatattgctagcatatcattttgttaatcccaaaacttaaccacaaaaattcagaaggtcttggttatagtgaataaattaccaggatttcatagggaagtaggacctcttaatcaaaatctttgaaagaaaacagggatttggttaataggcaggttgaagtacagagtgcaggaaaggaatgcctaaaaatggaatctgacaataaattctaagaatataggggaagattttatttaattcacttaatttctggcactccagaaatgttggaaaattaatatgatgatatattattacccactctccagcttgcaggtcaatcccttattaaaataaatcaatgaggtgataagcctaaagcaataatgatgtgtaaactcatttccatttagtgctatgtgctaaagatagtttaggaattgaagaaataacatcaataatttcctaacaacatttgatagtacctcatttctttttgtgtgaacccattaattcgaaccttttgaaatcttactctcaaatgaactataagtgaactttcccactattatagagatgtatttccctcaatttcaaatgtccttgtatttataaattttcagaaaattaaaacaattttataagtatttaatgaattagaatcatagaatttagagtcggaagataacataaaggacatttaatctaatctcccactcagcatcctaccttctctccatctccaaaattctgtagatacttaaaaatataagaattttggaggctgggtgcagtggccccgtcccataatctcagcactttgggaggccaaggcaggaagatgatttgaagccaggagttcaagaccagcctgggcaacgtagtgagactctttctttacaaaaaataaaaaattagctgggcatggtggtgtgtgcctggagtctcagctacttgggaggctgaggtgggaggatcacttgagcttggaaggctgaggctttagtgagccatgatcgcaccactgcactccagcctgggcaacagagccagacggtatctcaaaaataaaaaaattctttaaaggaattttggagtccttcagggcaggtcatttctttgttagatcatttctaattgccattatataccttcttatttttgcctaaatattttaccaataagctctagatctctgttctacaacaccacaaagcagcctatttccacttccacttgataggtcttcaaacattttcatatttgccctcctttgttttcagttttataaattcttcaatcttctgatcattctatttgtaatttgtgctattttttcaaaactcttgtcaaaatagaatccctcaaaatttagtgttgttttcttgatayggaaggtcaggtcagaaagcttatttgtgccccatacaaaatctatggcactgctttttaaaaagcaattttgtcagattgcttatgttgaagttaaagtccacttaaactcctgaatattttatatatgtaataatgaagctgggtatcatgtaacgtataacatgtgttcagcacctaacatcaagtaaatgctgttagtatactcattattatcactgttgttattgtcatctagtactaatgtgatttttcttaattgaatctaaataccaaattttacttttactgtcttaaatttatgtaatcattttgacccatttggcagtatgttgagctcctgtggaattttcttcctaatctaacatatttagttatttttagccatctgcacatgcaagatatagatcccaaacaggacaaggttatatgacgtaaccacatggcaaaccacaaaaagatcctgctatttaatggattagtctgcattattaggcgtatttacttagtcatgtatcttcctgatttttctgccatttagcccgtaaggattatcatttccataagaatatcacaagagctgtattaaatacaaccccaaagtcagaatacacaatatctagcacaaccaaacatatatttctgcatctagttagaattaatttcttatcataacctctcttgatactcaattacattagatttcttcagaagcttccatgtaaacaaggcttagtttaagtaagtaaacattccatactaagttagcatagacaacacttctctcatttcagttttggaaaacaaacatgaaaacaaggcaaactgaagctggatgaggtggcatgtacctgtaaatcccagctactagggaggctgaagctagaaaagtaggcctgggagttcaagaccagcctgggaaacatagacccctgtctcaaaaaaaagaaagaaagaaaagaaaaaaaagcaagttgagcttaacttggcctttgtgtactaaaagagctgtgttttctctgatttcagtataaatacaaacaaggctaccgaaagcaacttggccaccatgttggattccggagtctgcaagatgacccaaaacttgtgttgtccatgaatgtagccaaaatgcagagtgaaagagaatacaagaaggactttgagaagtggaaaactaagttctccagcccagtggacatgttgggagtggtactggccaagaagtgtcaggagttggttagtgacgtggactacaagaactacctgcatcagtggacatgtctgcctgatcagaacgatgttgtgcaagctaagaaagtttatgaactgcaaagtgaggtcagtttctattaaatccaatagtttatatattaattcatattttatatgagtagctatttagtcaaagagaagcagaaattaggaattattattgaaaatctaaaatgcatctgtttgtaatgcatagaatcacttgaatcaagggtccaggtgagaatgggattttgatggcttgctctgtcttttcacagaatctatataaatctgaccttgagtggctgagaggcataggatggagtcccttgggttctttagaggcagaaaagaacaagcrggcttcggaaatcatcagtgagaagaaatatcgtcagcctccagacagaaacaagttcaccagcattcctgatgccatggatatagttctggcaaagacaaatgccaaaaataggagtgatgtgagtagcactctggaaataaatagattatagtgcctgctacctagtgtttgctcaatagcacttgcttaataaatgagtagaaccacaaagcattgcctcatacatcaccacataaaattttatattggatcattttatttgaattagcaactatcctacactgaatcatgtaaaaatgggtcagtgtcagtttttgtcacccaaagcttatttattatttaaccaaaatataatgggaaaatgatcgaacaaactgtttttctttgaaacttgactgcatgaaacacccagatgttttttgttggggtagagtatatgagggggaaagattctgagtaccttacacaggcacaatggatgtgttataaagagtgtatttcctgacaaatgattataatgcttttagtttagctgaatcaggataaatggataattctgtcactgtaaataagtatctattccatcttcaacttattttcttcaccagctctgacaccagtatctagcacataataggtactcaataaatattcattgaaaaaatacataaaatatagcaggrtggagtaattatatgcaaagaagggaaagattactcaacactgctcagctaaaagcctaactttgaacattacagaatactgaagtatgtgccctgaaatctgtaattggtaagaagatttaaacagatatataataaccgtctgttattaggaggatctaaatatatgtactgtaggtcttaggaggatctgaatatatatactatatgtaatatgctatacactttacatatatcatatatcagaagttttatataatatataagcccataatcagcttagaatgagcattgataaactgtagttcctcttttcctaactaacccctcacagactttttataatgctgatttccagaatgtatagtaaatgctgacctgtcagcttcattatgaatgtttaagcatttacttattcttttactatttttatgatgacagaatccaacaaaatgagaaaacaacaaatttgtacaaaatgtttcccccttgttggaatccaagtttcttttctttccatgaaacaggagataaaaagatctgaacttaataaggtgaccaaatgagaacccctagatcattaagtttatcgatatacacgttctgggacaggactccccagcagtgtgctctagtttggggaatgctgaaacatggagctctcaggcctcaggactgccacacaaaacccgggccagctggggtccttgagcttgcagtctctccttctgaatcaactgatacacctatcccagtgtaaataataatagcattttctctgcattccatggggtgaaagtggcacatgccattgaagaaataatctaacttagtgactttcaaccagaagcaattttgtcccacaggaacatttagcaacatctagaaatatttttggtttttacaactggggagtggcatgctactggcatctagtgggtagaagccagggatgctgctaagcaccccacaatgcacggggcagcccccacaacaaagaatcatccatacacaatatcagtggttagcaggtagagaaactctgctgtttgcttggtgggtacaatgtgtgttgctccagtgatggatgcactgaaggccctgacttcaccacaatgcaattgctcttgtgcccccatgaatatatggaaataaaaaaattttttaaagagaaactctggtgttactaaatccaaaagggtagtgcagaactgggatacacacatatggaaattaacaagccttgctttgtttgggtgctgagggtcttaattggcttctctgggttatatgcaccataacaaacatgtgcaggaaaaagaaaagtgccagacacacacatctcatgctgcatacctcaaagggaaatggacaagtttaaggaatcaatgagacaaaaaaattttttattgaaataatttcaggcactcagaaaagttgaaaaaatagtacatgtaattcacatatgtgtgtatgtgtgtgtgcatacatatacccagattccccaaatgttaaaattttaccacatttgctttctctttttgtctctttttctccctttctttctctcagatctatatctatatatctatatgagaaattaaattgcttcatgatgcctaaatattccgtctgtatttcccaagaataagaacatactcacataatcacattgtgatgattaaaatcacagaattaatttccactggtctgctagtctacagaatttattcarttttatcactaatatcctytmtaagaaaagaaaatattttctctggctcaggatttaatccaagaccacaggttgcattacttgctatgtctttagtctcctttactctggactagttcctcactgtttctttgccttccaagtttttgacattcgtaaagaacataggtcagttattttgtagaatctccctccatttgggttttctggtgggttcctgtgatagactcagattatcttttcagcaggagatcacacattgtgtcctcctcagtacctcatatcaggaggcacaggatatcaatttgttctattactaataacttaaacacttggttaaagtgatggtgccaggttgctgtactgttgagtaaccattttatcctttgtaattgataagtaatctggcagggagatattctgccctgtgtaaatattctgtttttaatcaaattttcctagttttagccgggcacgatggctcacacctgtaatcccagcactttgggaggccgaggcaggtggatcacctgcgatcaggagttcgagaccagcctggccaacatggtgaaaccccatctctactaaaaatacaaaaattagctgggcatgtggtgggtgcctgtaatcccagctacttgggaagctgaggcaggagaattgcttgaacctgggaggtggagattacagtgagctaagactgcaccattgcactccagcatgggcaacaagagtgaaactccatctcaaaaaaaaaaaattattagttttagtaagtctgtgaaacttttgtttggatccccttgtcttctgttgaagagacataaggatggctctgggacatccaagatatcttgataaattcccccccaaaaaatccttttgggaatcctaatccttcacaatgattatgaggcataactataaatactaagtcacatagaagctggacacagtggctcacacctgtaatcccagcactttgggaggctgaggtggggagttcaaggccagcctgcacaacgtagcgaaaccctgtttctactaaaaatacaaaaattagccgggtatggtggcacatgcctgtaatcctagctactcaggtggctgaggcaccagaatcacttgaactcaggaggcagaggttgcagtgagccatgattgcgccattgcactccagcctgggcagcagtgtaagactctgtgtcaaaataatgatagtgataacaataagccacataggaaataaaacttcctgatttctaggcatgctttgaataagacatcttttgaaaaggcaagggctgcctctaaattaaacactgagggacacaacccagaagatggagaagcctgtttcatttgataatattggcaaggcatgtaattacctagattgatttcttgtaggcaggattatctgtaactttgaaaatgtgacccataatctctgtgttgaaaggcagttatgtcccagataagtcaagaaatattgcatctattttctgcttatgttgtctgcttattatatcaattctgtataatgtttaattcagataaattcagcaattctgtttgaagccaactgtatcattcactaatctaacaacaccactgaaaaattattatttcttattttagagactttatagagaagcttgggacaaagacaagactcagatccacatcatgcctgatacacctgacattgttctggctaaagmaaacttaatcaacacaagtgatgtaagttttcaaattcagcatgtgttttcagaaagctcattttaattgtttctaaatcagtgaaattgtctagaagttctctgaatccctgaattattttaattaattaactacatatgacttagattccttatttagtggcttttagattgaatatcgaaatgttagtactcactatgtcaggcagaatggggagtctgtattctctgttccttgcagtccgttgttatacatatcatcataaggtggcttatattgctcttcccagtgtggacaggcaytctttgcaggcagaggcaattcttattgaatctacagtgcttatctagaatcgtgcctgacacatagtagacactcaatgaaattttggatcagtgagcatacaaaacccacgcaggagaatctcatttttattgtcattatcattgcagcataatctcctgaaatgtatacatctgaaaattaaatattttaaaaacaaattctaaattctaatagaatgactttaacattaaagaatgtattaaagtagttccacgaaggactgacagataaacacaagtccaagatcaataggcactttaaataatctggtttctggataaaagtacatttaaatcatattctcaatttttaaattatgttacagatctgaaaaaacaaattctttcacttaagcttttaaaattcattatttaaaccttcttmaaaacataagttttagaaattatggtggactcagtatcttacctatagatgtggatcctattttggatggtcccattttgggagacagactatttcacaatgcatcagctacatagaagagataaccccttaggcatgatttttccccattagaagaattagatgctcttttctaacaaaaacttctaatgaaacagtccatgtgaattgaaaaacagcacctcaataataatccatttcatttctctattgttttacttctgcctgattcttgcaagtatagacatgcactgtataacaacagtttggccaacaaaggcacacatacaggacggtggtcccgtaacataatcatactgtatttttgcggtatcttttccatgtttagctatatttagatagacaaatattaatacttcccattgtgttacagtggcctacactaacatgctctacaggtttgtagcctaggaggaataggctataccatatagcctaggtgtgtactaggccgtaccatctaggattgcataagtacactctgtgatgttcccacaaggacaaaatcacctaacaatacatttctcggaatgtatctttgtcattaaccaatgcatgactgtatttgggaagagctgacaattttgctgatttaggtaattgaagagctttaaagtttaaaacaggatcattagcaatcaatgggcataatttctaattacatttgagtattttagggcacagatgctattctcatggactcaaaatatttagcacatttgatcattatgctatatttgtctatggggaacagtatttcccaaaatgatcttcatttcttaacagaaactctaccgaatgggttatgaggagctgaagagaaaaggttacgatcttcctgttgatgccataccaatcaaagcagcaaaagcctcccgggaaattgccagtgaagtaagattttatcctctgttgatattgatttgattgcaatttatcacttcaaagcagtctcaatttaattttaaattgaacaaaatctaaggggtaacaaattacagtggaataaaatgatcccatgcagtgtgggatgaggataagatcaaggatgcatttattatgtatggaatttcatagctgaatttagcctttaatctttcttatcaaaagactgaagtctttggctctctaggcttagtaaaatatttagagttaatgcgctttgtaatttgccacaaagatggcaacagaagtaaattttgaaaggaatgagacacattttttttctctagtacaagtacaaggaaggctttcgcaagcagctcggccaccacattggtgcccggaacattgaagatgaccccaagatgatgtggtccatgcatgtggccaagatccagagtgacagggagtacaagaaggactttgagaagtggaagaccaagttcagcagcccagtggacatgctgggggtggtgttggccaasaagtgccagaccttagtcagcgacgtggactacaagaactacctgcaccagtggacatgcctgcccgaccagagcgatgtcatccatgctcggcaggcctatgacctccagagcgatgtgagtctaagattttcctttggccaacaaaacattatgtctgctttttaaagtatcagagtcccatagtgagcagagttgagtttacacaattaccctggactaatgcccaagcgcatctagtcacccagacatctggaggcaccattattccacaaagaaagagccagcaaagccccattgctttggtggaagcctctagattgtcgagctagacaatcaaaggattgagtcctttcctatgtgcttctgtttaaaatgtttttcaaaatatgcttttaatctgaatattttgttgatttataattcataycaaaaatttagaattttctaataattcaagtattaaaaatatagagtataatatgaacttttatttaggggcaaatgatttaattatgacaaattatgacaaattgtgataaatgatttaattatgacaaatttgtcacttgcactttcagaatttgtacaagtcagaccttcagtggctaaaaggcattggctggatgactagtggttctctcgaggatgagaaaaataaacgagccacccagattttgagtgaccatgtttaccrtcagcacccagatcaatttaagttttccagccttatggattccataccaatggttttggcaaaaaacaatgctattaccatgaatcatgtaagtcctatgtttgtttgaggaggttattaattttttttgtttatggaaacactgaagtctgtttgtataaaagaaaacttrtttttgattcctttgcttggtactaatgtggttttaaagtattgtgcttcttattgacacaagacatttagacctgaawatgtcacaaataccgattcactgagctgaaattcttgattctcattaaaaatcagactgtctgcatgtgtctatttattactggcctataccagtcatgtttttctgtttctcttagcgcctctatacagaagcttgggataaagataaaaccactgtccacattatgccagatacccctgaagttttattagctaaacaaaacaaagtaaattacagtgaggtaagtaatatattcatagtgcgtgatacattttccttacaatgcactttataaatccaacttactattaatgtctattttagaaattgtataagcttggcctagaagaagccaagaggaaaggttatgacatgcrggtagatgccattcctatcaaggcagccaaggcctccagagatattgcaagtgaagtaagtatacttggaaagttatttgccttagctttggctcaaagatttatttctctctcctggatttatagtggcacaagtaagccatgaggttaaagctgttgctaacagtttattgtttcgatgaatggtttaaaataatggtaatagagttatcaacagaaaggccaaattcaagttattgttgagtccatagcaacatgcatttcaaaacatgtccgtttcctgctgaacaaaagtattagatacttgactatagttcagataatttttttggcttttccaatgatgtatctctcatatacaattgagcttattgtagggttccttcaaaacccaacctatgctgtatgaaccaatgaatctacaagggctgaattataggacacattactcaaagttcaacgattcctgtggaacatgtttgtttctatatcaggtggtgggttacaaatatttgctttctttaaaagatggatttgctcactgtcacaaggacagaaaatcaaacactgcatgttctcactcataggtgggaattgaacaatgagaacacatggacacagggtggggaacatcacacactggggcctgtcataggatggggggagggaggagggatagcattaggagatatacctaacgtaaatgatcagttaatgggtgcagcacaccaacatggcacatatatacatatgtaacaaacctgcacgttgtgcacatgtaccctagaacttaaagtataataaataaaggatttgctcacatttctaaaaatttttatctttccatttcttttgtctatgaataaaaaaaactctagatttttttctttatttccaaaatatgggaagtaatcataatttaagaataaatgacaatcacagaagggttaaataccatataatgaaatacctacctgtcattaaaaatcatgtgtataggtcaggcaccatggctcacacctgtaatcccagtgctttgggaggtcaaggcgggaggatcacttaagggcaggagtttgagaccagcctggtcaacatagcaaggcactatctctacaaaaaacttaaaaattagccaggtgtgatggcgcatgcctgtagtgctagctactcagaagctgaggtgggaggatcacttcagcccaagagttggaggttgcagtgagacatgattgtaccactgcactccaacctgggcaacagagagagatgctttctaaaatacaaaacaaaacaaaacaaaaaaaacagtcatgtgtgcaaagactatttaatgacacatagaaatgcttatataataactgaaaagagcaggcacaaacccatatacaatatgacttctaattatattctcacacacgaatcataacaaattattttagtggcagaattacatcttaatttttcttttttttctgtgtgtataaatatacasacattctttgcaggcaragataatttttattgaatctgcggtacttatctagaattgtgcctgacacatagtagatactcaatgaaattttggatcattgagcatataaaacccatgcaggagaatttcatttttattgtcattgtcattgcagcataatctcctgaaatttatacatctaaaaattaaatattttaaaaacaaattctaaattctaacagaatgactttcacattaaagaatgtattaaagtaatgcctatctatatggtatatattttatataagatatatatttcatatgtgatgatatgtgctatatttattttctaaattgtttctacatctatcatataatttacatattcagggaaaattttttttttaataaatagagcaagttaggcttagtgattgctttttactaaaagttaaaacagatgactatctgtctttttcttcttttagttcaagtacaaagaaggctatcgtaagcagctcggccaccacattggtgcccgagctatacgtgatgaccccaagatgatgtggtccatgcaygtggccaagatccagagtgacagggagtacaagaaggactttgagaagtggaagaccaagttcagcagcccagtggacatgctgggggtggtgctggccaagaagtgccagaccttagtcagcgaygtggactacaagaactacctgcaccagtggacatgcctgcccgaccagagcgaygtcatccatgctcggcaggcctatgacctccagagcgatgtgagtactgagagtcataataacgtgcagaggtgggaaattatttaacaccccttggagaaaatggcaatatatgrcacaagctcaccagcccctggaggaggcaaatagcattgcctttatcgacaggaattttaatcctttaacccttcagaccaaagaggaatattgtgtgatacctggcccgtccaccaaactaaattttgagagtgcttttacttgatctcttatccttcagatgaaaatgcattgctgatacagagataaatatttattggctatttgtgtcaacagaatatgtacaagtctgatctccagtggatgagaggcattggctgggtgyccattggctctttggatgtggaaaaatgcaaaagggcaactgaaattttgagtgataaaatctatcgccagcctccagacagattcaaatttaccagtgtgactgactctctggaacaagtgttggccaaaaataatgccatcactatgaacaaggtgagacttcaaaattaagaatcgaagtggggctcctaaagctgaatcaacaaaaaagaaacattaatgaggaaagaaagaacattgagtaataaaaggcatctatctatctgtctatgtatctattggcttctcatctatctattaataactgatatatatcatgtatattttgatatttagtcattgtttcatgattttgataaagtagcatattttatcaaaaaatagtctgcataaaatatgcttattctcattttccttttgttaacatacatttcagattattagaaggcatttataaatacacattcctttatgaacttattacctgaagatgtgcataaaacacataatgtgtataaaacacataaccttttctttttttttataaagtttttgtggccctaaaattcctattaactatacacagaacttttttcctgatgaatttgtgtattttttttgatagcgtttatacacagaagcctgggacaaagacaagactcagatccacataatgccagacacaccagaaattatgttggcaagaatgaacaaaatcaactacagtgaggtgagagcagattctttgacatttgcacactgctgcttatttcagttgatctactctatgatgacatgataccaaatgacagctttagaaagaatctttttcatgtttcatgtgaataacaactcttgcatttctcaatcaccatcataaatgtcaaactttatgcaatatgaattatcatttaggaaatacaaatgacatgaactaattatttaagctgtaaccatgagattatgtagaccattttcttttattatttttttgaagttaggatattagcaattgacctatacatgtatctcccctttatgctaaagcataactgtagtaaatatattttccatatattgttcctaagtgtggtttaggatccaaatttaagatttttagtatataagattaaaggcaagaactaaaatccacagtactaccaggtaacccacacacacacacacacacacacacacacagagagagagaaatatctgtcagtgtaaatattagcaagcccatttcctttcactttcagtgtgcacagggccacgtgccatcattccagaatcatagaggcttaggcagagagtcaagcctccaccctagtgcaaaggtacccctccccacaaataggtttttgacctgcctttgcttaagggttcccagtgacaaggagctgatctcataaatcagtccattcgttctggaaaatttatgagaaagcttctgatgtattgagtcacaacatttctctctgtaaactcacatagtcctctgaagctgcacagaacaaatctgtgccaacccccagagatggagagcagcaccagggtgcctcccctgccaccttcaccccaggttcaccttcaaatccaatatcccaagctgcggggcattcctcacatgacatcactagtaaaatgtgactctcagaactgagcaaaatactatgagtggggaatgactgatgtagaatacacttaactatcgtatttcctcttctggacatatgacctctattctgcatcctgtgctcccaggatacattggcagctgtcactgctggtgcacacagaacttgagaccaacttaaactctaagacatcttatgtggactaaagttaggtttcttccatcctgcatttatgcgtttggtaatttatctctgttcaaagattggcatttatctctgtaatttcttcttcttagactgagcctgtgggtataagcctgtggagatttttgtgaatctaagattctgtcagctgatgtgttagttatttcacctggctttgtgccaccagcaaggaaaatattgtttatttggcagcataaatcaacacacagagcataatttagagaatttagatggaattgccaccatcttaagtaattattttggaagtgagactgtaattttagtgcttgtatagctagcttttaattgtcaccaaaaactaaaaacatcaagtcttactcccctgtcagaaaggactgaattattagccaaacctataatataggtcctgttacaggaaaccatgcattacatgtgcaagaatttcaggaaacaaagggctccccctgtgtctagctagtcagcatttctggatttctcaactctgtctttgctgaaaaagctcagagatgtgttagtgcggctactcggctgccagtcccaggaggcccaggtgcccttccccattttgcccgcaaccccctattccacccacccagactgggacgctgccatgggcgctcccctctgatgttaaaaagaagagaactttttggctgctttcctattttctgtagaattaaacaccaacttcttagaatgaggcgttcacagtccaactctgggctattctcagccctctcctgtgaactcctccctggggcctcacccacttccttcaacacccctccgcttcccctccacagtggtgccttgattcacgtgatttcctctgcacttgatgccaccttagtctactgaaactctgctcaaagtctaactcaaaggtcaccccatcttcaagaacttccctgattctcagttcagaataaatgactccttcctggagctcttcattattagtgtggtttgacttttcagcagttgcttccacaggttatcagtctctccatcagttctcccaggaacctttaggttgagaggggtctcaacctcatctttgattcccaagtaccccgcacagtcagagacacagggtcagggcagaataaatgtgagttgaattgattgccatgatcaacagttaagcctttccctcccacccacattttaccatgctagaactatgagtttcagcttaatttttcctgtaatttttaaactggatttattgttttaactaaaattttttaaaacaacctgtaatatgtatatatacttaattcaacataatttttaaagtaaaaaataaaggtgcattgggctttatgggtatcttttttttttgttttgttttgttttttgagatggagtttcactcttgttgcccaggctggagtgcattggcacaatctcagctcactgcaacttccgcctcccaggttcaagtaattctcctgcctcagtctcccaagtaactgggattgcaggcatgcaccaccacacccagctaattttttttatatttagtagagatggggtttcaccatgttggccatgctggtctcgaactcctgacctcaggtgatccacccgcctctgcctcccaaagtgctgggattacaggtgtgagccaccacacctagcctcatttttgagtcttcacttcaacaaacatgcagaaggcttagaactctcaaaagaaagattattataggcactgtctgtggagaacttagtgaattgtcttagtcctctgtcagtttttagatataaatgtcagcatctgattttttttcccccaaatttagagtctgtacaaacttgctaatgaagaagcaaagaagaaaggctatgacttgcgaagcgacgccatccccatcgtggcggccaaggcctccagggacatcatcagtgacgtgagttgtcaattccattctgagtatgtgatcaatctaatgtggcattttcactgaactaaatcttagaaaagaacttttcctggacctttgaaaatatatcctgatatatttgtgtaggatttttcaaaacctcagttttaagggaaatgaaaatcttgatgtttataagagggatctgtaacctacaggacacagcgtcttctgtgaaaactggtcaaccaaaaatagagaaagattcattcatgtggaccctgttagagtgaagctgcaggcttggagatgcttatgtaagaattatcaccggcttatagaaaagcttatagaagatataactcataaacttaggttctgccagtgagattcagggcctggctttatgtaacatttgaatagatagtattttaaaacacatgcggtgcttgctattgaaatttgcccttatgaaaagaaggcagttgatcagtaccagaggtgactgctgacctaaggttacactctttttttttttttttttttggagacagagttttgctcttgttgcccaggctggagtgcaatggcctgatctcagctcactgcaacctctgccccctggggtcaagcgattctcctgcctcagcctcccgagtagctgggattacaggcactcaccaccacgcccataattttttgtatttttagtagagatgggttttcaccatgttggccaggctggtcccaaattcttgacctcaggtgatccacttgcctcaggctcccaaagtgctggttttacaagcgtgaggtcacactcttagcaatagctcctagccatttagcacgtctcccagagcaaaactgtcatccttttctggtgcctcagggattcttgaggaacaaatgacggctctaaaaatcaaggcccacttgctgtcctttatattggaatcttatgttagtgactcaactttatgtatgttggaccctcccagcaaatggacttatgccaataataataaataatgacataataataaccaagaagtattgagaactctttgctaagagctttatatgcattgtctcacttactcttcataattgccctaggatgtagatattatcattatccccattttgaggattgtttaagcaacttgcctcaaatcaaactcctagtgagtgggggagttgggactctgaacaatctcattcctttccactgtaccatattgtctcttgctgactcacctacactttctcggtcagttgtctttgagactagaagcatgtattttggataactggcttagattccagaatgaagtcattggacatgaataataaaaacattgttgatacatgtgaggctagaacccatgaccttattaagagcataatctaaccagttgggttgctatgtcagttttacaagtacaatcagttttcaaaatgatgccaaaagcttgccactgccattgaatgcatgaatctagtaaaataataataataataataaattctcctcggttgctactacaggtgatccttacaggaatcagtcactcattttactgtttttattttattttattttatttttttgagatggagtcttgctgtcacccaggctggagtgcagtggcgtaattttgggtcactgcaagctctgcctcctgggttcatgccattctcctgcctcagcctcccaagtagctgggactacaggcgcccgccaccacgcccggcttatttttttatttttagtagagacgaggtttcaccatattagccaggatggtcttgatctcctgacctcatgatccacctgccttagcctcccaaagtgctgggattacaggcatgagccaccgtgcccagcctcattttactgtttatcaaagacaccattctaccaagtgcaccctcttcctgacatgcttttagtgtatagaatccaattctacaggttccctggttcaaatgttctctccctgacttccacaggtgaccttttccccacatatgcacttcttgttttcagaggtatcccttagtaccaggctgtaggtgatttggggtatatactacaattacatgaattccatctatttttctacctctgtaagggcttccaggatgaaagccaggatactggcttgagttagtacttgttaacaaaagtcagttgaagtatgatgtaagcaagttgattttgcacagacttgtggcctctaaggggttacaataaaaacctgatttgtgcattttcattttagtacaaatataaagatggttacygcaagcaacttggccaccatattggagcccggaacattgaagatgaccccaagatgatgtggtccatgcacgtagccaagatccagagtgacagggagtacaaaaaggactttgagaagtggaagaccaagttcagcagcccagtggacatgctgggggtggtgctggccaagaagtgccagaccttagtcagtgacgtggactataagaactacctgcacgagtggacatgcctgccygaccagagcgatgtcatccatgctcggcaggcctatgacctccagagtgacgtgagtacagcatctataaatggagctgtgcatagaaataatttaaactatgtgaaaattatcctttatatacaatccattactcaagttaagattgattggtccatgaataagatttaaatcagaatacaattttattgctttattatgaatacactaatagacttcataagaaagtaaaattaacaaagtggacttggtcttataaaaacaaaatgggaattaagtaacattagaattcagggtccactagagggagacatttattctttttttaaggaaggaagaaacgtttttactttaaaaagaaattactgtggaatttgtttttggcttctttgcaaaccaaagaattattgaattctaatgcctactgcaacactaaatattatgcttatgaaataaaagaagtctctgtgtctgtacactactggactgtttcacagacacttcctcttagcctggctgtctatggaggagccacatggtaatgacagagcctactacctattggaagcagatacactatctcaaatctggatatgagaggcacatttcctgcactaggtattttataaactttgaaggaattaaagcactagcaagttttggaaactaaaactaatttgtaataattatacattaattggttgttcctaaaaacttacagcctacctgagaaaactcccacgtctgttctgtagcttctgacatacagaaccctgtgttttgcaattctttccaaaaagaaaggctttgcctgcacagaaaagatagtttaaaagggttgatgtcacccatacaacgacaatattgacagattgcttaccatctgtctatttgttgggcaccttctctggattaccttcctcaccctgcgatatgaccttcataatgtgggaagtatttgaaagttaaaaagcattctggaggtataaactgttattgttttcattctttttttttttttttttttctgagacagagtctccctctgtcgcccaggctggagtgcagtggcgcgatctcggattactgcaaccttcgcctcccgggttcaagtgattctcatgcttcagcctccctgcagctggaattacaggctgctgcctccctgccccactaattttttgtatttttagtggagatggggtttcgccatattggccaggctggtctccaactcctgacctcaggtgatctgcccccctcagcatcccaaagtgctggaattacaggcgtggaccccaacacctgtcctgttttcattcttgctattgttatttgtggggcaataactagtcagcacaggctaattctaatagtttttttttttttgtctagactacaaaatacaagtttttttattttctacttagtttctgtgacaggtgaaatctttccaatgagccaaacaaagattcaaaactatgattgtgaagcagttatgaatatctaatgggtatataaaaaccttcagcaaaaaaaaattttttaataaagtgagaaaaatatggcaatatgattttatataggtgtctgtgcttccatcctgaggacttggtgaggaagagactggggccctgcacaatgaaattgtccatttaataaataattaaattttattgccctgaatcttggacagagttacagctgttgaagatctcagggcttcaggggttctacagcactgttatattttaactgtgtttttaaagscattacagatattttgaaatgtatagaagaatacatcgcagggaataagaatccaaaacaatccaaccactagaaaaacccactcttattcatgtaatttatctacccacattgttttatgtgctactttaaaatttcatattgtattaatgacatttctacatgtcataaatattcttcaacagtgaagcttttaatggcttcagagtgttccatttgcctcggcctaaaattgattcactaagggcctgatgttgggcacgggtgtggtttctgtctctctgggttggtattcttccctgcatagggatgttataattatgataatgttcactgaaccaactgacagaagatattacttgggatcactcctctcctaataacctgaaatgtttgataactttttattatggctaggagatatttctgggtcatttttgagcataattcttttagtttgccttatacaacgcgcttgttttctacgaatagaaaacagaattgcactttattactgattctatttgcatatttaccctaaatattgtggtcttgatgaagagtttttgacttttttcctctgctcagaatatttacaagtcagatctccagtggctgagaggcattggctgggtccccattgggtctatggatgtggtcaagtgcaagagagctaccgaaatactgagtgataacatctaccgccagctccggacaagctgaaatttaccagtgtgactgattctctagagcaggtgctggccaagaacaatgctctcaacatgaataaggtgagtcctagctgccttaagcttctccaagatgccagaagatgttattatactttaatgactaatggagtctaaattatctrtgaaggygtggggtcgcatttttaccttttaaattacatgcttgaaatcctctaaataattttgattattccaagtttcaatcttgataactagtaataagactcacacttccagtagaatactttatattcaagtctggcttatttttcctaattaggtcagtaataacagttttaaatgaactttttgtcatttctatttcaaatgatttttaatcagcatcttatcttcttttatagcgtttatacacagaggcctgggacaaagacaagactcaaattcacataatgcctgatacaccagagattatgttggcaaggcagaacaaaatcaactacagtgaggtaggagcaaaaatctgtggtgctatattgtggtggtggtgtctatacttagttttgtggagattcttgggcctcagctgtcatggtgcatgtggctctttcatttaacactccactcatccaacctttcatctctgggttaaatattacattttatgggattccactggcaaactgaagtcacaatgtcttttctgttcgtggtgatttccagtgagtcagtgggactgagtagtattttagacwcttcagaggattgtcagataaaatactggcccattatttctgccaaaatattcatgcccactaattccatccctaccaattagatacatcagtaaatcactgcacctttccagggcagagagagtaaaggggcagaaaaggcctcagttaaaataactgagctttgtctatagaaagaaaaccttaggcataaggaagaaktgttctctatcaacaacattgattactgacttttttaaaagtaaaatgcaattttatagacacgtggtttattaatatgatacaaccaaaatttagaaagttgtgattatggttgttaactatattttgttatattttaatttttcttatttgtcttttaaacattataaaatatgattgtcatacaaattgtaggtaataaaaatgaataaaaatatatttttatacgtatagatagatattaaacattgttctaccattttttttcacttagtggtatgtttggattgctgctttgctcatcaatctgtattactagattgtattgatctatgctgatatgtacatcatattgatctatgtatagcatattaatctataatgatatataataggttaatatatcactatatattaatgttcattgatatatcccatttatttctaacgctatatagtatttttggtagaatataatttatttgcttkccactattgccagaaacttgaatkgtctccagttcctatccttttttaaattttaggatataagtcacttaataatctctgaattgttgatgtcaaaccttttgctttaactctttgcctttcttttcatagactctatacaaacttgccaatgaagaagcaaaaaagaaaggctacgacttgcgaagtgacgccatccccatcgtggctgccaaggcctccagggacgttatcagtgatgtgagtagcaacaccctagatatttacatggatggatgaagtggggaggcaggattattactattataacatttgggggccagtttaagcacatttattggcttgtttttctaaatcaaattcaaattcaaagtttttcatttgaaaaaactcatgttttaagcttcggaagacttcagtatctatgtcccaggtaggaagggggtaacctaaaccagtatacttcaatgcagtataaaattggatgtgattctataatttttcatatctacaattatgagaaattcatctccatattytgagcatagagcctcacagaaaatagaaaatggcaaaagaggtgttaaaaaataacttagttacatgtattggttcaatatcagaagaagagctgatagaaccaagtctaggaaaatccacctttccccaaatctgctctgtgtttttgccaactcatttttttttggaaaattatcttaaatccttccttttgagttcttttaaaatgaaaacagaaagacaaagacgaggaaaacaagaaaatggtgaacctaatttctcctcctgccatctctgaaagaggtgggttctttggtggaaaattcagacttcttcttcttcttcttcttcttttcttttgtttttgtttgtttgtttgtttgtttgagacagagtctcagagtctcactcttgttgcccaggctagagtgcaatggtatgatcttggctctctgcaacctccgcctcccgggttcaagtgattctcctgcctcagcctcccaagtaactgggattacaggcaccagccaccacacttggctaatttttttttagtatttagtattttttgtatttttagtagagacagcgttgcaccatgttggctaggctggtctcaaactcctgacctcaggcgatccgcctccctcggcttcccaaagtgctgggattacaggcataagccactatgcccagctgaaaattcggacttctgtaaatatttgttgggattggtgtggtgtgttgtctgaaatagggagaaaatatccagtttgcccttaccaccaccaacaacaaaatgcttttttgtagatacatattccatttttcacttgaggaatcccaaacaaacctcagtcaaatttgatctccaacagagcagggcttgtagtatgggaatataatccagaccacttcagggagtcaagtgccccagcagagctggatttgggaaggagtgtgggtgtgttggatggagggataaaatggtatctgtggactcaggaatagcagtctcaaaatcatatgtaaaatttctgggttagtgatttcatgggcccaagatgaagaaatggcagtacacagtaccgaaagatcttccggaaagtgttgcttcctttattttcagaaacttaacgtctacaagccataggaccatgtagtttggcctgtcttcccactggactattcccattagactgttgctgttagactatttatgagacttcgcattagactactgcccattagattagtgctgtagagtctaataagaatttaggatgaggagataaactgatatgcagattctttcattactctgcaagaattagcaattttaaaataataaagttttaaattaatgaggcttctaagcctttctattcatttttatttttgaaatgaccacctttatttcagtacaaatacaaagatggttaccgcaagcagctcggccaccacattggagcccggaacattgaagatgaccccaagatgatgtggtccatgcatgtggccaagatccagagtgacagggagtataagaaggactttgagaagtggaagaccaagttcagcagcccagtggacatgctgggagtggtgttagccaagaagtgccagaccttagtcagcgatgtggactacaagaactacctgcacgagtggacgtgcctgcccgaccagaatgatgtcatccatgctcggcaggcctatgacctccagagcgatgtgagtaattaagatccatggtaactgtgctcataatagtaattcatagaaatactgagacagtggtctagcattaggtagaaccttcagaagggatgacatttcttctctctgctcattttttaggcaactcttccccttactttttttggagagaaagaaagtaatacctgagactgtattcaatttggccttcatatattgaagaacgtatacatgaaatttgactatccaagctttctagtgttatttttttatttttgaaatcatgttaaaacaacttcagtaatactcgcttttgtgtttaatctctccagaacatttacaaatctgatctccagtggctgagaggcattggctgggtccccattgggtctatggatgtggtcaagtgcaagagagctgctgaaatactgagtgataacatctaccgccagcctccggacaagctgaaatttaccagtgtgactgactctctagagcaggtgctggccaagaacaatgctctcaatatgaacaaggtgagcccccaatttgtaggaaaataagacagggctatatgtcattcaagatacctattgttaattaagttagtctcttttttaaatccaattaaattgctatccaatgtatagtgattcagttgaattctctattctgttagataacaatatatgggagcatttctgctttgacatctcttgtgaaatagccagagttaagaatggcacagctctttgggaggccaaggcaggcggatcatgaggtcaggagatcgagaccacggtgaaaccctgtctctactaaaaatacaaaaaattagccgggcatggtggcagacgcctgtagtcccagctactcaagaggctgaggcaggagaatggtgtgaacctgagaggcggagctcgtagtgagctgagatcgcgccactgcactccagcctgggcgacagagcaagattccgtctcaaaaaaaaaaaagaatgggacagctattatgggttcaaattgtttgaagtctataagagttagttatatatgatttggtatggtttctttcttgctgagtacttatttaggtaagcacagagcaaacaagaaagatgcaagccgggcatggtgtctcacacctgtaatctcaacacttttgggaggctgaggtgggcagatcacttgagctcagcagtttgagattagcctgggcagcatgttgaaaccctgtctctacaaaaaatacaaaagttagccgggtgtggtgacacgcacctctagtcttaggtacttgggaggctgaggtgggaggatcacctgagcctggagaggttgaggctgcagtgagctgtgactgtaccactacattccagcctgggcaagagagtgaaactctgtctcataaaaaaaaaaaaaaagaaagatgcaaatcttcataacatttatcaaaaagaaatctagagatagcacatacaggtacatttgcagctaataaactaacaacaaacagcatcaaacaaataaaatcatgggaaggatttgttaatatagtcatactacagatatggatgtgaatatatgcttgagaaatacttgctttttatttaattggggtgagagtgacctggttaccaaacacacacacgtgggtgtgtatatgtgtgtgtgtgtttgattatatgtatatatatatttttcttttcatatcttagtatacatttatattttgttacaataaatgtcttgtaaaatcaaagaggttgaaaagaatattaacatacatggaacagacagcaagaaagctggctctcaactttgtcatggtgtcttaattgaaaactcctgtttacaacaaactgtttttctaattcattaacctttttatccttcacagcgcttatacacagaagcctgggacaaagacaagacccaagtccatattatgcctgatacacctgaaatcatgttggcaagacaaaataaaataaattatagtgaggtaagatcatttgttttatttctttggtctggccacattgattgttgccgatgtaggaatgtgagaattaygaaattaatcctcatgtaagccagttagcttagttggctttttatgccatttaccctaccttgaatatacatattattgtattaaaaaataggcagatagaaaggtagatagattagacagacagatagayagacagacacaaaaatatcttcatttcaggagggaaaaaatatctcaagtcaactattaatgactaaaacataattttcattaaaaataattcttgctattcatcaaattagtacttgcttcaaaatttgtgcggcaagtttattttcttcaattacctcatctgtaaaataggattaaaatgcttaccttaaagaatttttaaagaatgactaaatgaggtaaaatatttaacatgcccagtgtgaagcctggtgcaaagtatttgtttaataaactttaatgtctctcctttatgctcaagtcaccatgaaaattagatgtatttaatgtgctcaaaataacttgagctttatttacaagaactgaaatgagaattcttaaattcacccatttcaaattgcctgagaacaataaaatacattcttttatgaactatcttcagccttgctaaacttgtcattgcatatctttgcagtccagaaatactgctgcataaatagcgtcttgctcaattgttcttgccaaagtcaaaaatgtatatggttgattcaagaaggatactaattttttaaacatgtctatgtgtcttcatttttttttagagaaaaaggaaggcagagttgtcttcagtttgagagcactgaaaaatttaagtactaatttttaagatgaccaaatttattactttacccataataattacttttgcctataataatgtagccttaaaaaatggagagggtatgatttcactttctccagcattataaaacagaccaaaggacaagcctgattatagatatttgattggccttggcttcagtcacttttgaatgggccattttctcttggccacagagcttctcagttggattatcttctcccaggaggtttattttatccaaggcagatgaagttagtttctattccagattataatgaagctcttaatcctctctcatttgtttacattaggggaactgaagtagatttttttttcagactgctgcaaggatattgggctattttttaattctaaaattttcagctggatttactttctttaaaattgcatgatcatgcattgaaggctttgacttcaccacagtgcaatatattaatgtagcaaaattgcactcatcccccatgaatacatacaaataaataaaaataaaattgcataatgatgttgattctctgaggaatctaagatcacatttcagaatggcccactagaatttcttctcaacccattgcccgtggttccttcattgcataaatgtaaaacaaaacaaacacatctgtttttttcctcttaaattctcatttacttattttagttttcttaagtaacaagctttaaaatacatccctgatgatagctaaaagtgttctctcctttgaagcactgcatcttttttaaatgctgaaagaattaaagaactctatttttttggcctgaagccatgagatgattgaagcacattttttcccacttataccatttttaaaatatgaacatttattcctaaagaaaaaatgtaataaataaagtatttgaccttccagtttcaaaagaaacattcctagaaattttgaagaaaaacagattccctctggaatttatctcaaagatattaaattgattcttatttttactttagctttttcttataaaatctcatcttgaaaagactataaactgacacatcttaataatccactttataaacataatagtgaccctgtaagagtcttaagtcattaaaaatattaaaaaatattaaatgcatctgtagcatatttaaaatccagatactagtccggtatccttaattcaatctaatttgagaatggrgtataaaaatgaagtttaattatttgtatcacactttttagggattttccttatgtttaagattttgtctttacacaggctcagcaatgaaaagtacactgaacagtataaagtagagggatgataaagctttatagaactgtaaatctttgtagtttttcccttaaagccatgcattatttctaaattcttttccagaactatctactggtactgtgtctgctttatctaactcaataaacctcttaaaagaggaaagggggaaagtgaaattaaagattaaattgttcaatcatagattgatctaaaggctgtatttggatatagatgagctgctttcaaacctcagctacctaccatccttgaggttacacaaaggctttccaaggggtaaactggcatggatcgttttaagtaaatcagttaacatagcttcaacttccatacatacactcttctaaattatctgcccaagaatgcccctacagcttgagtggcatcccacttctttcataatcactcttctctcatgttaaaacaaaaaaggcatggtttaaaggtgaagaaataaactagagaactaaatgctactcattctcttgaactgaattctggatagaaaagcaacattgctataaaggaaattattgggacatttgatgaaatttgaatattcaccgtatatttgatagtaaaagagaataatactagacaataatactgtatcaatattaaatttcctgagtctgatacatatactgtcattatataaaaatatctttattcttaggagatacatggtaaagtattcaaggatgaaggccataatgtgtacaattttctcttaatcagttcaacaattgaaaataataataataagtaaaatgaagaaatacacaaacacataaagagagagctagagaaagcaaatatggcaaaaatgttaataaattggatagttggtattcattgtagcattcttgcaacttttctgtaagtttgaagttttgcaaaakgtggaaagtatacattttaaaatattaaaacatacattaaaatatttgactaagtgtgataatataaagatttcattttttaaataaagaaaaagaaatagtcatattcatcctagtagttactatgatgcatgtctgaaagtattaaaacraaactttaccaaacatggctgggtgcagtggctcatgcctgaaatcccagcaatttgggaggctgaggcaggagggatcacttgagttcaagagtttgagatcagcaacacccatctctactaaagaatacaaaaattagctgggcatggtggcacacacctgtaatcccagctactcgggtggctgaggcacgagaatygcttgaacctgggaggcagtgagccgagattgtgccactgcactccagcctgggcgacagagtgagactgtctcaaaaaacaaaaaacaacaataaaaaagaccccacaaaactctaccagacaacttaattcattattgcccatcaaaactttgtaatcaaaccaccatgagctcctacaagtctcattaagagatccaataaatttttactttttatgtttaaaaattattatcaaactgtatatttatcttgttttgatttattgaataccgatgttggcaattacttaaaatttttcgttaagaggatacagaatcagtcaaaatttttatcactggttcacaaaaagggctaaaagccattggtatatatgatttgtttaatgcgtggttctcaaatgacacttccatggaacatttgtgttttgtcttctgtgcatgtctgtcctgccacagaaattgaacagtggtggtgctttctcaattcacagaagaagtcaaaamagttttgcagttttgactcctaaatctttggtacctgctaccctcatgtcctcgaacaacttgcagcagttgatgaaataatagggagcaaatcaacattaacagagagattcagaaagaatgacacatctttagttcagcactaaatttgattatggacacatcctcctagtggtagtattattatatgttattatatgatactgttctctgctagtaaaaatgttcccaattcaaatttggagttaaataaatcaacatttcttgattgtttcatgaaaagggcaaatggtgaacaatctaaacacattaagaggtgttcatttaatgtataacgtgtaaaagatttgtgcaaagagaggttgtgatgttaaaacttgctgaatgtgaaattttcatttaaataaatatccaaggataaacagaaagtaaaagaaagagttctttttctgatttaaggctgaacatactcatgtagttttgcatccaaaagtggtcttcctttggcagaaaatatacttttcgagtgaatgtgaattctatatttaaaagctactccttctttcctcagagcctctatcgtcaggccatggaagaagccaagaaagaaggctatgacttgagaagtgatgccattcccattgtggctgccaaggcctctcgggatattgccagtgatgtaagagctgatcaagtcctaacatttcttaccatcatgccagccacacagaatacagctggatgtctctttggtcatcatccaccttaactcccttcagtgcataggcaaatatactgagggttgagatacagataacttgcccaagatcacaagcatcacagaggcatagcctagactggaatgtggctcatttgactccttatttttgatctttgctcaataggagtgagtgcctcgattaaagctagatgtgtgtatgctgagctactcacaaaacctcaggaacttccttggaacacactcaaggcaaagatgccagaaaagaagcaggcttaactgagtttgccccatcacttgaaaatgaacatggaaagacaaagtcttctttctatgtggtgcacagaaccaatatttctttaccctaaaaatgaaaacatcagattccctggacatcttaaaaattaatccaagagtagtaaaattgttcatttttataggtttttaaatgtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcttgtaaaacttaaactctctacctattaaataacagaaattgtccattttaaaactatttctcccaaatcaattgtgaagaggaaattacttctcagactatgctagaaaattttaatgatccatgtaaacatacgccccaggtgtgttcttaaataggctcactcacatgatggatttctgagacaccatcatggtttattactgtaattggactcttcatttcagtattcactttttatcattttttgccaacatatgattctctagcatatataaaggaaccattgtggggttattctgtggacatgtgccaatgagcacaacagtccaatatgtggcgttacagcagcatgaccagtgaaactcctctgttgccttaaagatttcatagaaagcaccaccacagaaagaacaacagggaatagccctttgtgcttccttcttatttactggattctctctttcagtacaaatacaaagaagcatatcgtaaacagttgggtcaccacattggcgcccgagcagtacacgatgaccccaagataatgtggtccctccacattgccaaagtgcagagtgaccgtgagtacaagaaagattttgagaaatacaaracaaggtacagcagcccagtggacatgcttggtatcgttttggccaagaagtgtcagaccttggtcagcgatgtggactataaacatcctctgcatgaatggatctgcctgcccgaccagaatgacatcattcatgcacggaaagcctatgacctccagagtgacgtaagtttccttgatgttagctctgcatgttaaaagcggatctgaaacgtgtctgtgagttctgactagtgccaatgaannnnnnnnnnnnnnnnnnnntgtctgtgagttctgactagtgccaatgaactgcaatttgtttgtatatttcaaacaatttacaattaaatgtctgaaaggagtttcccattggaggtactacaatttgttttcttctccaaaagttctctgtaggagaggaaacaaagtaaatattatcagttctaaacaggtataaatcttcctagggattcaggcttcctttgtttgaatcagatgaaacttagcccttaaaaatatatcactgcaaacttttggctaaggaagtaaaaaaatgtgtgtgtttgttggcagagggcagtagggagatagagggaaagcatattatgctaaattactttaatttacattttatacttactgatgggaaaattctatcattcttacgtttttcgaaaccagtcgtctaatacttatcaacattcagcatgtcctattgagagtaaaataaaatgaataattaaggaaataccaaacatatctctgtaacatcacatttcctttatacacttgaagttttgtgatttttgaagatggaaataaaagtgagaattttttgactgcagtactcacgcaccatcagtctcagtgtgtggttttatttggagctattagactacattttccaaggctaaaaaagcatgcttctctgtaaaaatcttgtaatactgtcataggcaggaccatgtcttttactttaaaagaagatcttttatcattcttgctgtactcctctgtaccaaaaaaacgctcagaaaaaaaaatacacttaggattcaataatgtgcgtgagtgagtgaatgactatgctaggaaccttaactattcatcggtatttttgtgtttctctaggataacccattttgtaactatgaatctgaaacactaattaataaatctgtttcttatctgttgatctgcagaatttgtataagtcagaccttgaatggatgaaaggcattggctgggttccgattgattccttggaagttgttagggccaagagagctggagaattacttagtgatactatctaccgtcagcgtccagaaacgctgaaatttaccagtataacggacactccggagcaggtgctggcaaaaaacaatgctttaaacatgaataaggtgagtcttcaatcctcactgttagataccgaaagttaccacagaacaatttaaaaattctgatatattattgcattttaaagataataataagcattatgataccttcttaaatgatttttccactataataccatagttacttagtgatacttcaaaatattaaaccattgttaaaagtactgtgtgctttgtttgtttgttttgtttttgagactannnnnnnnnnnnnnnnnnnnnnnnnnnnnnnnnnnnnnnnnnnnnnnnnnncactgcaacctccacctcctgggttcaagcaattctcttgcctcagcctcccaagtagctgggattacaggagcctgccaccacacccagcaaatttttgtattttcagtagagacagggtttcaccatgttgaaggctggtctcaaactcctgagctcaggtgatccacccatctcggcctcccaaagtgctgggattacaggtgtaagccaccgtgcccagcctaaagtactgtgtgcttctgattggattagtaggttgtcaaaaaaaaaaaaatactgtgtgctataactctttcctataaattattttaaatacttcaatccaattatacttttcataaccgataagtcctttaacagattattgaaagaattttaataagaaacaaaggtaaggaatttatgcagctttaataattttatttctaccttgtatacaagagagatgactggcacataatcaaaacaataatatctgtgaacaccaaaataatttttctctctctctctctctyttttttttttttttgtagcgcttatatactgaagcctgggacaatgacaagaaaactattcatgtcatgcctgatacaccagaaatcatgttagccaaactcaaccgaataaactacagtgatgtaagtaaactgttgatcttgtaatgaacagaaaggcaaaaatgaaccactgtagctgtttccttaggaaaaggttttgactaatttactacacatactacaaactaccattttcagtagaagagatagttctcacttgattcaattttgagctttgtggtgggtccacaaagtaggctaccattttattaacaggttatcaggaattgaatgattatgaataaatatttccataggaattatacttttaaaaccttcccctacaggtcactgtgggtatcaagtcattattttattcagcagctagcaagtaggcaaggactgggttggaatctgatgagttagtaagccgcatattattttgctgctccagtatgctctgataatcatttgatgttaacatttttccaggcatttctgccagaaccaacattttcaaaagggcaatgatcctgaaatcccaggtccatakatgaatcattgtccgagataatagtccacagcaaaataagaaaaaataagcacaatgcattgagtttttcataaaacagaatagagtacattttaaaatattgtccttgttttttattcttcttttgtgttaagatgctgtgtcttttatattatgatgacaataataaatactgttttgttttgttttgttacgtttgagacatagtttcactctgtcacccaggctggagtgcagtggcacaattttggttcactgcaacctccgcctcctgggttcaagcaattctcctgcctcagcctcccgagtaactgggattgcaggtgcatgctaccatgcccagttaattattgtatttttagtggagacgggatttcaccatgttggccaggctggtctcttctcaaactcatgacctcaggtgatccacccatctcagcctcccaaagtgctgggattacaggcgtgagccaccacgcccggccagtaaataatttttttttttacatctgcttgtttggcaaataaaattttgccaaccaaatgttgattttttccccacatttttttgttgaaatttacaagtcagtaaaatcccaatgtttggaacatgtgccttaaaaatcctaagcacccatgaggcaaagctatctataaacccaccctaatgattgactttgtgaattatttctgaagtttaaatgaggacaaagaaaaactaataatgaacagcttcactttttatggaaggagtaaatgagtaatgactttcttttctacagaaactctataaacttgctttggaagagtccaagaaggaaggctatgacttgcgtctggatgccattccaatccaagcagccaaggcttcaagagatattgctagtgatgtaagtggatgttttggaaaagccatttcttattcaaagatgttgacaaatagaagcttttagagtttttcttgctagaaatttagttacccctataartctcaattccctttagtgattttcccctatacaaaattgtaaatggaaaaaaagaaaagcacaaaattctagacccattatacccatcaatcaatcaaaactagagacatactattttttaaaaagtgttttacggacaccaaaaatgggttcatatttttgagcttcagaaattgaacactccgtcttcaaaaaaaataaataaataattgagcagcagttgacctagatgtttgtgaaattaaagggattaatttattccctttaaataatatgtgagaaacagccaatatacatgtaaactcttccttactacttctatttattcttgcattaaaagaaaactagatggatatgtcttagagatttgttttgtcctttgtaactcctaattggtgagatgtccctcaccggacacaagaacaagtggcaaagtaagcagagctttttctcagtacccgcttgcctcttctctactccttttcttcacatgsgaaacacctcctaagggtggccagtgtcctcattctgtaacaagcctccttaggactcaaatccagactttccctcttctggaagggcctcatgccttagacatatgtttcatttcttctgtaaactaaaaagtatctgaaacagatctcaatcaatttagaagtttattttgccaaggttaaggacacacaccgtattatcaaaacttttcttgctgttaagctggagaagcccacaccatggtagaatggaccataatgcgttattctggaatcttcaaggtagataaactgactcatagtgaaagttcagtgatgttgacaggctgataagagagccatttcctggtgacacataaactctatctaaatgtaacacatatccttgactgagaagtctattataagttctaataagggaactattctaaaatattcttaatgtcaaacagttttgggaaaataactgttattttccatcagattgttatgctccatcagattgtacaatatatttacctctacttgttaaggaatcaaatgtaaactgagcagtgtggtataataaggaggaaaaatattaggaatgagaagctcttcattctaggctcatgctgccacctgcttgtggtgtgactgcgcaaatcactcaacccctgctaggttcaggttttgacttttaaaaatagggttgatgatactcacttttctccttcatgatagtgttggggaaaagaaaaagaaacaatgtgaatgtgaacctatgaaacatgattatataagatgttcttgtcattatactcatatctctatttttttagtacaagtacaaggaaggctaccgcaaacagcttggccaccatattggggcccggaacattaaggatgacccgaagatgatgtggtccatccatgtggccaagatccagagtgacagggagtacaagaaggagtttgagaagtggaagaccaagttcagcagcccagtggacatgctgggggtggtgctggccaagaagtgtcagatccttgtaagcgacatagactacaagcatcccctgcatgaatggacctgcctgcctgatcagaatgacgtcattcaggctcggaaggcctatgacctgcagagtgatgtgagtggctctaatattcttcagtaatggtttagaaaagcattctaactcttttgtgccatggaatctttccacagtctggtgaaacctacagacacctctttaggataatgttctgaaatgcacaaaataaagtatgtatttagtttcagaagaaaccaatcatattgaaatatcattatcaaagtattaaaccaaacctgtaatgtgcttttcattaacacattaagtaaaaaattctagtggtgactgtaataactaatttcaaagaagtgatgagcataaatactttaagacatcagcaacaactctgtactagtctgttctcacagtgctataaagaactacctgagactgggtaatttatgaagaaaagaggtttaattgacttacatttccatgggctgtaccagagcatggctgggaaggcctcaggaaacttacaatcatggtggaaggtgaaggggaagcaggcacatcttcacatggtggagcaggagagagagagcaaagggggaagtgctacacacttttaagcacctggatctcatgagaattcactcactatcacragaacagcaagggggaagtccaatcacctcccaccaggcccctcctccaacattgaggattacaattcaacatgagatctggatgaagatgcagagccaaactatatcaaactataataggacataaaaagatttgagatttctatagctgacaaagtcaggtgtagtgtcaatactgctgtaatatattgcttatacttacaatggataaaatgctatatttcagttagaggttaatgaaaatgaagatgttacatattttttctatccaagttcactgatgccaggttaagaattcctgttctaaacaagctaattttctaaatgaatcaattgcattataattttgtgtctatttaacttataggaagtatctattgtaacttttgaatggaagtttaaaaatgaattatacatatgaagacaaattttctaagaaacttgaaaacaattgttccctakaaatacgttaggcacttttgttgttggccagtagagtcctttggagactcaaatattacctcattgatatcatagctccttgttttaatcaagctctggttaaatcaagcacttttggaagaatgataaaagcagtgacagttaaaaaaagagagattccctgaaagccataaaaacaaaaagaattgttacccttccttacaagaaaaattttccttcaaccagttgtttatattcaaagaagaaaatgaaagaaagaaaaaatgtatttgtttacttgaattctaagacaagaaagaggatggaggataaaataaatatgagtaaagagagatgtactctgtgacttggaagcatgtacatagaagcatacgaaaaagacgtcgtttttatccccaaaaaaacacattaatgcaacgtgatcaaccagtaatgctcatttcttctctatataccaagaagagctatgaaggccactgcctaacaacataggagccaactgtattctcacccagtacagtttccataagaggaggtagggaccatcaaatcagagaataaacactgtttcaggaggcaggcagtaatttccttaaggtggtttttatcactgaaaatgaatagcattaaagagatttttatgagtctttaaaacagtaaatattggctaccttcaggagccaggcatttaactagccattctaaaccaaagtaaagcaatcctgtgggtcttcccagaaatttacacaaataagattcagactaacacattatctgtgtatgttaaatcaggatcaggcaccaggccgtctaggtgacatctataaatatttgacattatttcattttcaggctatttacaaatctgatcttgagtggctgagaggcataggatgggttcccattggctctgtagaggtcgagaaagtgaagagagctggagaaatcctgagtgacaggaagtatcgccagcctgcagrccagctcaaattcacatgcattaccgacactccggaaattgtcctagcaaagaataatgccctgacaatgagcaaggtgagtctccagctgttttctgttgccagaatcataccttccacagatttggctcataaagtaggaaattccctaaggattccctgagaaaggaggtgtcataggcctgattctcatgcaggcctttaacagagcatctgcttgaattcaaggtgtgctcttctcaacaccctgccccctaattctctgtgtgcatgtgggaacagagcctggaatgatttccctggagtgatgcactcacccttctgagcagtgacctggagacatcacaattgcattacccttcctcacacattctcctaggcagagcagattcaggccacttacgtgtctttagccatctggtaaggaatataagccatttacacttcattctgagggctgggatacacatagtgtttcatagcaatgctggtacacattcaaattggttgctcaggttgctcctccacattaggttatggaaatccacttttgaaagctagctgcaatctctgctttcagttttattacacaagatagatgatcatttgtttcatccaaaattttatcaatctatttttatccaatgagtcagcccttaatatgcatattttagactgatttgaacttgaattctcccacacctgcctggaagccttccaatcattaggctagtacaattgagtgctcagtacaaatatgaaagtggcttcagatagcaaactccagagtctggggtatacaactctagaaactcttttatactatatccatcaacagcaaccacaatgataacagcaataggaatcaccaaaaaatcgttgagtatctgctatgacttgggcattttatatatgttatggatcatcttcaaaaaataataaaaaagaatgattatccccctctcagaaatgaggaatgtgaggagttatgtacctttctcaagatcacacagcttggaaatagtagagttgggtttgcacttgggattgactctgaagtctagggatttctactgtctcatagttccataactgagatccatctttggatatctgaataagcttgtgattcagtggatgaaaagaattactaatagcaaccattatattgcttcatattaattatgaaaccattgtacagctatttaaatattgctatgttttactttccccatgactcttttgcttccctcacctcccaaaagcattagaaggagctattttatagttaaatgtgagttaaatttgctaacaactgtaatgatgttattggctttaacagaaggtcttatactccctccctctccccatgccccatgccgccctgccctgtagcatttatacacagaagcttgggatgctgacaaaacctccatccacgtgatgccagacaccccagatatcctgctggccaagagtaattctgccaatatcagccaagtaagagatttcctgattgttgcttaaacctaagattaattaaaatgctttttccaccgtaacaatttcctttctggaattggcctattaccttcctcaaacactcttattttctgtcgtctattatcccttccctagaaactttacaccaagggatgggatgaatcaaagatgaaggactatgatctgagagcagatgctatttccatcaaaagtgccaaggcctccagggacatcgccagtgacgtgagtaccttccatctaactctctgtgrtctccactgtgctgaacaacccagagggtggctggtgaaccacacactctatagtgatttccacatgtaccttccagtcctacttcctacctctcaagaccattccctttgttgttacagagaataaaaatacattttggcattatagttagagttgctgcagggaatgctttcaccaatgaagatatatgattacattacaattatttttaaaacagtataaaacattgcttttaaatataatagttcagagatgccaaaatgtttgtaatataaaatcttgtccatttcatgttgtctgtaattgtcagcacatgagcatggttttaaaactggatgtctccacctgtatttctggcattttagtacaaatacaaggaagcctatgagaaacagaaaggccaccacattggagcccagagcattgaagatgatcccaagattatgtgtgccatacatgcaggaaaaattcaaagtgaaagggagtacaagaaggaattccaaaagtggaaaaccaagttctctagcccagtggacatgttaagcatcttgctggccaagaaatgtcagactttggtcactgacattgattatcgcaattacctgcatgaatggacatgcatgccggatcaaaacgacattatccaagcaaaaaaggcctatgacctgcagagtgatgtacgtaacatgaattttgggaaagggggaaggggaagatgtagatttgttcattgcccagtcagtgcctctgaggacagtcccctgggctgtgcactgcacaaacctsggggtggggctgggggtaccattcacattgtktaatataaaatccatctttagtagtaacttctggcaatgaaaacatatttcagacaaatataaatcatctgaatgtttttaaaataattgttgctattatgctagatccaaaacactaaacagcatttccttgggtcaattgccacaggattaaaatggaatctaattcagcaaaattttcctttaaaaattttcaactataaaattttttgaaatatcaaataattatattatggaattcagctttattactatatatattattattcatggctagtataaataattatgtttttacaagtgacttctgtgatcaatattaaaaaccctcaatcatgtgagatctcaggtcttacttttttggaagtacaatctcctgcacctatcccttcaaccccatgtgctttatttttcagctaaagatttgtatgtctaacacttgaaatgttttttccttttttttttctttttttttgaaatggagtttcactctcattgcccaggctggagtgcagtctccaattgcactccatcccttaaaaaaaatttttttaaatgttagcactcacgacttcaacttatgatcacaaaagggatttccagtgtcacaatgatgtactttcatgttttatttttgctttgccgttgcatgtactcagagtttcagtgctgaaagcctgcaccttgcctctcatacaatctttgcctattttttcattaaatgttgacatttaccttttttttttttttttttttttttgtgagacggaggtttgctcttgttgcccaggctggagtgcaatggcacagtctcggctcactgcaagctctgcctcccgggttcaagcgattctcctgcctcagcctcccaagtagctgggattacaggcatgcgccaccatgcccggctaatttttgtatttttagtagagatggggtttcaccatgttggtcagaaatggtatttttgtctgacatcttctttatagagtgtgtataaggcagacctggagtggctgcgtggcatcggctggatgccagaaggctcagtggaaatgaacagagtgaaggttgctcaagacctcgtgaatgaaagactctataggacacgtccagaagctttgtcattcaccagcattgtcgacactccagaagttgtcttggcaaaagccaattctctgcaaataagtgaggtaagaaccatcctactatcttttccaaagataccacccaaactgagcccgtagactggacttcttcaaagaattttggtgagacgagcaactctaaaaatgtcttcactagtgcagatacactgaaaatagaactctgacaaacaccaacatgcctttcttctaccacacatacacacttttgaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctccaaaaacacaacataaaacttataggatacacgtagagtaatacctagttctcaggttttagtgggccatccatcattgctttttccttgtaaaagccaagcaatatgtttttttctgatttttacatgatttattatctcctaagtttccttcttcaaaaaataattattgggagagagctttactaaatgtcattaaaaatctactggaattcaagctcaatatgaaaccagactctttcataaatcttaaggagacattaatgttcagtgtaactgtaaatatctatttttaaatacatcagtaatgctgactcagtagctccctcttcagactgactgtggcattgcactctctgtttgcagaaacgctatcagcaagcttgggaagatgtcaagatgactggttatgacctgcgagcagatgccattgggatccagcatgccaaggcttccagggatattgccagtgacgtaagagctcctccttcccaaccggaacaaacactaactagtagaaatagagggagtttaacttaatgccctttgaattatatttaaatggaattgggtcattgttattagtatatttgtaaatcctaaattcaagaacaactcttacaatytgaggatccttttgcayctatgtytggttctgcaactcttgcgtttaagcacagattttgattttcttttcaatatcttcacaatgtcacttaatttacaagtacttaaagagatttaatttcatagtacagagaattctgttgttactcaaagtgtggcgtgtatactaccggtgtttcctataataattttatgtagtacatgcacaagtatttttttaaaatagttatatggttgttttaatgtgtgctagaaatacactgtttttttccacgtagatagggttatacatttttaaataaaattttaaaataagtttataattaaaaattatttcaggcaaggcatggtggctcatgcctgtaatcccagcattttgggaggccaaggcgggtggatcacttgaggtcaggagttcgagaccagcctggccaacacggtgaaaccctgtctctactaaaaatacaaaaattagctgggcatggtggcggatgcctgtaatcccagctactggggaggcagaggcaggagaatcacttgaacccaggaggtggagattgcaagtgagccgagatcgtgctactgcactctagcctggggagcagagcgagactctgtctcaaaaaaaaaaagaaaagaaaagtaaaataaaaaaaatttcaacaaagaattaatttgatttaaagtaataagaagtacaactggtacttgtgtgtgacaaaacatctgaaggtggccaggctatattgggagataatccagcaacacagttcttgcctaagagatgctctcaatgttttcatgcatgtagacacagaagacaaaccaatgtatcaaaacttatggcttgaatttaaataaaaacagtattccccgacccccccaaaaaaggtaaactaagggagatggagttagtttgagtaggctctctagaaaaagtgggtttggaaaaattactcttctattttctgttcacatctaccagtatctgtacaaaactgcttatgagaaacagaaaggccattacattggctgtcgcagyrccaaggaagaccctaaactggtttgggcagcaaatgtgttgaagatgcagaatgacaggctgtacaaaaaggcctacaacgaccacaaagcsaagatctccatccctgtggacatggtgtccatcagcgctgccaaagaaggtcaggcactggcaagtgatgtggactatcgccattacctgcaccrctggtcttgctttcccgaccagaatgatgtgatccaagccaggaaagcctacgacctacagagcgaygtaagtgtgtcccccaggaaacaagtcccccattgctttgcctgatggctccttccaatgctctgaaaacacaactctctgtacgtaggcactccactttattattattttatcagaattattaattgcctacctacagccaggtttcttcagaaagttttcattgttaaaggtgctaccagaattttcctatagatttgttaatgtgtacagtgtttccagtttcttactttttttttttttttttttttttttttgagatggagtcttgctctgtcacccaggctggagtgcagtggtgcaatctcagcccactgcaacctccgcctcccaggttcaagcgatgttcctgcatcagcctcccaagtagctgggattacaggcatgtgcaccacacccagctgatttttgtatttttattagagacaggtctttgccatcttggccaggctggttttgaactcctgaccgcaggtgatccacccgtctcagccttccaaagttctgggattacagaagtgagccaccatgcccagccttgcccgcccttccttccttccttccttcattccttccttcgttccttccttctctccttccttccttccttccctccttccttccttccttccctccttctctccttccttccttccttccctccttccctccttgtctctttccctccttccctccttcccttgccctgtggccctggctggagtctcagctcactgcaacctctgcctcccgggttcaagcgattcttctgcctcagcctcccaagtagctgggattacaagcacatgccaccacagtcggctgatttttttattttttagtagaggcagggtttcatcatgttggccaggctggtctcaaacccctgacctcaggtgatccacctgccttggcctcccaaagtgctggggcagtttcttaaacagaagaatgtccatggtccttcagctatgaatcaaagaagggcaggaccatcttcctcaaacttaatttgaaaagttagcagcacrctccagaccacttgtttccttttacttgacgttcttcacaatgtggtctttcattaactcacctaaggcatttttagatttactcgtattttccgcccttcaaacttttggaaatgatggattacagaaggttatttatttcctgtatagaatggataacttaaaaattatctgaccttggttcccttaagcttccagaggtacttttttataatgaatgagttcattacaggaaagcatgctcatcacttaaaatgcattgccaagtggtatatttaagacagtttctggagaccaaaattgtggaagtagtgatcgaattcttaatcatccttttaaaaatacttattaaacacaccatgtgccaggcattgtgctaagcactaaagataccatggtgaataaagaagaagaaaaaacatgacataggctgggcgctgtggctcacacctgtaatctcagcactttggggaggctgaggtgggtggatcacaaggtccagartttcaagatcagcctgaccaacatggtgaaaccctgtctttactaaaaacacaaaaattagcctggcgtggtggcatgtgcctgtaatcccagctacacaggaggctgaggcaggagaatcgtttgaacctaggaggcagaggttgcagtgagccgagattgccactgcactccagcctgggtggcagagtgagactccgtctcaaaggcaaacaaaaaacatgacagctcctgactttagggagttcacattgataaccgagacctagatgttcattaaagaataaaaatggaatggctgagagtgatccatggtgctatgaagagagatcgagaaagttcttctgagaaggcactgattttacagagatatgaaggaagaatagaagttgggttggttaggaggacatggggcattccttcagggtgaccaacatgtgcaaagagggctgatgagactacgaattgaaagacaggctgtgtgatcaggacacacagggccaatggaagtacagatgacacgaggctggaagaataggtggggactggtgccagaccattcatcccttctagtctgtgtcagggattttgatgtttatcctatgaccgatgggaagccataggatgggggaatgttgtgacatcggatttgaattctgaattttgaaaagatcattctggctgctgtgtagagaacttactagaaagcccattattgttgctttaaagtctgcattggtaatggtatgatgataacctaaatattattcagaagtcttccatgcagtccctcaaatggagagctgcttctgcatcactttgccttttagaatgcacatgggcactaccacacagacccttgccacagaaaaccaagcaaaatgaaatgccattgtgcatttgaggaattatgtttgtcaggctagtgctctgttttaattattgtttgtggaagataaaataaaagaggcctggcgtagtggctcatgcctgtaatcccagcattttgggaggccaaggtgggtggatcacctgaggtcaggggtttgagaccagcctggctagcatggtgaaactccgtctctactaaaaaaaatacaaaaattagacaggcatcatggcacgtgcctgtagtctcaactactcgggaggctgaggcaggagaattgcttgaacttggaaaggggagtttgtagtgagctgagattgtgccattgcactccagcctgggtgacagaatgagactctgtctcaaaaaaaaaaaaaaaaaaaaaaaaaaaaaaaaatatatatatatatatatatatatatatatatgtatttatgttatatatattttatgttgtatatataatatatacacacacaacataaaaactgtccttattttaccacacacatacacaacaaaacacaaaccctgcttctacctgtgttttctttttcaggccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacacacctgaagtggtccttgctaaatcaaatgctgaaaatattagtattgtgagttagtttttctctattaaaattgaattaatgccataaatagatgagaaagaataaacctggtcatttattttagaataataaaaactttattaataacaaaaattttattaagtaatacagtattgtcttggtttgcttattaattttaagcaaaaactctaataaaagggaataatayagattttatatcaaatttgagtaacttacgtgaaaagattccagaaatctttgccctaacatgaaagggttttggatcaaatccaaaagaaaatttaaaagttgcatagtgggactagcaacatgaaaattgtgaagtaattttattatttttgtttctttccacagccraagtacagagaggtttgggacaaggataaaacttcaatacacataatgccagatactccagaaattaatctcgctagagcaaatgctcttaatgtgagcaatgtaagtactacaacagactctctttttgtttggaaagttacccagtcagggctatactatgagcatggaagggagggaagatggactcggtccctgacttcccgcaacaggggaagactccttgtggtcaccccttgactaggagtgaggcaaggaggagatccctggtgattcactgggcaaggccagttactggtgagtcaatatctccacaacaaaagtctctttagttgtcctttttgaataaggggacaaagaaggtgaaagacgaatgaagagatgcacaaacaagaaaagagaattaacgatagactcagatagactcaaaataattatgagaagtctttgtaaaaatatatgaattaattttaaaacatggacctcggggggttttctagaaaatcataagtgaccaaaattgacccaaggagaaaaaaccaaaaaacatacagcaagaaattaagaggtttcttaattaagaaattaaggagaacatttaaacacttttcttcctactttcaagtgtcagggtccccttgattatttcaaaacttcaataaataaataaattaccaggagcctagtaaaagaaggaaatccattgcaattaccaaaacttttcaaagatagtgtcacaaattaaaaactatagaccagctgggcatggtggctcatgcctataatcccagtactttgggaggtcaaggccagaggattgcttgagcccaggagttcaagactagtctgggcaacatagggagaccccatctctgcaagaaaataaaaaataaataaattagttgggcaaagtgaggtgcacctgtggcccaagttacttgggaggctcaggtgggaggatcacttgagcccaggaggaagaggctgcagtgagccataatcatgccactgcagtccagcctgggtgacagggcaagaccctgtctcaaataaataaataaataaataaataaaatttaaactgtagaccaataatggggggaatcttaaatattaataaatcaaattcagcattacattaaaatgataagatataatcaactggggttcatgcaggaatgccaagagggccccatagtcagagacctaatagtgccatagaacaagaagaaaaggctcattttattagatttacatggcatctgacaaaatccaatacccattcttattttttaaaaataaaatcttagttaagaaagaataaatgaatattttctcaacatgactgaaaaataaatctcaaatcaaaggccaactcatcctcagtgaccaaacttctcattcatatcaggattaaaatgagggtgcccctaatatcatcattatttaacatttgctggaagtattggctaagtgagtgagattctcattgatgctaatataattactcaagagtaagaacatgcctggcgcgatggctcacgcctgtaatcccagcactttgggaggccaaggcaggcgaatcacgaggtcaggagatcgagaccatcctgcctaacacggtgaaaccctgtctctactaaaaatacaaaaaattagctgggcgtggtggtgggtgcctgtagtcccagctactcaggagactgaggcaggagaatggcgtgaaacccaggaggcggagctagcagtaagccgagatcacgccactgtactccagcgtgggcgacagagcgagactctgtcttaaaaaacaaacaaacaaacaaaaaagagtaagaacagaagataaatattggaaagaaagaggccaaattatcattatttgcagaagaagtcattttaagtcttaaaaaagagaatcaactgaggaaaaaaaaaactatttgtgagtacaagataatccagttacgtggctggctacacaattcaagaaagttcaaggaagataccattttcatggatcgcagaaattacttgtgtgtagaatagtatgacctcagaagaagaaggatactaccttagtgcaatttgccaaggcttgaaactttgcatgctttcaaaagaataatatgtctttgtgagagaaggaggctgccagcaaagattcctcaccatgtgccaaacagctctataagttctggtataatgagccacttggggactaatgttttccagtgtttaagaagaaaatataattttagggcgctgatgtattttctcttttggaccagatatcaatatcatggtgcagcgcattcttgtcaagaggctgaatcaaggggtagtcagttcttcactgcagtatagacgcctcttcccactcaatccataggcatctgtggcaggagaattctggaaagtcacatatgctctcttttgcatgataaatttctcagctgaaaacaccagaaccttaccattgatattatatgaacaagactaatattcaaaattatgctaaaagtaaaattattaactttattaagatattaatgagaatgacttccattttggaagaaatcaaacaccccatttgaatgctaaccaaactatacagcattttctttacaartgtatcaccattactgtaatcttgattaaacccacaatttaaaactgctgccgttatttagaaagcacaactttagcagaatatttgtatgtgattttatgggtaacaaagcaaattcacgttaaagtgactcatgtaatcttcatgctcactacattgagtaagatattgttattttgtttttatcagatggtaaattgagatttttaaaagttaagaaattttcccatgttctcaaagttagtagctgaaaacattgggtctcaggccccgggctttttttttttttttttagttaaaaatatatacatacttggctgggcatggtggctcatgcctgtaatcccagcactttgggaggctgaggagggtggatcacttgaggccagagttcgagaccagcctggccaacgtgatgaatgaaaccccatctctactaaaaatacaaaaaatagccaggcatagtggtggctcacctgtaatcccagctacttgggtggctgaggcmcaagaatcgtttgaacctaggaggcagaggttgcagygagctgagatcgtgccacttcactccagcttgggtgacagagcgagactctgtcaaaaaaaaaaaagtatatatatatatacttttatatatatattttatatatatatataaatattcaatatatataaatattcaatatatatattcaatctcataaaaagcattacataagaaatagtgtgaaaatgtgcataataaaatagaatgaaaacaaaaagtaaaaagataacataatacacgtttgcattaactattttgtagtttaattaattaattactttatttatttattttttgagagggagtcttgctctgtcacccaggctggagtacagtggcgtgatctcagcttgctgaaacttctgcctcccgggttcaagcgatgctcctgcctcagcatctctagtagctgggattacaggtgtgtgccaccacacccagctaatttgtgtatttttaatagagacaaggtttcaccatgttggctaggctggtctcaaactcctgacttcaagtgatccacctgcctcggcctcccaaagtgctgggattataggcgtaagccactgcacccagcccttcttgtacattttaatatggagaatattttttcttctgtacagaaaacaagtcagttgtcaaaataggcctactcaaaatttatacaaaagcttgattgaaaattcatataaaacctgtccatgcttacaaggataaaatttgagcactcatttttcagacatgcaaaagctacaaaactgtcactaattaaaatccacttctttctgtgctgtagaagatcccctactgataggtatgatttgtgaattatatgtttaaattactattatttccgagtctctctgttatttgttaatacacaatgtatccattaaaatatgaacatatatttacatacatttttaaaatacttgtaaatcagtcactactttagttaacttctctttacaaccaaaaaaatagctgtgacatccaatcatgcttcagcggaagatctaacattaccaaatgatatggatcattaatcatataagatcaaaaaagccatattgaaaaaaacccacaaatgtaacaagtttacaattctgaaggttacaaaactgaattgaattagagataaataaattgaattattgcattaaagaaattcaataacccattaatgtctaaagttatctcaatgttaccaatacaccaacacaagaaaacaaagccaaaccctttttatgaacgagattataaagcatgagcaactacttcaaggctatcattcaaatttaaaatttattgtacatttgaaaacaactgaaagaatattattggagcactttgggaggccgaggcaggtggatcacctgagggtcaggagtttgagaccagcctgaccaacatggagaaaccctgtctctactaaaaatacaaaattagctgggcctggtggcgcatgcctgtaatcccagctactcgggaggctgaggaaggagaatggcttgagcctgggaggcagagtttggggtgagccgagatggtgccattgccctccagcctgggcaacaagagcgaaactccgtctcaaaaaaaaagaaaaagagtataattggaatgtttatgacacagacatgataaatgcttgaggtggtggatacccagttatcctcatgtgactattacccattgtatgcctatattaaaatatctcatgcaccctataaatatgtatatacctactatgtacccataaaaataaaatataaaacattaaaaataataaaaacaaaagaaaggagattgtcaagcccagacctttggactccagacaccattacatgttccaggacaatggtgcatagaatgattctcayctatgctcttctttaactgctctcaagtccttgggcttcaaaactgtgcccctgtggtattaattccacctgagccattgaaggtattggcaaatttgaatctaggatgataccttatttttctccttttcagaaactttaccgtgagggctgggatgaaatgaaggcgggctgtgatgtccggctggatgccatccccatccaggctgccaaggcctccagggagattgccagtgacgtgagtggccttttttaacttctcagtttttttttttcagccgatgccctaggtgcatcaagaggacatgctgtgacccatctgctttatttttgcatctccagtataaatataagcttgaccatgagaagcagaagggacactacgtgggcaccctcacagccagggatgacaacaagatccgctgggccctcatagctgacaagctccagaatgaacgagagtaccggctggactgggccaaatggaaggccaagatccagagccctgtggacatgctttccatcctrcactctaaaaattcccaggctctggtcagtgacatggattaccgcaattacctgcaccagtggacctgcatgcccgaccagaacgatgtgattcaggccaagaaggcctacgaactgcagagcgatgtgagtgggctgcatttggggttgaactcttwtctcagtttgccatgacttccagagagtttatgacactaaccccttctgtcatcattttacgacttcatatcaccaagaatttaatattagtgagaccttatagtatggtatcaaaatcaccaaatccaagaaggacctggactttatatcaagaaataaatggtagtatgaatacaggtcttaattgtatcagattaaagaaaactgtgaaartattctttctatagaatttagatagcaatagaggcttatatccagtaaaatattggcagcccatggacaggatgtaggcacagacatgcttttttaattgatacagtgtttagaaattttgaattaagttgccaagattttaaaatccaaaawtttttgtgtacaaatgtcggatttcccatttctcttggaaattcagaggacacagctctgaattatcccttagtaacaataaccagaatggaatcaaggataaccccctttaaataaaaatatatgctatcgtttgtcacactgcctggccgcctaattaattttcttacattacctgcgtggctgcttgagtatgtcctccttggcttatatagcatttacattgtatttcttcatgagaccaatggataggctaactaggaccacatgaccagggttgctgaactcattctggccctgttttcacagaatgtttacaaggctgacttggaatggttgcgtggaattgggtggatgccaaatgactccgtgtccgtcaatcatgccaaacatgccgcggacatcttcagtgaggtattccaagattttaccctgacattcagtacatttcccaagaaagtgacaaaatgcacaagctaaaatatagtcatctaatatcagcartcttaaccatttcaattgctgtgatttaaactgagcatatatatttttcaaaatgtactgtcgctatcacattatgggaccacatccataatataatatccagcacactcactgatgcttggcattgtataaatggaaaaatctttttgtcagcaatagcaatatacttgggaaaagtttgtttcgttggaaaaatgtgcattacagtacacataatgatacattatataactttgagagctaagcaaacttcctactttaaaatctgtgggaggcataagaagctgatgcatttgtttaaaaaataaaatgctaaaaagaaagccaaattcccaagaagacgctattcaaatacggcactgtatgtttctagtagagaaggactctaaatttagtgtatcttctcagttcacacatgtctaggaattacaactatctaaaagatgctttctttcccatagaaaaaatatcgcacaaaaatagaaactctcaactttacgcctgtggatgacagagttgattatgtgacagcgaaacaaagtggcgagatcctcgatgatgtaagtatatggctgttttaaaatctcacagtgatgcagatatcacttccaaagcttttccatctacttacactcagaatgcaatcatctgaaatacagattttaatcattgaaatgatggatgctaacaattgcttggacaacatgatgctttcttaacaagtaacttgcccccttgcctctcatttttttttttttagattaaataccggaaagactggaatgccaccaaatcaaagtacaccctcacagaaacccccctgctgcacactgcccaggaggctgctaggatactggaccaggtatgggtttcacccacatgcctggtgtttgtgtacgagtggagggccttaatggaactgtaggataattatgcacacaacttacccctcccttctgactcctcattttaaccctttatggtggctctgtctttcagtatctctacaaggaaggctgggagagacaaaaagccacaggttacattttgcctccagatgctgtgccatttgttcatgcccatcactgcaatgacgttcagagtgaggtaatacatcctgatgggagtgcattttgcaaaagtgggaccttgctcccagggattccagttatgccraaggcagagatagcaccttccaggtgttcagtttcagtgtggcagacctggccaggcttggtgatggttggagtacctgctcacttttcggtctttcttccatgggctttgagctttcttgtttcttcacccgcccaccaccccccttggcttttttaaaagcaattgttcaaattctttactttttcttatattctctgccctccctaaaatctttaggcctttgaataaaaatattgccagaatcagagaacaagtatatattttttctctatttttattttttaaattttatttttatcatttttagggctatctcagcagaatatttttctatttttaaatgggtgtttcttcatatggatttatttcaatgctttttattatttgctctcagagttgggggtgtcaaacaaaaagctggggggctgaatttgctgatatcccttagtagatgatcaagccccctctgccttgtgtgcttgtcaaaactgatggaatttatattcctcttctcgccagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgatatggtgtcagtcttggccgccaagcaggggcagacccttgtcagtgatattgattatcgtaattacttgcaccaatggatgtgtcatcctgaccagaacgatgttattcaggcaagaaaggcctatgacctacagagtgatgtaagtgatttttgtttcttcattatctagaaaygcatggtacactctgagaatgatgagcaacatcccagatccayaagtgcttgaaatttgaggccatcgatatttaatttgttcccaaagggaattgaggctggatatgaagaaagatcaggagcagtgatggattgattggtttgcctactgactgcatttctgagtaactttcaatcaaatttttttwaaaaaaatctgctgcttttgtaccattttggccatcagcaactcctcactcacattcacatagaaaagtatcagctgatggaaaataataattggcttgggtgggaattgagaatgagttgaggttttgacaatattagatgatagcacagttaaagacctaagcatgccctattcctgctttgccaagcatctcattcctcacggcatttatgaagttgttcgcaaagcaaaagagaaacaaaatactgattaagctgcatgagggcccagtatgcctcatgcagagctttggtaaagctaggatagagaataagacataacctacctcccactgaagcctgaatcaagatctctacttgccaccagccttctgcatgtgcagaacagtaactggatgcatcaacttagttgcttaggtgcccagagaagctaatgctccctgggtcttctcatcattaacaaaagggaacctggaagtcaaagactgctgcagcatagatgttgaacttgaacatctgacctcactggttgctgcagcaaaatagctgttgtggaacttaaatcagaatagcaactcttcttattttcatgtcgagttggctgggagaatctaggttcttgaaggcgtaagggcaagaataggtttggctgggacccaggggatgcctcccctacccaatacgtgaatatttacttgtgtagtttccctcatttagtctaaatgccccacatacttctacgtgactaaatgtatcaaatccatctaaaagtacaacctccttggtaagccttttcttatgacgatagcagaaaataacagccccttcccctcaactccaatagcatttgagcactcgatctaacagcacttcttgctttataaatgacttatctcaactcctagactccttctttatacttattcatcaaaacaccaagcatagtgcctcatgcacagtaacagcctcaagaaatattgctcaggtgaaatcacaattgaatgaatgagaaaactactagagagaaatcctttaaaagcttctgaaaaaattgtaacctgccctctgtaagcctgtgtctcagtcatttattcctccattatatctctcttcctgctctcagaatgtctacagagctgacctggagtggctccgaggcattggctggatcccactggattctgtggaccatgtaagggttactaagaaccaggaaatgatgagtcaggtacgcaaagcctattctccttctaacctatgcctgtcctcctacctgccatgttggggtagataacctgtggtggtagacctgtcttaattgtctccgtttctttacagatcaaatataagaaaaatgcccttgaaaactaycctaactttasaagtgtggtggatcctccagagattgttttagccaagattaattctgtcaatcaaagtgatgtaagtttgctttgtgcatgctgaagtgcacagactggggagtaaattgtctatcattgggtggattagcttaacttyagataattgcttgtaaaaaaattgggaggtggtaaattctaagatcatctttggggggtatgtcttaaaagtcactagcaggtggtgaattgtattcacttttagatatctatattcctatccaaattattctattgttttagctaaaatgggctaaaattcaaccagttggttagttttaatctttaaacgtggactgattatgtttctaggtaatcttataaaaatttaatattcatttatagtaataaaagatttggttttctctccttaggtaaaatataaagaaacatttaataaagcaaagggcaaatatacgttttcaccagatacaccacrtatctcccactccaaagacatgggaaaactctacagtactgtaagttctcttttatgtaataaccactcaatttctaatttgaagctcttgttgcattcatattcttggctgattttgtcaactgctgaacttataagccaatctattatttattttcccattgcacttagtcttgtgtattagaagtaccatgttattcaaggcaaatagcgtttattcagctggtgcttttgagctccygtgatgtgccgggctctttaggaggcaatgaggggctaaagctcaatgagacaagccttcaggagatcgtgcaagtgaggggaacagacttaaattgatagaataataatctaacaagtgctctgggggcacatagcattgagcacctaccaatagagaaaagggaggtaaggttggtccctctttagtaatcacgcatcagcatctctagccaacaagaggagaacttgccctccaaaatttcattcagctaatttaaaggagaccaatagtgtacatgtgtgcacccaatgggaaagaatatttgccagttctctccctgtgtgcaaatttgttgtcacttttactaggaccgcaaaaatagtcaactcttataaaatgcctagagttggctgggcatggtggctcacgcctataatcccagcactttgggagggtgaggttggtagatcacctgaggtcaggagttagaccagcttggccaacacggtgaaaccccatctctactaaaaatacaaaaattagccaggcatagtggtgcgtgcgtgtaatcccagctactctggaggctgagacaggagaatctcttgaacccaggaggtagagtttgcagtgagcttagatcacggcactgcactccagcctgggtgatggagcaagattctgtctcaaaaaacataaaaataaaataaaataaaataaaataaaaaataaaatgcctcgagtctgtaagtttaatttgcaataaaccaaataactgccctattctaggtagatgcactaatggctatagataaagatttcagccttgccttgaacatacatgtttcaccttaattagaccaattgttttagtggtatctgaaagaagttgaaagaaaacttttgttgccatgtatttctttgttctagatactgtataaaggggcgtgggagggcaccaaggcctatggctacaccctgratgagcgctacattcccattgttggagccaagcatgctgatctggtgaacagtgaggtcagtatgaccttttcctctcctaagtttgagagtctttactggggatcaaggggctggttaggaaactccagcgattctcaatgtttaacccactttacagcttaaatacaaagagacatatgagaagcagaaaggtcactacctggctggaaaagtgatcggtgaattccctgrtgtggttcactgtctggatttccaaaagatgaggagtgcggtaagtaaatgtccactttaacacgggatttgtgccccataagtgtgctgccrtgtctgcctgtttataacttgccctttggttcaggttagctgggaaatggagtagcgtagggtccttcctgagattttcctcacccctccaagtcagcctgtggactcttggtagctgtgtgcttcctccctgccactttctccctgactatttaacactgtgactgctttgtgttcagaaaaggaaaaagcatcaaggtcactatttaccctgtgttataaaaggatggaaaacttcaggccaggtgaaatggctcacacctgtaatcccagcactttggaggccaaggcaggcagatcaccagaggtcaggagttcgagactggcctggccaacatggtgaaacctcatctctactaaaaatacaaaaattagctgggcgtggtggtgcatgcctgtaattctagttactctggatgctgaggcatgagaattatttgaacccaggaggcagaggttgcagtgagtggagatcacaccattgcaatccagtctgggcaacagagtaggacaccatctcaaaaaaaaaaaaaaaaaaaaagatgggaaatttcaaaagaagaagaatatattaaagtatataaagtatatatatataaagtataaagaatataataaagtatatattaaccttagtttattctagagatactgatctatatgggaaataaggatctaaaagacattgatctgaataatttacatttaaacccctttcttatttttgtctttaaaacatattagttgaactacagaaaacattatgaggataccaaagcaaatgttcatatccccaatgacatgatgaatcacgtgctggctaaaaggtgccagtacatcctcagtgacctggagtatcgacactatttccaccagtggacgtctcttctggaagaacccaatgttatacgcgtccgaaacgcccaggagatcttgagtgatgtatgatgtcccttctgcagcttgactcagctacagcttccatgactgtgtcttggctaccccccaaccctggctgccatgctcccrttgtccctgtattcataaatcttgctgcttctcaaaacaaagtggcatgagccactttttggtataagaatccaccctaagccataggacacatatgttaaatatttaattggtttcacratagactcagacattgatattgctctcaagcttctttaggcttgggaattaaagaccttccagctggtgagaggcctaccctatgtcttctaagcaataagcacagccaacrgctgataggaaattatcaaatgctcaattgtaaattcagaataccttccacatttcattgttctctctttcttgcagaatgtgtataaagatgacctgaattggttgaaaggcattggttgctacgtttgggatacaccccaaatcctccatgccaagaaatcatacgaccttcagagtcaggtgagccaccttcctagaaggactggttctccatgggtcatcrgaatccatggtggtgtcagtgggctgatgggcaggcaaagaaagttgctgtaacagtgtaggctctaactgaccaaagcccctcctctcccartcaaagctcttctagtgtcctgctctggggctggatcttcccagtctgagtctctcctttggtttaaggcaatgcacatttataataaaagcttatctgggaggtgtttcttagtgaactactctcaagcatctgtaccttagttgatcaagttaacttgcagagagtaggaggtagaagcatcctttgattacaggtagataagttttggaggaaaaagatcagtatctggaaaacttttcagcacgtggttcagctctgatagggcagttgtaatggaatgttaaaagtgaggggcatgtatacatatgtaactaacctgcacattgtgcacatgtaccctaaaacttaaagtataataataaaaaaaaaaaagtgttcgaaaccaaaaaaaaaaaaaagtgaggggctgctgtcagggatggagaataggcatggaaaaggcaacaaaatggccaaaatctcraccccagtctcagtcaagagaarctattcattctggcagccatacaaagtctgcaggactctagaatgacagcctgtttgttaggattaaagcagaaatccagaaataaaggcacatgtaagttggcacaagcagctacagctgatgacagacctgtatgttaccatttttgatgacttttgtttytcttcacagctacaatatacagcagcaggtaaagaaaatctacaaaactataatctggtcacagacacgcccctctatgtgactgctgttcagagtggcattaatgccagtgaggtgcgtcttcctgtactcctcttccagggacaaactatttyttgtctttatgtattttctaacaacagaggtgaataacctattgttgcttgtytacaggtaaaatataaagaaaattatcatcagattaaggacaaatacacaacagttctagaaacagtggattatgacagaaccagaaacctgaagaatctttacagcagtgtgagttgagttttttttcccccttatatatgagccacctttcccmcttctgggacagtaagagaataaatgggatggacactctttccctaaaggcttttctatggttttttcctggaccttcaatcttactttacctcataaaattctagtaggtacaattaaataagccccaccttaaagaggagtcctgggagttagtagggagtgtgtgagaaggacagacacagaaggaaaacctgctactcagaagctaaccagatgcattttcccatattcacaagaaggtctttaattcctgcagaacctgtacaaggaggcctgggatagagtgaaagccaccagctacatcctgccttccagcaccttgtccctgacacacgccaagaaccagaagcatctggccagccatgtaagtaaagcaaaaacatgacagctttcccaccctccctcycctcccctgctctccactccaagaatctttcaggctgattcatacgttgtccagaagtacccctagcactcccgtgggcatgtccaggaaataattccaaatgctcagtcattagagtctatgtgctcactrcctgtctctctctgctgcctggagagaatcacaagcacttgcaaagaggacaggatgtgacctttcagactgcctgtctgcacatgataatctctgctagagtcagaagtaaggatgggctgaagacataatacaccttacagaaatagactttttcaatagaattacatggatgtagggcaaaaataaaccagtgaatatgataaccggttattataccatccccagttaatataaattattttatagcaatgaaatagaaaacatttaaaaattgtttaattctccttttttaggtagaacttttcttagatataaacataattgtaaaacaaacaaaccctaaatctcatgagctgtttaaatatagtagaagatcatacatcctctaactctttatgcctttaaatcttatgacctctaaccattaatgttcttaagtaaaacctttttgcgtgtgtgtgttttgttttggtttattatactttaagttctggggtacacgtgcagaacgtggaggtttattacataggtatacatatgccatggtggtttgctgcacccatcaacccatcatctacattaggtatttctcctaatgctatccctcccctagccccctactccctgagaggacccagtgtgtgatgttcccctccctgtgtccatgtgttctcactgttcaacccccacttacgagtgagaacatgcagtgtttggttttctgttcttgtgttagtttgctgagaatgatggtttaaaacttcatccatgtccctgcaaaggacatgaactcatcttttttatggctgcatagtattccatggtgtatatatgccatattttctttatccagtctatcattgatgggcatttgggttggttccaagactttgctatggtgaagagtgctgcaataaacatacgtgtgcatgtgtctttatagtagaatgatttataatccattgggtatatacccagtaatgggattgctgggtcaaatggtatttctagttctagatccttgaggaatcaccacactgtcttccacaatggttgaactagtttacactcccaccaacagtgtaaaagtcttcctatttctttacatcctctccagcatctgttgtttcctgactttgtaatgatcaccattctaactggcgtgagatggtatctcattgtggttttgatttgcatttctctaatgaccagtgatgatgagcattttttcatatatttgttggccgcataaatgtcttcttttgagaagtgtctgttcatatccttcrcctactttttgatggggttgtttgtttttttcttgtaaatttgtttaagttctttgtagattctggatagtagcccattgtcagatggatagattgcagaaattttttcccattctgtaggttgccttttcactctgatagtagtttcttttgctgtgcagaagttctttagtttaattagattccaatggcctttgttgccattgcttttggtgtttcagtcatgaagtgtttgcccatgcctrtgtcctgaaaggtattgcctaggttttcttctggggtttttatggttttaggtcttatgtgtacatttttagtccatcttgagttaatttttgtatgaggtgtaaggaagggatccagtttcagctttctgcatatggctagccagttttcccagcaccattcattaaatagggagtcttctccccatcgcttgtttttgtcagatttgtcaaagatcagatgattgtagatatgtggcgttgtttctgaggcctctgttctgttccattggtctatatatctgttttggtaaaagtaccatggtgtttttattactttagccttgtagtatagtttgaagtcagatagcgtaatgcctccagctttaattttttccaattctgtgaaaaaagtcaatggtagcttgatggggatagcattgaatctatagattaccttgggcagtatggctattttcacgatattgagtcttcctatccatgagcatagaatgtttttccatttgttcgtgtcctctcttagttccttgagcagtggtttgtagttctccttgaagaggtccttcagatcccttgtaagttggattcctaggtattttattatctttgtagcagttgtgaatgggagttcactcatgatttggctctctgttttttactggtatataggaatgcttgtgatttttgcacattgattttgtattctgagactttgctgaagttgcttatcagcttaaggagattttgggctgagacggttgggttttctaaatatataatcaggccatctgcaaacagagacaatttgacttcctcttttcctaattgaataccgtttatttctttctcttgcctcattgccctggccagaacttccaatactatgttgaataggagtggtgagagagggcatccctgtcttgtgccagttttcaaagggaatgcttccagcttttgcccattcagtatgatattggctgtgggtttgttataaatagctcttactattttgagatacattccatcaatacctagtttattgagagtttttagcatgaagagctgttgaattttgtcaaatgccttttctgtatctattgagataatcatgtggtttttgtccttggttctgtttatgtgatagattacatttattgatttgcatatgttgaaccaggcttgcatcccagtgatgaagctgacttgatcaaggtagataagctttttgatgtgctgctggatttggtttgccaatattttattgagtattttcacatcgatgttcatcagggatattggtctaaaattctcttttttggttgtgtctctgcccggctttggtatcaggatgatgccggcctcataaaatgagttagggaggattctctctttttctgttgtttggaatagtttcagaaggaatggtaccagctcctccttgtacctctggtagaatccaggtgtgaatccatctggtcctggactttttttggctgggaggctattaattactgcctcaatttcagaacttgttattggcctattcagggattcgacttcttcctggtttagtcttgggagggtgtatgtgtccaggaatttatccatttcttctagattttctagtttatttgcatagaggtgtttatagtattctctgatggtagtttgtatttctgtgggaacggtggtgatatcccctttatcattttttattgtgtctatttgattcttctttcttttcttctttattagtcttgctagcagtctatctattttgttgatcttttcaaaaaaacagctcctggattcattgatttttttgaagggttttttgtgtctcaatctccttcagttctgctctgatcttaattatttcttgtcttcttctagcttttgaatttgtttgctcttgcttctctagttcttttaattgtgatgttagggtgtcagttttagatctttcctgctttctcttgtgggcatctagtgctataaatttccctctacacactgctttaaatgtgtcccagagattctgagttcaagtcctgatatccttgttaattttctgtctggttgatctgtctagtgtcgacaggaggtgttaaagtctcccactattattgtgttgcattctaagtctctctgtaggtctccaagaacttgttttatgaatatgcgtgctcctgtgttgggtgtgtatatatttaggatagttagctcttcttctttcattgatccctttcccattatgtaatgcccttctttgtctcttttgatctttgttggtttaaagtctgtgtaaaaccttttattgtaaaattccctgtaagctttattgtaattcttagcccagttctccttcagaaaaattagagactttatctcttaatcaggaacattttctgtaacactttaaatcagcatttctcaaacatgttttgaccatgactcacagtgggaaatttattttttatttcaagttcacatacacagacacacacccctgaagtttacctgagtttcttctggcacaaatgtctcacagaagagtagtgactgctagactagagacagtgcactctgataatttccattctgttctactcatttaaatgctagtgactcagtaaattgatttcactactctactgggcttacagatgcacagcttagaaataaacttcattagacagtctatggaattatttaatttttacctggaggaaacagtaacatatttgattttacccagacccacctctatttggaagattacaaaaaggagcaaacttttcattttggaagaaaagtactatagataagattttaaaagctcaaaagaggctttttccttgagtcatgaacaaaattatagaggcaagattcttggcaaattggttttggagcaaggtaaaacatagagaaattaatcctttaaaagaagtattctgaccttattttaggaaaaagttttgtgtgtgtgtatgtgttttttttttttttaacggtgcctttaaatgccatcatctttgaagctgagaaatagattagatgtaagaagctgattttctgttttggaaaaatctagtggaaattttggttggcctccagtcaatgaagagcattgctggaattctgacacaaatatatactcccatctctcttttgttacagaggtgcaaatcrctgagttttggaagaactgttattttattattgtgtgctatgagattggatcttagtctctgtcttaacctggtttatataatcatggaacactaattaacgggcaacatggcttaagaactaattgttatcccacagaagttgattgcactgtatttttgaaagccttgtagaaactgaaatccaaggattgtgttttcttagcagcagacttttcagttattaaaaacaaagatattcctaagcacagttttaatctygcactccttttagtaagaaaaacaaagccattaccacaagagaatatttttaaattacataatctttaaaatgaattgcttgtagtagcagtaaaagtactagtattgctataggaattttgaaaacagcaactaaaatttcatagcgctctgtggtttaaaagtacttttgatacagtctgatttaagccacacgataaccccatggcaggcgctactgctgtatctctctgtacaggtggggaaatgagttcagagaagtgttgtccccaacgctgggtggatctcagagtcgggtttttcccattaagtcttatgctgttttaataatataaatccattactctctaaaactgtttcttcctttctacttattctctatagatcaaatatcgggaagaatatgaaaagttcaaagctctttatacgttaccaagaagtgttgacgatgatccgaacacagcacggtgcctccgagttggcaagcttaacatcgatgtaagtacggtcatgcgccccttaatgactaggatacattctgagaaatgtgccgctcgttatgtgatttcattgttgtgctaacatcatagagtgcacttccacatacctagatgggatagcctattgctcctagactacaaacctgtacagcatgttactgtactgaatactgtaggcaacagtaacacagtggcaagtatttgtgtatctaaacatagaaaaggtacagtaaaaactcagcattataatcttttgactgaaacattgttatgcaacacatgagggtaactccaaagaccttacttcaaatttaagtcaagtaaaatagccatgtattattaataggaacatttcttttcttttctttttaagacaggtctcactctgttgccctggctggagggcagtggtgcaatcacagctcactgcaagcctctacctcttgggctccgggaatcatcccacctcagcctgctgagtaactgggcctacaggcatgcaccaccacacccagctaaggtttttttttgtagcgattggaatctcgttatgttgcccactctggtctcaaactcctgggctcaagcaattctcctgcctcagtctcccatagtgctgggattacaggtgtgagttatcatgcccagcctgaacattttctatttaccaatgcatatgacactgactgtgcacatgtaaagaagctacayattatttcagctataatgctttattttttaaaaattycccttggtgttaatctatagaaaatgtcagaaaataccagtcactgccctgcccccaactgttcgctgtgagttggttagcctgacttctcatgtatggccatgatgccttggcacaatttcctgtataactggcatgtgattttaactttacagcgcctgtacagatcagtttatgaaaagaacaagatgaaaatccacatcgtgcccgacatggtagagatggttactgccaaggattcccagaagaaagtcagtgagattgattaccgcctgcgcctccacgaatggatttgccaccccgacttgcaagtcaatgatcacgtcaggaaagtcacagatcagatcagcgatgtaagcctgtgacttaagaagtacccctccacggccccgccccacggccccacccagaaggcagcaaactcacccatttctttaccttagcctttttccactatctcttccctatatgtccatttgtccaacttgacttcagagctgtctctggaagcagggctctgtgtacacatgtttctgtggctcccctgagcctctttgcataatgcctttgctcctcattccacaaagccttctgagtctagaatgtacctctgtttttagtgttaaagttattatggtcaattttttttttctgatcctttctatcaaaaccctctagattgtatacaaggatgacctcaactggctgaaaggcattggttgctacgtctgggacactcctgaaatcctccatgccaagcatgcttatgatctacgtgatgatgtgagtttgccttgttttgttctttagtatatttccatttctccatagtctagagttaagaggaggttatgtaaaatagggacattgtcacaggccagctctkgggggtggctgagctggagaaagttgctaggagcagagcaaccatctctcaggaaggcgtatggcattcttattaaactgcagtccaggtgtgccatcgtcctctggtggagaagggaccagcatcttctctttctatgttttaggctattttggatatattaacaagcacttaattgtcattttaggaaagtgtgatttgttagygtttgcaatgctatagacaagctctatttgtaaagagaggattttccacgcaaattaaatactgtaatgaggatttcagtaagaaagcttaaactttcctagaagagtagttatcaagtgtcctagaagactctagaagccccatataagtgttggttacactgttataaaattcaaatgcatctcrgtctgttgagtagtgctgatgaatataaatctcatgagttaaaagcaaccaaaccctctgtgaaaaccagcagtttcaagcataaggaatggtccaacatgggcttgttttcttcctctyggcagatcaagtataaagctcacatgttgaaaacaaggaatgactacaagcttgtcacagatacaccagtctacgtgcaggctgtcaaaagtgggaaacagctaagtgacgtaagtgatcactggggaagttaagtggacagtaataaagcagggccaccactcaagcagaggtggcaaaaaccatagactgggcagtgccaagtcttttctaactgggaaaccagagttggtgcgtttgaaagcactgaagatgctgctggctattgtttcctgaaacctgatgcattcaagcagtttgctggggcggagttgtaggtgatscgagtctatgaagtaactttgtgccttagcacttccaacgtgttttttgtgccctgtgtcatagcaagtttatttctatctaggccatttaataaattagaaccagctatggtagaataagaagcaagcaggctctggagttagagttgtggagtgcagtctcacctctaccacacattatctataaggcttrtgaaaagcacttaatccatctgagcctcccattctgatgcataaaatggggacgtaaggaagcacccactatgacgcctgacacaaagcaggcagggcaggcacaaagctgctctttctttattaactccacaggttggtaagtcaatatcagatcccgccagtgagtgcaaacattgagacctattattttggaacttctagtggtaaaatgcccacccttcctcttcttgtgcctgggccatctcttctgtttctcagtgtgagtgtccacacgctggctctgatcctgttggacaagccacagtaatgtgtcagatgagttctccaggcaaagggaagcaggctaccgttattttttttaaagaggaacctgggttcccattctctttgcttctaacaatgcttctttctgcaccaggctgtctaccactatgactatgtgcacagtgtcagaggcaaagtggctccaactaccaaaaccgtggatctggaccgggcccttcatgcatacaagctccagagttcggtgagcagtgagaacttgagagtgcccagcagaaatccgttccatcagcctctgtggaagcaagctgagcttgcttcctcttgacctgaccttgtataaatgctgttctattcacatgaggtgaaaaaacaaaaacacagagcataatctatctttcctcctagctgccaggatccccctatggagcaatcaaaccaacataatgggcatgttttagcaatatttacaagttacaaagaagaaagccaatatacattctctgctttcaaaaagctgaaaatcaagataacagagacaaggcctttaacctcaataaaagatgaactagaaattgttgctggaattcagaagagaaagaacctggatcccacctgcatatttaacctacctattctatgttacccaatggtgctgatttggtctcaacttttcatgttatttcccatcttgtgtattaaaaataatttttggccaggtgcggtggttcatgcctgtaatcccagcaatttgggaggctgaggcgggcagatcacctgaggtcaggagttcgagaccagcctggccaacatggtgaaaccccatctctactaaaaatacaaaaaattagccagatatggcagtgcatgcctgtaatcccagctacttgggaggctgaggcaggagaatcttttgaacccagggggcggaggttgcagtgagctgagattgcaccactgcactccagcttgggcaacaggagcaaaactccgtttcaaawaataataataataataataataataataataattttggccaggcacagtggctcatgcctgtaatcccagcactttaggaggtcatggcaggcagatggcttgagcctggagttcaagaccagcctgrgcaacatggtgaaaccctgtctgaacaaaaatacaaaaataaataaattagccaggcatagtggcatgcacctgtggtcccagctacttgggaggttgaggtgaaaagattacctcagcccagggaggtcaaggatgcartgaactgtgatggtgccactgcactacagtctgggtgacacagtgagaccctgtctcaaaaataaaataaaaataatttggtttttcatattttaaatgtaattcttaatcctaaactccaagagacagagtatttaagatcacagacagacactcctccatgtcctccctttctgccatgaacacatgcatcctgacctcttcacggcctgatgtcaacacactgtgtttggaaggggcaggagagggtaatacaaacatgtgcctggctatatcttcgtgatggcttgcatatcatcacctgaggatggagtaatggcagaggtgaaacttggttacctatcttctctgcatttcccaaattcttgctagatgccatacagccaactgggcatatgtttggaagcacagaggaattagwgkttttttttttttttttttttttggagacagggtctcctctgtctcccaggctggagtgcaacggtgcaatcacagctcactgcaatctcaaattcctgggctcaagtgatcctcccaccttagcttcttaagtagctgggactacaggtacacgccaccatgcctggctaattttaaaattttttatagaggtgggatcttgctatgttgtccaggctagtctcaacttctgaccttaagcaatcctcctgccttggcctcccaaagtgttgagattacagatgtcagctaccacacctggccaggaactactttcaataaaccatttcactcattgttctatttttccaaaacaataggtgaagagtaatctgactcattttatgactcttagaatgtatttaattctctcctgaaatcaattcagtgagcataagtgtattaagtatctagtcaaaactgtaacatgagctatatgtgatttgttaagctcagatcagttacttgatgccckatgtcatttaacctgctcttcctcattcctgcagaatctatacaaaaccagcctgcgcaccctgcccactggatatagacttccaggtgacactcctcacttcaaacacatcaaggacacccgttacatgagcagttatgtgagtggtctcctcctcattgagatgggtctgaaggtggggtggcaggagactcatattaattaatagcctgttctaatcctccagtctcaccctcaaggttcaacctgatagaatgatgggagctggagaggagagacagcatatttttgagggktgctgtgcaattgattccttctgcaattcagcagtgcctgggtagccccatgggttagaacagaatgttcgtgggagccttggctgagggcccatggctgtcatgatgcctctacttctgctggcctcacttagcacagatgcaccctgaattatcccaagccatttattggaaatgcarcttcacacacgcactactgaggtgtggtgatagtattgtcttccttctgctatgtttcactgcagaagatataacatcaccatgtgttcctttgaaaataagacttcttgcctagctgctggctgatatttagctcactacttatcctctgtgcccagttcacagaaggctagaggggtagttaggctcttactacctgtagcttactcaaatgatgaccctcatgttgcccttctccacttttcacaagtactcaactgggacttgatgcatttaccccatggggaaggcttagggaaatcgtggccatcccagtaagtctggcctgcagaccacaatgagccgctggtggaataataagctctccctctgtgctacccttcatattcctgggaatcaaacctagtggccagaaaggacccaataacctgtggctcaataatgtacttccaaagtagacagtcacagatttaataatctaacacctaaaggatgtgttaaaatggttggttaaaatcagtccacgaagctatttgtcagtcttaaatacattctcttgtttcttctttgtattttctaattttctagccacactggggctaaaaataaagatttttctctggcattttgcataccttccgacaaacagatttcacctaggcaaggtcaaattttattcttttcttggcctggttttattttccaacacataattttcaaggcctggattaatattgaaattttgtcaatgacttttctacatacttaatccttaaaaagagcaatttttcaaataaaggtgacatctcttttctatttggagaaatgtaatgttggtccttgtttacccatcattgatctcattctgactttgcttttgcagttcaagtacaaagaagcctatgaacacaycaaggcatatgggtatacacttggccccaaagatgttccatttgtccacgtccggagagtcaacaatgttaccagcgaggtacctgaatgctgattctccaagagacatattgagtttcaatagcyatggctttgtttgaaatgcattaagaattaatcttatttcagttgtaaacttacataccagcaaaaaatgaaaaaggtccttattgtcacattttgatactgatatttcttggtagtggttttttgtatttggtaatgccttggagagactcggttccatagattatgatgcaaaacttttctaaagaaataatttcttcttttgacatttatattcaaaaatctttaataaggttgcattttagtctgactcatgatcctggttttctacaccaactattggtttgcatatctgatcctactatgcaaccatctgatagaaagtggaaggctttgtgctcagaattcttcacctaaatgaaataactctcattttctccttttttcctaatctcaatcattttctatatcctcgatatttcctcccctcttccttatgtaaaatattttattcttgattagtcagtagatgccctcgtcrtcccctactaaatgcctgtaatgatatttcctccaacgtagagactgtatcgggaattgtaccacaaactgaaagwcaagatccatacaactcccgatacccctgagatccgccaagtcaagaagacacaagaggctgtcagtgaggtgggtattttcttaggaaagacagggagtagagactagggatgaatgttaatcattcggtctctaatacatatgttttggggtatttttttttctttagttgatctacaaatcagacttcttcaagatgcagggccacatgatctctctgccatacacaccccaagtgatccattgccgctatgtgggagacatcaccagtgatgtaagcatctcgtaggggtctttctggagtagtcttaccaagacgcaggcttgctttcagcagttaaaacaaccagtggtctttraacagccttttctgataagcacttctaaacaaagagtacaagttggaggtaagacagtgtgggagaaggatgccacaattctacagctatggaaacagtaataagaggaccacctggggaagacagaattgccatcattcttgatcactcagtgaccaccattctacattcaacayggaatcattccaactcctcactccctaactccctgtgtggcctccatcccaggtcatgttgagtattttcctctcactcatccctactctgacctcattagcaacttcttgctgccatttttttcattctccttgtatgttctctcctcctaaaagaccaatccattcaatctgttcttttctccaatcaatgttatagtaataaaataatagcagtgttctctcctcagctcagggttagagacttaaatgaaaaaaaacatgacttatttgggtgcaagtaaactaagagtacaaggtagatgaactggctgggcacggtggctcacgcctgtaatcccagcactttgggaggctgaggtgggcagatcacctgaggtcaggagttcgagaccagcctggccaacatggtgaaaccctgtctctactaaaaatacaaaaattagccaggcacgatgatgtacgcctgtaatcccagctactagggaggctgaggcaggagaatcgcttgaactcgggaggcggaggttgcagtcagccaagatcttggcattgcactccagcctgggcaacaagaatgaaactctgtctcaaaaaaaaaaaaaaaaaagtagatgaaccaaaatgaaagacacagtaattaagaagtgttgctactccatcttttgtgtttcctgacttacatttgcttatgaccagctatatttctgtgtttgcctctcagattaaatacaaagaggacttgcaggtcctgaagggatttggctgcttcctgtatgacactcctgacatggtccgctcccggcacctgcggaagctctgggtgagtgcacatcatcacaatgcataattaccccccgcacagctggatgcccccatcaccagcctccagggctaggcagaagggatcttagcctgcagctacttttaaggggaaatttatcattaactcacttgagcagattatcayyttaatgtgatctgtgcctcctatgaaaggtgctgagcttagttaaatracaattgtttttgctcctgcctgggaagacatccaggacacatgaaagccctgctcagcttacacatgccagacatttgaaagacaatatgacatgaatcccttaaatgattaatcaacttgtatttctgtttttttttttttttttaagtctaattacctatacactgataaggcaaggaagatgcgagacaaatacaaagtggtgcttgacactccagaatacagaaaagtgcaagaactgaagacacatctgagtgaggtaaggacgctttacttgtcattgaagtcaatcaaattgaccagtacaaactgaattactccacaaggctcttagttcctctagtgatcgctgttcaggcaactgcggcaggtaaaatatttcccctcttaactgtggaatggctactatgtctaagcaagtcaaccaactgcactttacctcagtttacttattttgcccccttttggtaagatacgcatattcatactggctcttcctatgtctagggctgatgaggggttttgcatgattttatagattagaaagacctttctttttctttttttttttgagatggagttttgctcttgttgcccagtctgaagtgcaatggcgcaatctcggctcactgcaacctctgtctcctgggttcatgcgattctcctgcctcagcctccagagtagctgggattacaggcatgtgccaccacgcctggctaattttgtatttttagtagtgatggggtttctccatgttggccaggctggtctcgaactcccaacctcaggtgatccgcccgcctcagccttccaaagtactggaattacaggcgtgagccaccacgcctggcctagaaataataattttacttattatttttgttgtctctaaacttatttcaaaattttctttctctttaattcctgctatcaggagccccgagcatggcagtgccattggagaagtcttcagtggctccytgctctgctgcccattcagtacaattcagactacttagtttcattttcatctggcattgaggctcctgatatattgcagttatttgtgaatagatctgattctctcacctagagtgttggttccttgatgattggaccccatgttatttacatgtgtcccatagtgccttggccataatagatgtgcatgtttgccaaagggcatttcacaagtgtaaatggttgctcttcttataggtcagttggccattctcattctactgtcactctggtattgtagctccattcatcagtttgtgcattcaccattctgtattgtggcttcacccagctgagcattggcttccaggccatttcatccttctcagtagctctgatggctgctgattaggaatcttaggctcttagcgatgccctgaaataccaaatgtcaccctcagtggagggatatgcagcttcctacactcagtgagccagaatcagaggatgactaactcttcagcttttgcaaatgcaacattgagccaatttgctttcctaaaagcttcactgtgttatttcagcccgcactcgcactcagactagaacgcttacgttatttttatcctgctaaagttgtgcttttccactctggctcagtatgagaatcacctgtggaatatttaaaatccacccagagagggccctgaccccttgttccacaccagactgattctccgtgtctgggcatctatacacttttagatgctccatagagattctgtttaataatatgtagcctgtgttgaaaaccaccgcaccacatctctcctccagctaccaagtaataatttaaaacaattggtaacttatagtgcttcagagtaaagataactctgaaatacctttactctttttggctttctgggctcagaattatctaaaactttagtttctcctcttcccarttcccagagggattttgggcaagttgygcatcagcactgaggaagaagaatggatatttttcagtggagcagtttgcaccacatttgcctctccataagaatgacccaggcttgataaaatgctgatccaagccactcccctgaatttagaagggttgggagacagcctacgaatctgtttttaataaaaaccatggagagcgggggagggttaatatcaggaaagtttggaaaacattgagttagtaaaaagtgtgatggccaaaagaagttaccgacttttgagttttcaattgtatagattcttgacatatacacatttgtagtactaggaagcagggacgttgtcccaagaagcataagcaatgcatacctaagtacaggggaaatataatacacagtgaaatgtataattctagaaatggcatagaggccaagcacagtggtacatacctattgtcctagctacttgggaggctgagaccagaggatcactggagtgcaggagtttgaggccagcctgggcaatatagtgagaccccgtctctaaaaatcaatacataaataaaatttaaaaataagaaaaaaattgcttgggagaattgggttttagtcccagatttacttccaattagctatatgatcttatgtaattcacaactttagcaccctaatttcctaaactgaagagttggactaaatgatgatttgagctccttttagccataaaattctaagagttgttgatttactttactcaaaatttagcttggaagaagcattaagttttcatttagtttatctctttcaatagtaacatgaaaaaacagccccaaacacatgagttacattttgttttaacttgcagttgtatataattcagatttaaagaaattgatgtgtgtgcctgtgtttcttacgttttatctgttcaactggtatttatatccatgattagaatttatttggtatccatttgttctttctcatttgccgcattacattaaattccttcaacatttattagcaactattattttttaggccctttgtctgagctctagttgatgaaaggatcgtaccactgaactgctgtgccctagtctcggagaagaaacaggcattggtgtgataaatggctttatataggaacagtcaagacagcatggactcttggagttttccaggcaaataaaagggagaagaacattcaaggcaggaaagacagtctgtgaaagcagccataatgagttccagtaactggggactagtttacatagcacatggagggtgtggaaggatgctggtaaatgaagctattatagaaacatgggttggagccaggttataaagacttgtaggtgttatataaatgaccttggactttatgaaaaatcattgaagaattatttctatgaagaatagatttgagcattaagaaaatatgtgtctcagacttttgaaagatgggtgactcacgtggggtggtccaatagaggagttgagcaggtggttttgacatgtagaaaataagatggaaggctgaactagggcagtggtgttggcaaataatcagatttcaggaatatcacaaagtgaggagcccaggattcatgaccattttgatgtaggaataagggaggagcctaggatgactcccccaagtttctggcccgagtaactgggatatcaacaagtcatttagcaaaatagagaaaataggagaagcagcaatttgagatagagatagaggcaatataaagaattatatattgaacatggtaaatcacctaaattcagaaagttgtagaaaacttgggtctggagctcaggaaagacactggatatgtagatttggaagttatcaatctcaaagtgatgcttgagatcacaggtacagatgagatcaccccgggagaatgtactgggtgaaaggggccaatccttcaccccagttaacagcagcctttgcatgagggcagaaccagaggaaggctgatgaggaggtctaaaagacaggaagccacctagggaagaatggttgaatggaagccagagaagagagttttcaggaatgaaacactgagcagcttcagttgctacagagaagtgttcatggcaatcatgaagttcttggtagtctcaatgagtgtgacttcaytgatgtgggtaggtgggagccaaactatggtcttgagaaattaatcaaaagagaggcaaagaagaaacacaggcaacttggctgagaaaagaagaatgaaggccattggctagagactggaaaaggcttaattaatgacaggaggtcttgagtctgtttgcaggtgaaragaggggattgggaaaacaggaagggtggaagatacagaggagatggagacagttgctggaatagggtactagaagggacaactgcaaatgggaccaagaacacagcaggagtcttgaattttggacaggctagagaatgtctcttgttttgacacaagggaaaaaagaaaaggagggtgcaggaggtaaataaaaggttggtttattgggaagaaactgcaatcgttgcagtgggagggctcctgccttttctatgtaaaagcagtgaaggcatctgcagagaacataacatgcccatgaaacagaaatgatggtgataacttggtttatgtctagctggtctacagagctgcaggsaagaagcagaagtcaatctttacttcagttcctgatactcctgatcttttaagagccaagcgagggcagaagcttcagagtcaggtaagctcagaggttcataagcctgccactcaggcatcacagrgggtgattatatgtgcctggcctcacctggccagtggcagactcacacacttggttgtcctggctgcaacctcatgcccattaacactgcacttgaagaagcagttctcttttgggccatgataattatggttgtgttttactcaggtaagggatgccacatcttctttcctaagtgttataaaacttgtgttttggagtaatgaaaataattgcttgatcattctatagaatcttcctgttatccgcagacaaacgaagctgtatttcatgcagtcacgcaaaaatcaggggaaaatatgttgaggggtctatcagaatcttctcatacttctgttagcattctttatcacatggctttgcttggatcatactcagtggtaggcatattagataactggagtatgtgtatttgttttcaaatatgagacacagagaaacaaatgaacagaaacgcatataacaaaaaaacaagcaaacaaacatcaggacagtaagcagataccaccttcccactgaatggttagaaatgaatgaagtggactgaatgctaaatactaaatgctttatctctatgacacctcactttcttctattattcagtatctgtatgttgaacttgccaccaaagagagaccccatcatcacgctggaaaccagaccacagccttgaagcatgctaaagaygtgaaggacatggtcagtgaggtaagatgggaattcagcactgaggcactgggtaaaaagaaaaatactttgttaaaaccttcccctgctacctctgatcagagagctcattactataaatggtgctcagcatcatcaaaacacaaaaggcagagctattctcttaaagtgtgtaacacattgtgcccctccacaagacctgtaggtggcttggttggaaattgggaagacacttaagcttgtctctctcttctgcatttatttctcagaaaaagtacaagattcaatatgaaaagatgaaagacaagtacactccggttccagatacgccaatcctcatcagagccaagagggcttactggaatgccagtgatgtatgcatcccttccttttttcttctgttgtgatggggagagctgaggttgaagtacctaagaaacataacatatttcagccatatccatagttctaaaccatggcctaggaaaaaaacacacatttttttaaagagaaaaaaaaatgcccaaacaatactagtcaggcaaaatagctgagagataccagaagcctattcttctcaattctctcctgaataaaaatatgaccctttcttataattcttcagcagcattttctggggatacttgacagttaatttacttatccataaaattatggtcttgcagtcagccagacatggattcaaatcctgatgctgttacttgcctgctgtatgactctatatcatctgtctaatttttccgagtctcttttcatatatgtggaatgataatgagaattgtgataattaaataaaaccaaacaagataatgtataagtgtctagcatgctgctgggctcctagttactcagaaaatgtttgttcccttttttctcttaattgcatatagatcatgtgaatgatgcatgacacagtggttaaaattaggggggacagatgttcattttccatatcacacaatcgagggcaaggctgccttttaatggtaataatctgttaataatctgttaatgaagatgtgaagtagtgaatccaaggtaaatagccaatccttacgggttttgtgtctcagggtccaaccaggaattcactgtacccattaccagagccacacccctagaggactagacatgttgggacttaaactgagccaaaaatcaagccaacttcatgaccccctcaacttagcaacatagctctaggatttcaaggcatcttaaggtaattgcagtaagcccgaggcagaaaagagaaggcacagcaaatgtgaacaatatctcagttccataattttgttaggaatttttatttggagaagagaagagcctactagttagaaaaaggcaatgccagttagtgcttaaaatgtaagctgggaaaaaatcatatactcccctcaaaatctaccttctaggatatttttagtcttcttgtgacatccttcatcattatcacttcaaagttactgttgaatatttatttgaaccaagctgaattaatatcttacagcggtggccacacattgaaattggccctgggattcatcatgccccactggacagcaccatccctagggctttatcagtagcaattctgataactctaatctttacaatagtctaatgtaacaagggtagtatctggcatttaattcagtattaaccatggctagccccacaagtagatctaagcaatcttatgatccatctaaaaaacaaaattacaaagtcaaagaaaagacatctttcactgtgtgtttgctcagttaaccccaaaagaaaagaactgtttgacgttgaaaataggttgtgcagagaagcacccatcttgtgtagattagatgaatcatctatgatattctcaggttagaatcagagctgttttctcttgaaatatcacaaagataaagattataatgaaatgaagttttaagactgcttagtgaagaaggcattttaatactaggagttagaagctaaacctttttcccttttccatgtacattagcatatcttgggctcaacaatgttgtttgtttgggttttttttttctctcaaatgaacttttggtttatgttttatatttaaataaactttctattttaagtagtcttagatttaccgaaattgtacagagttatcacatgccccacacccaggggaacacccatatcctcctgttgctaacacctgtatcaccatcgtagatttgccatgatcagtgaaccaagattgatacattatgatcggttaaactccatagttgctttggatttcattagttttccctagtgttctttttctcttctagggtctgaaataagcttttaaatttttcctaaatgtattcatgggaaaaccagagagaagacaagagagttcatgcttaaaagagctcaattatttaacttggtagtttttttgtaattcatgtgttttttctctttctagctacgctacaaagaaacatttcaaaagaccaaagggaaataccacacggtgaaagatgccctagacattgtctatcatcgcaaagtcacagatgacatcagtaaagtatgtccctaaatatttctacttgtgttgggctctacaactcaccatatacatatacatatattttttagcaacctccctcttctgaaattctccagaaagaagccatatttacattamctttgggtaagacttacagctgtctttgtgttttttataacagataaaatacaaggagaactacatgagccagttgggtatctggaggtccattcctgatcgtccagagcatttccaccaccgagcagtcactgacacagtcagtgatgtgagtgttgacatcttctattttcacatataaattcatattcccatataagctctgaaatcatacatggcataaaaactgaagaaactcttggctagattttagattttgtgtgtggatgtttaaatcataaaactcaattgctaagtgagtgaatttcaacttgggagaaggaaatatatattcaaatttataaacctcatttttctcctaaatgtatgatatcatattacaggactggaagtgatatatatcatctaggaaatagcctattttgatccaatgaagtgacaacttcatgaagcaattaagacacataacaatgctcacttagaaagttcagctctgtgtatgaaaatatagctgccaagctaatgatatactatctaggaaagtatgcctgttaaatttgaattgctttaattagtattaaaaatggaaaacttccatatgttataaaacaatataccaaaggtcagtattactgaaaatgtcttttaaataattgttttaatactttattattttatatacctcaaggggtagtgcttctgtttgwtccacttgtatagatactaacttattgctgtttggagatggcttcttagaactctttgatgttcttcttctcccaggtaaaatataaagaagacttgacttggcttaaaggcattggttgctatgcctatgatacccctgatttcactctggctgaaaagaacaagactctctacagcaaggtatatatactcaaggagaattggcctcatccattcgacatatacctgtacccagagagaattagcactgagaaatagtctttcatgtttccatccctatcatggcttctagaccttatagtctgagtacatacttacttgttcactgctaggaaactcttgggttttaatctcattgactgaaggcatttatttgaatttgatgaaaaatcaactctgttcarcccctcatgattcttctagaactctctccttattaatatgtctctgggtggtttctcctattaaagctgatatgacagccaatataaagtgggattattttaatccacaaataatgtatgacgtgrggcaaaccacctagtttttatagcctcattttcctatttacaacataaagcaattcaattcacttgcatttgggttgtacaataggatccagcaaactttttcctgaaaaatgccagatagtaaataaaacatctaagaagatgttatgggccagattcattctagggcatattcttctttgtttgttacaatactgtggaatggtgaaacccattctaattcatgaagctgtttaaaaacwggtggcatgctagctgggtcataccccacacctgctcttagaagattatgattatctgattaattactggaaaactcttcaaattaatgtactaaaaaccttcaagtgcacatgaaaatactttcaaagttaaataataattataatatatagaaataaactagacattgatttaaatttttgcccaatatggaaaataaatctatttggcatccattcaatggaagtgttttcgtcgtgtccacttttgggctagttttcaagacatctaggcagttctaccctttactgtcttggaggcagaataaacaatcagtaaatatgtgttagcttggctgggttctgtggctcacacatgtaatcccagcacttgggaggccaaggcaggcggatagcctgagcccaggagtttgagaccagcctgggcaatatgacaaaaccccatctctacaaaatatacgtaaattagccaggcatggtggtgtacaacctgtagtcccacctacttgggaggctgaggtgggaagatcgatggagcctgggaggyggaggttgcagtgagctatgactgtgccttgcagtccagcctgggcaacagagtgaaaccctgtctcaaaacaaacaaacgaatatgtgttagttctatgaattaattatcacaattatatcatatgataaacagcatgtctcattcttaagataatcatagcctgctgtcaagtaaccatgttctgttttttctagtataagtataaagaagtatttgaaaggacaaagtcagatttcaagtatgttgccgactctccgatcaataggcatttcaagtatgcaactcaattgatgaatgaggtatgtatgaataaactgctccaattaagcctattcaattccctaaagaagtctcagagtttttttaaattaaagcccaatacacagaatgacaggaaagccatcctaagttttcattttaactaaagatttggaaaagactctataatgtcaccatccaacaagctctgccaaactacaaataagaacaagtgaagggaccgttcagtggtgggagagccccgcaaacatcagcacctctgcacaaacacagggcagcacagccctgcgggtgacaataccaggcaggtaaaggattttcttgactgtcagcggaactcccttatatattacacaatctatattgtgtagatttggaagacacagaagttcaaggttaatttagtatcctctactaaggcaccaaaatgtcagttgttagaagagctacgctaaaggaatagttgtgattcatgcttcaaagatattgccattgttactcccacatatattggtgcacagaagtatccatctgcacccaaattttttctttctattttatccagcctttcctgtaaccatctttgcaataatttaagttaaatttagctcaagatggctgaaataaacaagctatgaatttatttagttgggatggttttatagttaaagttgtatttaatttcctattttcagattttttacagtttctgtaagttcaaaaattccgtgagaaaattagtacaatatttctaaaaatgaaaatatagccaatggtatatttacttaaatgtatgacttttttgtttgttgtctttacatttgattcagttcactttcagtagatttccagactggacaaccctgaagaattactgccagtagcttcctatgaatacaatcttgatatattttgtttctatttttctatttcatgaagaatttccaggtctcctttataatccartaaattaatagcattagaagactattacaaatttcccgtggatgttttagcatcagttatgctttgagattctcacagcctyagttggtaaagctgtagctgatcagtaccctattttaaatataccgttagatgccataaaacctaatgttgttaatggcatcatatgcaaagatggaaaatgtttgggcacaaggaactctaattttggtgtcataaatctgacctatcccacactccagccttcttcaggtaatcttcctccacttgactctctttgcttccctgtttttattgtcttgggtatgttgggagcccgccactagagatgacatgttctggccctctggagtgtttaccttgagacatttttgtgtagccttgaagttgtactcttgctataatatgctatgatgtttgagcagaaaaaatacagagctgattatgagcagcggaaagataaataccacctggtagtcgatgagcctagacatctgctggctaagaccgcaggcgaccagatcagtcaggtactgtgatggggctggccggtggcccaggcaggactgtgctcccagtttctcatgagatgtcatcccgtctgctgcaaggatgtcataggttctgcctatgatattgggttgttctgtttcaaagtatctgtctagccacccaaaaagcccgtcagctatttgagtgtgccagtccatgctctgtgttctcacttgtgctgtggtgaagatgaaaggaaaagctgggtcctcccatcctttactcttctggagaacctgtttgaaaactgcaactgtaaactgcagattgagttgcaaaagcaaaaaataaacaaacaacaacaaaaaacaaacaaaaattaatggaaggaaagaagacataactccttactatatatctttctattccaaagatgtcttcttttctataaagctattttggtggtaacgtaagtgaaactagctgtatcattccccattcacaaggactatgaatggccaaccgcaagcattgcagtcattctgcttcacattataatgtatttgatgtcttcacccgcacatatgtgagtacataaagtgtgtatgcctacatctcttcactcagaggtgattgggatatagagccgtgttcttttctgtcttcataagtctcttttgtgcttcactgctctttgcatggacagagaaaatataaatctagtgccaagatgtttctgcaacatggatgtaatgaaattctgcgtccagatatgttgactgctctctacaattcgcatatgtggagccaggtaatgtctgatgggatgtgaagaaggaggtttagaagaagtcttggatgcattcccttgtatgctttcattgatttcctcttccactccctgcccatgctggcttcatatggtaaagctatgtaaatattcattccttgtaaatgatctctgaatgtggccaaaggtgatgggacagtggtcatccgtacatcatctgacactttcagaactcttaataaaattaactgattctttcaagtgttatttccaaagtggtataacattaatttatacttttcagtatttgcctcaaagaaatagattccttagagattgaagatagtaagtagattcaacagcatgtaaaaggtctgaatatttaatgttttcatctaatgtgtctcttgttcaattatcactacaactgttgcrgggagatgaggattaccgtgcagctctatgaatattgtatatattcatggcgcctcttgactttgatgctgaattgctaggttatttccagcacatctgatcccacacacacaggttaacagtgtctctgataataatgcctttttagaaggccaactgaagcatgcactttccagcacatgctgaaaggtaaatttgatgcagcaataaacagtgataattggtaactaccagacacaatgttagtaataataccatttttcccagaccaaaaaaaaaaagttaattgagctttcctcttagcaacttgttttgtcattttagtttaccatgaaatcaatatgtgaaatgaggaggttaagctccaattaagagcttaacctcctcatttctcctcctataaatatcctgtttgcctgaacttcctcctttgtccttatatgatcctcaaatagttgtgcatgaaattttatggtgctctctgtatctgtcctgcttaaaacagcttctgtgcatgaaaataattatgacttgaaaattgcaaaaacaaatgaattttttaaaatgataaatacttcatatatactcattctttattttacatccctgtttcatctttgacatggaaaaatgcctttggagattgtacatgttcaatacaatatgttatgagtaaaacaatatttgtcagactccagagaacaggttctagtcctgctctgagatttggtctaaatgtgcccttgggtcagtctcgtaacctctgggggcctccgagtacatgtgtataaaacatattggaacttgggaggctgaggcagaagaattgcttgaayctgggaggtggaggttgcagtgagccgagatcgcaccactgcactccagcctrggtgacagagtaagactccrtctcggagggaaacaaaaaaaggaaattattagtagtagtatcatctgctcactccatttcacttttgctatcagacacaaatttatagtaaacatttccagttaggaattaaagagaaagctagataccatctcccactctggtgtttcaagaggacaattagataccttaaagcccactctacaacttcttagagctctttcttctcttccacaatttagatcaaatacaggaaaaactatgaaaaatcaaaggacaaatttacctcaattgtggatactccagaacacctgcgtactacaaaagtcaacaaacaaatcagcgatgtaagtgcaagaaacactgaataccttctcaaactcagggggcatctgcaaacatggaggggcattttaaattgtcacaaagtctgggagactactgccatttagtgggagggaggcaggggtgcgagatgtcctgttatgcacaggattctcctccccaataaagaattgttgtggccgggcgtggtggcttatgcctgtaattccagcactttgggaagccaaggcaggtggatcacttgaggccacgagtttgagaccagcctggccaatatggcaaaaccccatctctactaaaaatataaaaattagccagatgcagtggtgcatgcctgtggtcccagctactcaggaggctgaggcgtgacaattgcttgagcccaggagatggaggttgcagtgaaccaagatcatgccactgcactccagcctgggtggcaaagtgagactctgtctcaaaaaaaaaaaaaaaaaaaaaaaaaagaaagaaaaaaagagagttgttgtgaccaaactggcagacacgccagctggaaacactgaagtcttagcagagagcatgaaagcacctgtcaaattcatagaattctctttcctttatattcactcaggaaaaaactttgcatttatattttgatattatacattgagaagcatgacatgatgtctttctgctttttgatctttcagatcctttataaattggaatacaacaaggccaaacccagaggctacaccacaatccacgacacrcccatgttgctgcatgtccgcaaggttaaagatgaagtcagtgatgtaagtactagaatggtttagcagtccctctcatcttggcctccttctaatgagatgtaacaaaccctggtccagttatctattcctgtgtaacaaccaccctaaaacttagtggcttaaaataatagtcatctcttttgctcatgattcggtaagttgactggacacagctgaacagtcctgctccccatgttgctggcagacacctggggctcagtcaagccaggacatccaggtggctcactcccatggctagccattggtgatggctgcgggctgggagctgggctattgtgtagacgagacaggaaccccttcatgtggcctctccacatgcctgggacttctccccagatgggtctccacgtggcttaaacatatcctgaggtactgattttttaaaaatgaatttccacgactttctcctaaagatactgataagtaaattggtaaactaggtctatggcaaagccaggaaaattgtgattcctatgatcagtttagtaaaccccactatggctccctcggaacagtttactttggccttagtcacattaaaacctaggatccttccccaacgattaatgaaaaagcccagatcgaggccctcgaccctgaaatttaagaagagcaaaagtgggtgaagctggaagtcccaggcccaggatggaaaaactgcctgttgggcctgcagatgctaagccttctctgtgcctttccctcctatccaaacccacatataccaaaacttgctaggtatgtctccagcaatgacaatatacagttctatatatttttaaaaggcagaatgattgctrtattcatcagttcattcattcatcaaatattgtctatgtgcctgacactaggaatgagatgatggatgataaacagtttttgcccttaaggggtccttaatggaaagaataggcagattaaaaaaaattataacacgatatgataatagctataactgccggagcacagaaggagagcaagactaattctgtctgggtgagctggtagggaaaggcttctcttccatcagcagttatcaagatgttctgaactcaagatttgctgatttggggaaaggaaaacctgaatgaatagggktccaactggtcctttcagcacaagcacagaaacaaaaattatatggcaggctgggcacagtggctcacacctgtaatcccagcactttgaaaggctgaggtgggcgggatcacctgaggtcacgagttcgagaccagcctggccaacgtggcgaaaccccatctctactaaaatacaaaattagccgggtgaggtggcgcaygcctgtggtcccaggtactcaggaggctgaggcaggagaattgcttgaacctgggaggcggaggttgcagtgagctgagatcacaccattgtactccagcctgggtgacagagagagaatctgttaaaaaaaaaaaaaaaattatatggcaacactgatgaccatagtcagtgtgccctgatctgagataggaaggtgcatctctgcatggctgtatccttgctccacagcagatttttaaaattccgtcttaaggagcattgtgtactatagtcatgcatggatttaatttcttgttttttaagatgctcagtatgctgctataaaaaaattaatcttgtcactgtgtttcctcccacagctgaaatacaaagaagtataccaaagaaataaatccaactgcaccattgagccagatgctgttcatatcaaagcagccaaggacgcctayaaagtcaacaccaatgtaagttccagaaacttccccaagcatggtgggggatttaccagcttctgtaggacacatggcctctttttacatctcttcaggcaattcagctctagtgattgattccaaagcaagagtcaggccccaggagcatgaacaatgatgctaaaatataaatgctgcattggtcctcacaaaggagcatagggaagagcaaaggaagcttcatcccatgccatggatgctacacccactcagcttttgcggtgggtggctgagaaatgggacgtttaattctgaaatgtaggttgcatttttggaaagtgcctgagcatttttcattctctttccctgtgctctcctcctgcctcaaactctacaatctgcttcttctgatgaagaaaacattgagccatttggtgccatcaggcattggcctagaccttcttcctgctcagatattccctgcgttgactctcttcttgggtgcagcatcttaaggcctcaactacagaaataattttgtgcatttagatgagcactgacttcttaaaaatatattaaatggttatacaatgaaaccattgtaaccgaattagtacccactagtgctagaggggacatatatttatgagggctagcaaactggaatccctgtaggagctggcaaagagcttgtacgtatcctgaggatggattgagggcagacggatagaaggacagatgtgagataaagcaaatgcagtaaaacgtaccttgcaaaatccaggttgtatgggtattctctgtaatattcttgcaacatttttgtatgtttgaaatttttcaaaataaaatgaggggaaaaaaaccttattaaatagtatacataaaagcatgtgcattgtattgtgtataaattatacctcaattttaaaaagagagaaagaatgaggaaagaaatgtgcctaatagtgcaggctcctcccaaggacactcaaattaaattacatacacttctgtggctcagatttggcccaatgcagccagttctccagccctgaagggtctaggaagcatgcaagcccctctgcagccagactgcctgggtttaaattccagctccaccaattgctaagtctcaccttgggaagtttacttaacctttctatccagttcttcagctgtctatttcatgcagttgttatgaagattaggtgaattaattttataaaattttataattcatttaattagttttgtaatttgtaaagaacttagaaaagtgcctggcagaaaataaatacctagtgtttgatcatttttggtaaaaattaaacccgaatttagtttgaaattaaaagtactcgattctgaagatgattrggctggactggcagaactagagagattgaagaatcatttcacccggaggcctttaaaaattttagcctctatttcgggaccacagggtcccaacagatgacctctgagtggatgactagctgcataaattgtacagaaatttcaattggggcttcctcttgcattaggaatcatgatttgagatgttttgaaatgcaagagcccctctgtgccatgtgtgtgtttatgaatttagcctactgaatcaagtgattcctttctctcctgttaaaaacagctggactataagaaacagtacgaagccaacaaagcccactggaagtggactcctgacygaccggacttcctccaggctgccaagtcatccctgcagcaaagcgatgtaagacaggagagacacagacgattgtaactgcatactgcacctgagaaatacaatgaataattatttataataaccactrtcatgagtgttaacccttgctcgtttgagatccgagaaggagaggaggatggttgggggagcgataggcgagctcagaacccaaacctgcccatggagcctattctcctttggctgggcctggacacaaatgactgagttctgactgaggctggggagagtctgggggaagactggggatggaggggcttggtcctggcagctaggctgaaaaggaggagtccaaaatgcagtgagggaccaagaagctcttctcctcattctggtagcaagtctttgtcctctccttaagaggactccctgtgtgtttaatcaaatgcccagcttcctcctgtgctgtcacccttcccttttcttctgcctttcttctatcacagtttgaatataagctgraccgggagttcctcaagggttgcaagctttctgtcactgatgacaaaaacacggtgctcgccctcaggaatactttaatagaaagtgatgtaagtacctagttccttccatgatgcctaacctcactcagggccatcttccatggtacagtccccagggacaccagggaaggatggagaagagctgcttccatcagggctcaggtatgggtcctgaattayggcctgtcctgtgaggggcgccagcagtcaagcagggcagcagcagtgcaagggccattagatccaggtgacagtcctcgatttatactgcaccagcagagagttcacacagcaggaattaggaccctgaaggcctggctggactctttatggaaacgccatgatttgttttctatgggatcatactttcccttcactacagtttcctcctctgtaaagacggaataataatgggctcatggagggcttatgggagggacaaatggcatatctgagcgtgctgtgaacgtaagtgtgactatataaagattcatcacgagatccattttgattgttattaaaaccacaacttgctagagataaggaaaaaacccttttgaatatttcccaaaatttgcaagtatcacatcttttattgagtttagtattgtcaacgctgcygttctactggtttgagggtgtaataaaaatatgtaggatatccagcagagctaaagaaatgccccttttcctgcccctgaagctgaaatacaaagagaarcatgtcaaggaaagaggaacctgccatgccgtacctgacacgcctcagatcctgctggcgaagactgtcagcaacctggtgtctgaggtaacccccagccgcccatgagttctgcttccctcttgggagaacgccccaggcagatgccttaatgagctctctatggattcccccagaacaagtacaaggaccatgtcaagaagcacttggcacagggctcatacacaacactaccagagacccgggacactgttcacgtcaaggaagtgmccaagcatgtcagtgatgtaagtgatcaaccaccsgtctcttggcagcaacaatgccacttgactgtagaatctggtgaaataatgtcagttgccttttgcttcctttatgtagcttcactcttaccatcaatatctacatgtgaatcttaaactctgayttttaaaatgacccagtatttattggctttccaattctggcaattatggcaaatgtgggttttgctacaggacatgtaatctagccatatcagatattactaacctattaataacagaaggaaacattgytgattaggagtggcctctcctattattaaactgctacccaattttagaaaggtaaaactacctctttgggcctcagtaatctctgcctgctctatccttatcaataatgctgtagtaaccttggtattatatgagtcccatatggttccatatatttttaaaaggtagaaatagtaaataaaagagcttaatttgcctctacccaggttctccgaagattgccaggtggttctagtgttgggttgcaggacacaaatgacagagaagaactagaatatgggtcttatctaagtcccagactgaygccaaaatggggagcatggattttcctggagatttcacagttcttcaagtaaaccaactctgttcccagcttcctctactcataaaagtaattctggctctatttagacaaattasaaaaagaagtttgtcaaggagaaaggaaaatccaactactccatcatgctggagccaccagaggtgaaacatgctatggaagtggccaagaagcaaagtgatgtaagttttccctctcaacactcttgggggcccatttgaagcagkggaacccagattggtgcattctcttgttccagtgtgtggtcactctaattcctctgtggtagtttcaaaaagttagtggcgagaattggtttgggtttaaggaaaaaagctgattgtgcttaatggggacttttagaaagatagcatatctcggctgggcgtggtggctcatgcctataatcccagcactttgggagcccaagacaggcagatcacgaggtcaggagttcgagaccagcctggccaatatggtgaaaccctgtctctactaaaaacacaaaaatcagccgggcatggtggtgcacacctgcagtccccagctactcgggaggctgaggcagaagaatcacttgaatccgggagacagaagttgcagtgagctgagattgtaccactgcactcaagcctgggcaacagagtgagattccatctcaaaaaaaaaaaaaaaaaaaaaaaaaaaaagcctctctcttgagtaaacattttcttccccaataaaggtcgcttacagaaaagatgccaaagagaacctgcattacaccacagtggctgatcgaccagacatcaagaaggccacacaggcagccaaacaggccagtgaggtaagggtgtcatgaaaatgtccccagtccccaacagccattgccaaggcatgccaggcaaccatcacctgttgcccattttggttttctctgattcaggtggagtacagagccaagcaccgcaaggaaggcagccatggcttaagcatgctcggtcgcccagacatagaaatggccaagaaggcagccaagctgagcagccaggtaatgcagatgggtgcactggtggctctcatgtgaggagattataaaagaccttgcaggaagaagtgatttccagattgaaaatgcaaagggatgctgggtctgtaatagtactgcaaagcttccaagagttataaaaagtgcactgagggccttttctcgtttccctctaagctgtctagacctttcttgttctccactttaccatttatgggcatttgtctgggtgtctgtgtgcttaactatctttatgtgacaaaaacatcagttcatgagatcctactggaacctctccccaggccttaagagtttcatcctcggggtctgattcatacttgagtcacctgggatagatttaacatgaagagcaatgaaattctaacttctagaatccaaccagatgaaaatattcatttttttttcattaaacatacatatattaactgcccgggctaggaagtagggatgagcagatgtcttcagattacttgtccatggataaatcattaaaattttgtttggcaagtgtttgatcagggtatgcacagggtgctgatggagaatgccacattcttgcagatctcatattattgagaagcaaatggactcagaaatgtgttgcccaaacccagttaccacatgacttattttcccttgttaggccaattatctaaaattccccaagttatgacaggttttcagactttagctcagagatcccatcatctaccaccagacctatcagagtgcaagtttgatcctataggactttagcttaagaatatctcatttctcctccaatttacagatcctaccttctttttccttgtcctctcaggtatctgtttgaagaaataggtttgggatatacatttggttgtcgtgagtgactgactttcagcaatagcaaacatgggattccaatcttttggaagatataatgcagtaatgtcaagtgacagaacaagttagaattatgaaaacacaagagggtcagatgactgatgaaaagcaaatattattttttaaaagtttttaaacttaaaattcctatgtaacatattttattataaattaatggaattgtataagtatttgaaactaagatatgggatcaccaccaccaacaaaaaaacagtggaatctctaagagtaatgagatgtaacaagaacttattaatgcaaaaagttaatgtttttaaatgtacaaggtcatatcattataatttaaaaacaaacgactatgatgttgaaattttgaaaactttattgtttttgaaaatcaagaggctcctatttctagtactaagtgaatcctatggtatggagaatgggaccctatgggtcccatttacttcctgtgaaaggctggtctccggattgacagcttcatggtgtggccctgggcccaagggcgcttcagctgtgtgtgggctttccctgttctgactttgctgtcttgctgcgtactctaggcggaatacctcaaaggccaaaggagagggcacggcgctgcatcttatgacacccctatgatgargcatcttaagaaaattaatgtacacatcagtgatgtaagaaagactgagaccagcaagccattatttctgtcttcctctgattcttgtctactttcttggcattggtcaggagactgaccaggttgcattcttttctgttgatttttgtgttggaacgtgtagattgctgtggaaatttgttgaaggatatacttttgcatacacccttcttttcctgcatgaaactttccatctggaacataccacttggaataggaaggtagactagactcagagatggactcctaatgtatgtgtatgttaggttgctgacactgatcaagttaaatratgaaatgaaaacaaactgagaatctcatcttcaaccaaagaaacctctgcctcttctgaagttatctgccatttttgatttttaatatactgaagattggtatttaatatagtttctcagttcaggccttctatgaatcaacagtataaacttttaatagcttttctaattctcgggactgttcttcagtctttagaagcaccagtatacatctcaattcaataaaaaggagctaaaaaattagatcttaaacttcaaatacaattaaactcctaaaaatataattaatgcaaaatcactttcctatactacatccataataggcccaatttctgagcctgatgggattataaaccccgggggctgccacttgccgagacatggcattgcagagttgcctcttagctcccatggttaatgggaaaaagcttcaccattccctaatgccaagtgtatgtagttttactacattactccctagtcaaacaccattccaagaattcctagagtcctaaacctggtacatgtccttacctttcaaactatactagttttaagaagatccagtcaaaaaggaaggccaaaagtgctgaactcagattcatattagtagttgtaaaaagctgcatttgtttagaggacttcctatggagaagggagccataactttttttcagttaaaaaggttgaagttaacttgaaattaacagaagaaaaagaaactgaagtggaatcaatgggattgctgcttgaaaaatacctcttcagaaacaagtatcttctaaaagacagaaggaggacttttagtatgcttctaaaaaaagcagattttattctcatttgagatgggcttttgcttcttttcttccctactctgactctgcatatctggtttgcttttctgtgtttcacaactcttgggaacatctcctagttttatggacttctatatctcttaggaaaagttgcctttggtccagacaccagctcacacctcagaccttccttagcaggccttccacttctttatgttgagagtgaaactttttcagagaagagccattgtagcatttgtttacgtttctttttcctttactttgtgtgtctcagtgtgcctgcatcatgctgaactgttctgcatgcttattttttctctgcatttccactgaggatttattcaaagtaaaggagtctcagcattgtgaatgcattttctctgatgtggcagatttcattgttattttgtgtctgttgtgctggatgtgtcaagttgggggaggtgaagagcagtgatgaaccatgaggggtactggtgttagtgagtctttcatcttaacaataacagaaactctaggattccctgagggttaaatattgcccttttggttggctaacatctagaaacagctcagttttcattcctcctagagtgaataactagtagaattctacttctggccttaattctgcaatactgttgacaaaagcatcagtttgtttttcaattaggagatgtttctgtcactttccattctgttgaattctcctataaataaatcctcttatttattttgtgagacagggtcttgctctgttgcccacgatggagtgcagtggtgcgatcctgactcactgcagcctccacctcccgggctcaagtgatcctcccacttcagcctcctgagtagctgagactacaggggtgcaccacaatgcccagttaatttttgtatttttagtggagatggggtttcagcacgtgcccaggctggtctcaaactcctgggctcaagtaattcacccaccttggcctcctaaagtgctgagattacaggcatgagccaccacacctggctatcatcctctttagatattttacctagacataatgactgtctcttccttccattcaatcaaatcacatttattgagcaactattagtgcaaggcattgtgcttattttttaaattggagttatttagccctctgcctacctaaacttatttttatgtatactaaaagtatatttaatcttattttttctcattattctgaagtatctcacttttttcctacttctagtctgaaatcacacttgaagccattaacccccaaactctcatatttgtttactcaggagttataccatttttggccaagtttaataatttttaaatgatatagccaaagtactattttaaaataacaataaattctcctaatttaacagattctttatttttcaaccttcttgatcatttacagcccttctttggatttcacagacttaaattgctgttggttttgctagttaggagtgctaaaatgctccaaatcaagtacattaaatcacatctctgaatttagcctgaagccttttccattttttttttttttgttttgcattagaaagaggtgattactttttataccttggaataatataaaaatgagcaaggccagtgatcatatatttgaatgcctgttgtcttgtcattcttaattattaatagtgtcttctttactctaaatgtcccagtttggataatagattatatgatcactctatgtacaatgcatattctttggcatttgtgttyctactattccccaattcccaaattgattgatgtccaggaataatttggatgtttgcatttgctgttaggttaaataccgagaaaatttcgataaagaaaagggcaagacaccaaaatacaatccaaaagacagccagctctacaaagtcatgaaagatgctaataatcttgcaagtgaggtatgtttctaaaattgtggtaaaatatataacatggtatttgccattttaactgtttttaagtgtgcaattcagtagcatttataacactcacaatattatccaactactgtcactatttccaaaatgttttcataccaacagaaactataaccattaagcaaaaactctccattccctcctcccgtcagctcctgggaacctcttatctactttttgtctctatgcatttgcctgttttagagagtgcatataaatggaatcaaacagtatctgtcctttggtgtctggcttattttacttagcataatatgttcaaggtccatccatgttgtaggatatatcagaacttcattccttttatggctaaataatattccattgtatgtatatgccacattttgtttatccattcatctgctgacagacacttgggttgtttctgccttctggctactatgaatgaggtatgatttttcatcaccatctccagcatttgtttgacgatgggctatctcactttgatttccattagtgctgttccatttcctatttacgtgatttcctttcttcccccataacacacaggttaaatacaaggctgacctgaagaaacttcacaaacccgtgactgacatgaaggagtctctgatcatgaatcatgtcctgaatacaagccaacttgccagttctgtaagctcagtcatttgctccagaaacagcttgttttacccatttggaactaaattctttctgagcccagatgcatcttcttctctgctactgataccctagatttattacaaaactgttctcatttgagtgtattcttccaaatgacaacattaatctaccaattctccattgtctgtaacacctctcagaatgtaaaaatgcttctttttaaaaaatatttaaactttgccctccaattaaccattcccttttctctaaggacatagaaataccctctggaatagtttctttcacttttaactttttacttataacacctactttgaacaagccacataacctaagtgtttacatcttaacggacaatactgaacttggatcctcatttttaaaactttttcttaacctcctgtttagtgtttgccatttttagtttgatcttgacaatggtgctgtgtaaacgtctaatctaaagaggaaaaataggaatgctgagcagcttctccatcaatgtgccttttttgccgccttcccctcagtaccagtacaagaagaagtatgagaagagtaaaggccactaccacaccatacccgataatctggagcagcttcacctaaaagaggccacagaattacagagtatagtaagtggatcaagaccgatttttcctctggygcacattcatccacagtacaatgtgaaaaaaaatttcatagattccctccattgtttgagaaaatgcacaaagatataaggggttttgaatctggtaactttttgaaacaaattcttatgttataaattacaacaacatctacatatagttgagaaatatacatgcaattatgtgctactggcaggggctggaagcataaagagtgtgttttatgaggggacaaacccctcatggtaactccaatgtgccccatgggtttgtgccccaggttagggaacactacagtagattatagggagtcaggaagatttcaaacagagaagtgatacgatcaggtctactactgaaagcagttctgggaatttacaaaattactaaatttttaagatacagtcatataccgcatgatgtttttggtcaacagcagaccacctgtatgacagtggtcccayaagattataatggagctaccctatgcaggtgtaccattttaaaacctttaataccatatttttactgtaccttttctatgcttagaggtatcaagatacacaaatactcttgtgttacaagtgcctacagatttcagtaaaataatatgctgtacaggtttctagcctaggagcaacaggccataccatatagcctaggtgtgtagtaggctataccatctaggtttgtgtaagtgtactctgtgatgttcacacaatgatgaaattgcataacaaagcctttctcataacatatcccagttgttaagcaattcatgactataattgaagattctcagaggaaagaacttactatcacatgacctcctatatcacaaattcagcattatttaggtcccctgttgggcattaaccatgaggactaactattagaaacgtcctcgtgtcttctgtagggcagtatgtgcccccaggcctttattccaacatcttgttacaacccaagagctcggagattgagcagtgccatcaaggtgctgcgtgcatgagggtcttcgcctgtttttccagaagttctctgtcacatacatttatgtggctcccctgattcttaaccacatgttatgaggatgagaaaattttatttatacaacaggcttgaggatcttttgagactgtcaggttttttaacaagtcagtcaatatgtaaactagttttcatttttataccaatttattggctgcattaaatatatggccagtcaggacccacatagagttgtttacttataaataaagctccatgtgttatccattcaatctagaccccaggtctctgataaaagttcttgtgaaagaaaaactaaggatttttatcagaaatattgattaatgctaatagcattaataattttaaagtgtttacagctacccatcaattattgaccaacctcatctacctgggtaattttccccatgcgttttcttgcatcagcatttctctcagctggctcttgtcaatgattcttttgtgtccttgaattgaatccaaatcctaattatgccttgcagacagtaatggyacccatcccctcaacacctagacaacaacaaaaatgtactggatctgaaacataacaggaaactgttttgagtggcaatgagatgccatccaattgacagaacatatcaattaaaaaatactatccttaaactgctgtctaggaattgaccagaggagagatatctaacatggctttctatcaccaggtgaaatacaaagaaaagtatgaaaaggaacgaggaaaacccatgctggactttgaaacaccaacgtacatcactgccaaagagtctcagcagatgcagagtggggtaagtcaaaaaaaccacaccacacaacaatgatccatcacactactgaacacaagctctgcccatgacatggccagtttcctgtcatccaaaagtggtagctgatgaaactttttatcatgtgatcactaaaatcttctccatctcagaaatcctatggttcagttattttttaaaaatgctctaggtagtaaatatttaccatatgtcttatttcaacagccatttctgtaaaattagaacatggaaaactattcccaacacaaattatactgaatgtaatttggattttcctttatgaatgaaaagttccctccacacagacacccctttggctttgaaatgctctactcttagtagaatgccccaagccaaacaaaagggtatttgtgatcaagatgtttatcaagaccccagataatcaaaagtgaagatgccatattcgttattttagaattgtaagcagaagcactaaattttcttttggtcatttttaaccaagagtagagaatggaatcttattttaaatcttagtctgtcttcagtgggaaatgggcttatttggaatttccatttgcctctcttcctccaactataaagaaaaattgttttaaataaaagcagcagtttgtggagctttctggtgatagaatgtcaggtcatcaaaactttaaaatggcttcaaacaattggtcaatctgagtaaaggatctataggagtttcttatactgttcttgtgactttcctgtaaatttaaaattctattaaaataacaaaattacaaaagtagagttccaacatctattccaagcccctctgtgagtcagctaagtctggagactggagaggagatggggcagggaggcagagtggacaaaaccatacaattcctctgtgcctcactgcccacctaagctattcagtgatttttaaaaaacaggtcaaaactcagtgtggtggcatacacctgtagtcccagctactcagcaggctgaggcaggaggctcacttcagctcaggagtttgagaccagcctgggcatcatagcaagaccccatattaaaaaaacaggtcatgattaggaaaaaaagcaagttagcatttggtagccttaggctctccttccactgcgatttttttccccttgcctcactgacttgtaattctgaaataaagtcttttgtcaccttaagaaaggtgtgggaaagttcagaagagacaacagaggattcagagtcctgatggtgcatccatccttccactctgtgaagggcctgccccagtcacaacattagactgatgagtgaggggcccatcaaagtgtctcagcctgaatttccttgtggccatttgctccagacaaagtatttcaagtacaatcatacatgtttcaaatgtgtgaccattagcagaactatgattaagagcccatacatagaaaatgctgttttttttttcttcctgagatggagagatatattgtaataaagatttttttttaacttgtctttccttcctacttacattagaaagaatataggaaagattatgaagagtccattaaaggcagaaacctgactggcctggaggtcacgccagctttgttacatgtcaaatatgcaactaaaatagcaagcgaggtagtgcccacttggtcttttctttccctcttaatccaaataattgcactagtgacactcattaatgtgttcctcctaccatttacatcaccacctaactgtgggtttcaaattgggttctcatgtgcttggtactaccacctaatctattacccatgttaattcttctaattttttatttgaatattaccttagcattctattaacttcaagctttcatttgatatttaatgttaactgatcatgcttataccctgcctgtattcatatttttacttactaaactgtgaaccctttaaaaattggaattgttttttattttcttctttgcctgagagaatcaatctgggctttcttgtcaatgttgttgcttttctttcatgatatagaaagagtacaggaaagatctagaggaaagcatccgtgggaagggcctcactgaaatggaagatacacctgacatgctaagagcaaagaatgccactcaaatcctcaatgaggtaggcccacagctgactgcctgcacgtaattcatacagcatcatttctttgttagccaaattacaccagaaaaagcaaaacaaaaacagagaacagagaaaaacagagcttttcattttcagattccatatcaacataattgttaaccattacataaaatatacctcaatttctgatgaatggatattgtaacagtgtgtttctgtagtggttatcataatctattatctaatattatttgatttaacttgatatatttggtgtgctcatctacacgaaaacactacactggagtggtgtgcacctaagtgtaatcttagttatgtaccaaactagatgtacaatttactttatactctaatcttctaagcagagaatgctaaaagtattcaaaaggagacctctgttgacccatactgacttgcatagaatagtttcctccagagggcttctgaagacaccacttcatcctaccacacggaagagcgaaggtgaagagtagcaagcgacactatctgtgacaactggggtggcgtgttatgtggatttacattcaccctgtatgtttattacctagtagtagcatttaggtaccttttttttttcttttaatgctactatagaaagaatataagcgagacctggaactggaagtcaaaggaagaggcctgaatgccatggccaatgaaactccggattttatgagggccaggaatgctactgatattgccagtcaggtcagtgctactattcgatgtcaatctttcaggaaagtagttgtaactttaaggacataaagtgtccctctgtcatctgatttattggtgacagtcacatgcatacaatggcattcttgaacatctgcctggaggaagccatcccaatgaaaggatggaggaccctttgccaggctcattgctgtctacctttctaagtctataggctctggggacattcagagcaaagggcagaaactgaggaattaagtagctgtttggagctggggcaaactcgacatcttggccttatttctgagtcartccactcatttgatgccaggaattccttgcttagaatatcttgggagttcttcctctcctttcaagccctaagtttagaacagtttttaggcatcttagcttgtctaatgctcattggtatgggtcttttgcttatttgtcatcctcccagctcgtatgtaaacaatccatgccttactatctgttgatgatccctccttacccatatcccatcctgcatccaactaaatcttctctcaacagctaggacttgacctttcttactgaatctcactctttggtataaaactatgaacaaaataggaagaaatatctgttgaatgtcaaatgaatgagtccctcttggaaaagaaatatggctcacctcttaatcaaatcaagccaacaactgttgtgcacattgcaaacatttacccaactattcggtgttgttttacagattaagtataagcaatcagcagaaatggagaaagccaatttcacttctgtggttgatactccagagatcattcatgcccaacaagtcaagaatctttcaagccaggtaaggacattcgtcatgccatcactcataaaccccaatcatgaaagaatggaagtccttccattaataaataccttaagagattcttcagatcagtttttcccaataaaaaagagattcaccaggtgcggtggctcacgtctgtattcccagcactttgggaggccaaggaaagtggatcatttaagtccacgagtttgagatcagcctggacaatatggcaaaaccctgtccctacaaaaattggccaggtgtggtggtgcacgccagtcccagcttctaggaaggctgaggtgggaagatcaattgagcccaggcggttgaggctgcagtcagctgtgactgcaccactgcagtcccctgggtgacagggtgagactcttaaaaaaaaaagagagaagcccggcatggtggctcatgcctgtattcccagcactttgggaggccgaggtgggtggatcacaaggtcaggagatccagaccatcctggctaacacggtgaaactctatctctactaaaaaaaatacacaaaaattagccgggcgtggtggcaggcacctgtagtcccagctacttgggaggctgaggcaggagaatggcgtgaacccgggaggcagagcttgcagtgagccgagatcacgccactgcactccagcctgggcagcacagcaagactctgtctcaaaaaaaaaaaaaaaaaaaaaaaaaaaaagagtgagagggtaacctatgatgcaggaattttaaggtagtgaagaactcttttaaggtactgaagaacatggtacaacttgtaattaatgaatcaatattttaacatgtaaaatctcttatgatgtggctttaaaaatgtgtgcgcagatctggaagaaacaaagtagcccacatttggattaccaatctcaaacaagactgagattgagaccacacagtctaacccctgactcccctcatgatgaataactctccatcatcttcctacaaatagagagatgaagaaaagtaggccatccttcacaccctgggataggccttcacttgtatgaacgattgtcagtgatggtcaggagtctgcaatttgtttgagtggtgccagattagaatttgtgcttgtcttctgatcaatgagttccaaagccatagttaacgtgccctagctgtgctttataggcacctggggatgtagattcgctggtccaactctggaattttgatgctagtaaatctgtggtaggctctggaaatctatttttgtttgtttttaattttcacagatgatctcttaatgaccaatcaggttggggaatcaaggatttcaaccctttactggaaacatatagttgtatattgtaaaattacacatgaaaaatatagttatcactagagagtggtttgattaggaagcaggtatattcaaatggtggaaatgtttcttttctttgaagggtagggatgcaraagaataattagctttttaaaaactaccaaaatgatatgggctccaaattaccatgttgtgttcactgagggagccagggaggctgatattctttgggctgtgagagcctcaccagccttttaccttctgcttttgacactgctgatctttaacgaaagcttcagcatgtggacctatcccagtgtgggatcacgtcacttgctctgctctcctggggctctctttggctggttcctcaaggcctaaaatatagccaggcaagttagttcctccccaattcagatcagtatttacagttgaatggtaaatactggtgagatggtgcttgtgtttccacaaacttgcttctcgatttccaatggagaatctgtatttataactcttaaacctcatacttgggggttaatacaagcaatgtaagctgactcacaaatttaggatactatacagtagtctcctcttatccgagggggatatgttccaagacctctagtggatgcctgaaattacagacaatacctaaccctatatatactggtttttcctatacatatacacctatgacaaagcttaatttgtaaattagcacagtaagagattaacaacaataactaataaaatagaacaattataacaatatactgtaataaaagttatatagttacatgaatgtggtctctctctctccctcagaatatcttattgtaatgtactcttatttttgaccgaggttgactacagttaactgaaaccgtggaaagtgaaacctcagataagtggggactactgtactgaatacttaatgccagtatggcaggccaggtctcactaacaactgtttgagtactaaatgaatggttaagttagatattaaaagccagtgtccctgtacaaaggctgggatgtaacaaaagcccaccaaaagtttcggctaggcctttcctgggccttaaagcataacaaaataatgaaggaattcttaacaggacccatgtagaattaaacaagttttactgtgggtctaaaaaaaactccccaggcctccacaaacaagtttattgggggtctgaagaaactcctcaaacctccctgatttagcaggagacaacatacgagtaatcaccccagcacctgaacccatttaaattaagtaaatttactgaggctccagaggaaggtcttcagaactcagaccttagttataaattaaaagaagttaatcacttatgtctttagatgaatgaacacttacacaaagacatatagcttaaaaggtaagctctgaaaaactttgtaattttgagttggcctggtgataatttccaggccttctcccggtaaccagttacagaaataaaaactcttggtcgggcgcagtggctcgcgcctgtaatcccaggactttgggagaccgaggtgggtggatcatgaggtcaggagattgagaccatcctgaccaacatggtgaaaccccatcattagctggttgtggtggtgcacacctgtaatcccagctactcggaagcctgaggcaggagaattgcttgaaccagggagtcagaggttgcagtgagccaagatcacgtcactggactctagcctggagacactgcgaaactccgcctcaaaaaacaaaaaaccaaacaaacaaaaaaaaaacctctcttcctccccagttcatctgcatttcattattgggccacgagaaatagcagtccaaccctcaatttggtctgggaacaccagggagttcaggtccctttctcccagaatacatccaagttctgtgtgcaaatgtgattatccctctaagggattagcaccagctctgcaaaccagttgaggtagcttttgcttaatcttggaaaaaataaaagaaaaacaataaaaataaaataaaaggacgattgtttctattcttttcccaggacaatgagaactgttttccttacatctacatagctaaggagtcatccaggtgactttttcatgaacaaaacatttgttcatgatgaactaccgtttcttccgaaaaatctggctttaattcgcttccatttagatgaacaaaatctaggcctacatctctcattggctgaaactgcttgtttgttgtctctggcaagattacaaatttcaatacttataaatgtaattcctatattaacaaagtacatagagacagacagaatagttttatccccattataacagtggctagtctcattcctcagccctcagccctacaaactaaaacttccctgaagagtgggaaaaactggagctaagttaagctagagagaaaagtgaaaggacagtgacaagcgatgatgaaagaaaaataaggctctaaagtgttctgctgcagagaataaaaacaatcatcagtttggtggtgagattgactgcccactggtgtctggaagagcagcctctatatggacacgtctctccagccaaaggctggggcaggacaggggagcccaaggaatagtgatgtctggttcagagcagtccttggccagtcagctggccttagtagtgctccaggtgtgtctgtttggtagagctgccagtcctgtcaggctgctttctgcagcatcaagagccatattctggaaatgcctctgggcctgcctgtctgactgccggctcagtcctatagctgggagccctgaccgcacctgctcatggctcagtgaacatcttgtcaccagctaaggctttctagaggtcatgtctttgactcttaaccctccagcttctctccgcctgcctgttgaacagtctggctacatagcttcatccagcccagcgaggactactgccactggaggcatccccatctccctctctgggccttgctggctgtgaccttcctcctgtggaccagctagcaaggttccccctctgccagctttgccatgacaataggtcctactgaatgtctgggcttagctttcctggaaagaaaaagtatggtgctctttctttgactgagagggttcttccttgcgatgccctaacatccttggacagttaagaaaatacaaaggactttccctctgctgagcctggaagggctaaaatagcctattttasgtcccattggcctatatccctgtggtgtttaccctccttatttcttggaatctattcccagaaaaagtacaaggaagatgctgagaagtccatgtcgtattatgagactgttttggacaccccagagatacagagagtccgggagaaccaaaagaacttcagccttgtaagtttttattaaatgtaaggcacagcccacaggcacctaggggtgctgaggaagatgcctctggatatcccaggcttgcagtggggctgttgtgcagccctccacaactcccatcctgccccaggaaatgtgtgcccaattcatctctgggctcaccttgtatcttaatcccaaatcacagcatgaaagactcatctgttacttcgttggtggtattggggagaaaatatagtatcttttcctcacccatggcaaggttcatggcgaaaacccctgtaacaaaagacagattaacaagagagacacacaatttattyaataaaagcttcagaaatgactacccaaagaaacagggaaatatgtgtatttttatggatagagatgcggaagtgtgattggacaaagaggggtatgatccaatggtaataaacaggggatttagcgatggctgtttgttcagattctcctagtatctctgtgtctttggctcctttcctctgggtctagggaggacccttctggaaggagaggcttattgcctgctttaaatgaaggtcagataattattatctgcttcaggaaaaaacagagaaggccagaaaaaccctcctgcttctgctgttttttcaaatgccaaggtgccattattttggggtagtgtatcctaaaccctgtcagtggcttcctttactgaatgtgaactatcactgctttccattagtggagacatctatctttttcaaagttaaatctactaagcaagggatacttaaacaaaaacaaacccctagctttatatgttttttaaaattagtttctccacaaaattcttatcaaataatttcccttgggctaccagaccataattattgtgcatagacttttttttaaagatacaggattttaattttcttcacataatataggacaaataaagaaaacaaagcaatgttgaaatcttaacaagatgtttactctttcttcatagctccaataccagtgtgaccttaaaaacagtaaaggaaaaattayagttgttcaagacacrccagaaatactgcgtgtaaaagaaaatcagaagaatttcagctcggtatatttactatttattttgcatttaatgctaacctagtcatttcactctcctctttaaaaatatactagccttatattgatacacacaattaacatctaacctcctcagtaatactagcagtgatttgctaaaatccccaatactttgctccaaaatcatctccagagaccatttgaaataactttaaatctgctaacaacgtaacttttatttttaaattttttaatcccagggcagtaacatgtgttgtcttgctccaagaagatggatttctttttgacattgtgatttcttttgttatccctcccccaaataactgactgagtttgcatttctttaatggattttgtgttacatatggggagggttttgttgttaatcaacatttcctggctcttctcatcctgtgttagtatggtataccacaatcttagaagaaatcttaagatctggaaagatccatgttgtataactggtctgagtcactgatactgacatggaaatgtcaggtgcgatgctctggcacttgcctgggaacatcgtctagtgtcttgttttcacaaaagccatgtgtcctagtctttctccaggaactgctgggttttcttttcttctgtgttaacactgtcctgattctgaatgcccaggttttatataaagaggatgtctcaccaggaacggctatcggaaagacacctgagatgatgagagtgaaacaaacacaggaccacattagctcggtaaagacacagtgaatgcacttgcaatattttctgcctccctttgataatttacaatgacctatgagttgcactcaaagcctctgtcaccagaaacagcttatattgctaaaataggtgcctgtgtaccaccaccacacagtggctagagtcatctcatattcagtgcagtgccttggcggttttcatgagggagagattagatctgaaaaacagagaggcttgtgagaaggtagaatccggtacagtcaaagaaccaaccttcctggatatatgtatgtsaatctgtttatcctagtcaaacgacctgctgggcataaagacattggagtatacaggaaagggctgcagtctaaataggggcccccatccctgccccaaagagacgagagagagacaaagcgtccctgtccttggaattgttctcctcttacccagtatcagaatgaggtcccattcacactaagtataaagcctgcgttatttacactgttaatttttttaatttgggggctacaaaaaacatgtacatgttgggaagaataacagtccagcatgtaataatacctttcttttcccatttttaaatctgcaggtgaagtataaggaagcaataggacaaggaactccaatccctgacctgcctgaagtgaaacgtgtgaaggagacgcagaagcacattagctcggtagtggccatactctcagcttccatttgtgtgactggccatctctcaattgctaccctggtgctctctcatctttctgcttcctatcaagagcttccatgccttggggatgttgtgaattctcccttagtcttgatggggtcactacaggttgcaaaagtagataagaaaccacttttctcataatcaaggagtagaagggatttggctttcttttcctacctgtcactgacttgaagctcatggacttggcttcttaattaattatcatgccattcgtttccaaagtaaaatgttttgatggtagtaataaggttattgggatgatctcaagtaatttaactaaaagcatatacatataaacatataagtagtataacatactttggttttgtgtatatatataaaacatgtgtgtgtgtatgtatgacacatcatatgaatgataggattcccagtgtccaaaaagaccctgggtagacatgtgaagtctcttctcccctccctttcaaggtttcttctcctgtattctttgctctctccatctagtaaatgcagtggtacaggctgcgatctacctacaatggtatattatacattaagcctgttctgtcatgggaatttcaggcacctgtgcagtttattgcagggcacgtgtcccccacacctgaaatatcaggttagcacatttctcctgaccttttgtcaagcaagccctggctctgcacccaccccttttcccatccatacgcagattctaggcaggtgttggctactagcaaaagactatgtgaagtttgggaaatagtttatggccaataaaaggggaggaccttggtcttgggattcccctggtcaatggaggactgaactctcatttgattttctttaggatacttgatatttctcttgcaggttgttcatattatttagatctcattcccttctcactctctgcttatactctgtggtacagatttccttgtggtacaaatttcatttagagttttgtgtcctctaataagagttgagaaagctagcctaggctcctttgtcactttgcattacaacttcttggttttctttaattttgctttgtgctgttgtccgagatcaattctgctgctttgttgggtgaagagtaaagaaatgcaactttgttaccaagaaggtagatgttcaaaggttcctagaagcttccttgcaaaacaaagctatcacgcctagcttgtcactgattttaagaattaaaatctgggtacgttgctccccacgccatgcactaatacaccagggaatccatccatttaaaagaactcattcagtcctttaggctgaaaacttaatgttaagagttaaggaggctcagagagtggaggttccttaatgttttcattaaaatgcatagtccttagatactactaytaaaaaatatggacttctcccaattcagaaaacactagtttacttgatccagcaattagcagtaaaaatttcaggtaaagatgctcttcctgaaaaataaactgattaagccatctcacatccagggactaggctcctacagattaggagccagcgaggaacattcattagaacatacaaaacaaaaagaaaattctcaataagcctgaaggaatagagtatcctatgattggaaaattttaaaccaagcaatctattcattaagtacaagtctactgcaggcctactatatttgaggcaccaaagctagatgcaacaaaatggttagatttttctcattggtaartttatttattaatgcattttaggcatgcactaagtggttacagaaaatgcataatttagtgcccagttttcaaagtagtaaaaatttttactattttggaaaagacaacataaatattcatggaattttcycccctgttccttgaatgttatatttgagagctagattgtttttatgagtttcccccaaatagcccacatgtggctgctatctaaaggatttacggtcattttacctttctgggtattctaattattttctacaggttatgtacaaagaaaacttgggaacaggcattccaaccactgtgactccagagattgagagagtcaaacgcaatcaagagaactttagctcggtatttacaaatatatcatataagaaactatttcccataaaaaatttaccacaataacccatcttttttaaagaaagtaacatcttaacagcaattctgtgtgtgtctgtgtgtgttgtgtattattacctgaccaaaattatgttaatacaaaatgactcacatttccgattatacttgaacattttcagtgacttgactagatttgaaatactataagtagaattaacaagattcctcagcgttatataacttaatgctttccattgtactttttcatttccagaattagcattgtagagttcatcattaaaactgtgaaaaaagtaaaaacattatccttactaaatattacttactaaaaaactgcctcctcacatataaccccttcccccatttccttccttccttactctctrtgcctgttttaaatgtcctctgggtactttcttgtatctcacaggttttgtacaaagaaaatttggggaaaggaatcccaacacctatcactccagagatggagagagtcaaacgcaatcaagagaactttagctcggtatttcttagggggccaaaaaaaaaaaaatcccttaattttatttaaaataataacaccttacaaatgtaaaattactaaattcatataatgaaaataatgataccaaatattacctcagttttcaacccaaatctaatttagtatttagttctggtgtgaaattttaactgtgttttctctaaaacatagatatttatcactttctttaaaaacctgtaatactctgttttcttcctccattcctcctttaataacagtaggtgtttctaactggtgtaacacagtcaaaagtaaaatctaacaccctttcaaaaggacaatgttaattagaattttatttgtatttattgtggctgtttaatgtattctttrtgtttgcagcttttaagtttttttttttttatgtttagatgtttatttatttttccataagtttgggaggtacaggtggtatttggttactaagttctttagtggtgacttgtgagattttggtgcacccatcacccaagcagtatacactgcaccatatttgtagtgttttattccctcgcctcactyccactctttcctgcaagtccccaaagttcactgtatcattcttatgcctttgcatcctcatagcttagttcccacatatcagtgagaacatacaatgtttggttttccattcctgagttacttcacttacaatactagtctccaatctcattagaggtcactggtttgcagcttttcttaaaagaatgtcattcttaaacattttcattcaaagacaacacagcaattcacagtaaatataatttacttgtcttggctattttttgtatgctatgtaagatataaattaatttttcctttggaaaactttcagtatcattgaaagctagtattatttagctttcaacatttattctttattttgttcccccaaacctacctgtctctctctctcctctttctttggttccctaatttaatgttaccaacaactcatggatattaatttcaattagtttgaatgctatttgatactctggtctttgagagaaggcctacataagtcaagccactcctgccggcagcctggcagctgtgttttactgatgtcttttagagacagacatcctgtgtgtgactaaatgtccaaaggggatctatagttaactctatttttaaaagttactgaggtacttcatcataaaaacaacaataaaaatacttcttttaggctgtttttttaggttaagtctacctaaaaaatgatgggtccaggttgatttgtttgttggttttgtgcacacagatattgtacaaagagaacttgagcaaggggactcccctacctgtcactcctgagatggagcgagtcaaactcaatcaagaaaactttagctcggtatttgggagaaagctctttaactccatattaaaaaataataatttctacaaaacagaacatctcactgttcatccctttataataatcaatttaacaaaatctttttttaatcacatcaactgaatccttctgttttccagatctcctactcaccatttgattctaacaaacattttatactttctataatagtcccttaaaactttttctttccttctcttttcatctttatgttgttgggactgttgaagttaattgatttccagaaaagaaaaaccaaacactaaagctcttatttacttggaactctttttatctgatgtttctgggttagagatgcaagaaaagatactggacttgaagccacatatagaaatggtggctcttccttaggaacagggatcatcttaacatagaccctattcagataaacaatagcaccaagaaagaaaattgctccatattgaaaccaaaagaaatcttatttggggccaggcgtggtggctcacacctgtcayctcagcactttgggaggtcgaggcaggcagatcacttgagcccaggaggtcgagaccagcctagccaacatggtgaaattccatctctgctaaaaatagaaaaaattagccaagcgtggtggcacatgcctgtagtctcagctacttgggaggctgaggtgggaggttcatctgaaccctaggaagtcaaggctgcagtgagccgtgattgtgccactgtactccagcctaggcaacaggagtgagaccctgtttcaaaaaaaaaaaaaaaaaaaaggaagaaagaaatcttattttgatacttattcaaaacaagccatttcatgaatagaaatccaggccttctgatttttttttaatatacaaatcagatcatgagcttatatttaatgttatcttttattaatattgttgctgaaaaactctaacacacaaattatttgtgtattatatacaactctgaagcttctatatcaagaccttaggttcacttatacctgtgatggagaatcaaatgtcattaggaaaatttagatggatttttttctggggagtgggaattaatccaaaatatttttaattgtcagtttaaatatattctaaaagtttgattctttgacataattagatcagtaactttctttggtcccactgtctttttgttctgttttgttttttaattactattcactaacaatccttcaattttgttaaattttcaatgttaatatgtcttttggaatgttatactcattgttttccctgtgggttgtaattattattccttttattgaaaggcttgcaacgattttcaaaattattttctaattattttcttgtatactacagtaagtatattattatttgtatctatttgaaaccttaatgatcctggactttttttaaagtaaccatttgtgttaatttttacacagattgcatttaggcaaaattgcccagtggtgcataagcctattagatactgtggaaaatagacaatgccacatattgaacctctatacytgaccatctctacaacaacttgaacttaatgacaaggaccaaattgccatattgcatagatttggcctgttaaatatttgttagaccgtaagacaaacgctttttgtagagaaaataaatacttgctaatctaacttaagcaatttttctattgtacactgagtattttagtggtcttaggaaattatttgtatttttttccttaattcctggcacaggaaataaatatattcaagttacaataaaaagatgatgaatatcaaatacactgatatttcactaaggaaatacaaaacatgttctcacccagatctgtgcctgaacagagaggttgacttgttgaatctgtctyttctgtctgacgtctgtagttttataccaggttccccacaaggtagatgaaagggctgttttgactgctcttgttttttctggatgctttcttgtgtcatacaggtgttgtataaagaaaacgttggaaaagggattccaatccccatcactccagagatggagagagtcaaacacaatcaagaaaactttagttcggtatttaaaaataaaaaatccctttaattatttaaaaaaatgtttaaaaagattaatggctagattttaaaaatctaatcaactcatcccaataaaaaatttgacctgtctttttcccaacttaatgctgccatttcctatgaatcagttttccccattttggtaaaacattaatataatcatttaacttaataaaaaaagtgttcagtattatattcctgcttttacaaatgtaacattctcagtgtctaagcatccacwtttatactgctttggcaaatttgatctgaacctaaagcttaaacaaatgtattttgcaaagatccgactattatcctcgtttcttattctaaccttttctatctctactgttatttgtacagatattttgaagtttcttttttttagcaccttatcattgctctccatttgccttaaacatcgttgttctcaatgtgttcacccaaactaaaaattaaatactctgacttcttttgaaagtgaacaaaagaagagttgtgtgtatgtgtctccatatacacaatgtttgtaaaacccaaatatccctatgtgattaacagcattttcaaatcaaaagtaacttccttggtttcttgtctgtttctacttttttccctccttgtaacaaggtgggaaaagactaattgctctttcacggttgctcagtgctgcagagattagttcaaacaatgaaaataacaacctttcttttcctatttcttagtttttgctgctctttcctgcattcctttgcttttgaagatgtctttaggctcaaacaaacaggttgagtctaaaagcttctggtatttctcttcctctaacttactctcttcctcccttcccactcccaactgctccaaagcagggggaaaatgactgattgattgctttttttgttctggatgctttctcatcatacaggtgctatacaaagaaaacctggggacaggaattccaatccccatcactcctgagatgcagagagtcaaacacaatcaagaaaaccttagctcggtattttggaaagaaaggggaaaaaatgccacttaacttcagaattaaactgatctttacatttatttatttttgtttgaagcccatttcccttctttgcttctaatacatcttatattacaaaaggatatactttcccatttctataatacagttaatgtcaattttttacttcatctgatatttacaaacaaacatgttttaaaaataatgaatgtttccatttgtgtggataacaacaccgagttctaacagtctcaaatcctcatgtgattgtttaggaggcaccgtactcacaaaaatgaaaaaaaataacatggataactctgacagcccttcctcagcagctgaagtccctgcttctctagagggtgcagattccctatcccaacaacagcttccactaaagtagtcggtggcattttgtcagcatataacttctggctccttggatgactgtgttttttcctcatccttaaaaagtcccaagaaatgaaatgttactcatggttgtttttctggatgctttctyatcgcacaggtgttatacaaagaaaacatgggcaagggaacccctttacctgtcactcccgagatggaaagagtcaaacacaatcaagaaaatattagctcggtactttggcaagaaaagaaaaaaactacttatttaatgattttgaaaactttcatgatttaaaataatacgtattaatcctactttttaaagacaacttaaattttgtgaatttctttagcaaatttatccttttttcctttgggctacttctagcctaacaccattcccatttctataatacagttaatttcaattttttatttcatctggtattttcaatcttttttttaaaataatgagtttttcagtttgtgtggataacaccactgagttctaactgtctcaaatcctcatataattgtttaggaggcatggtactcacaaaaaaggaaaaaaaaaaataacatggataactctgacagcctttccccagcagctgaggtccctgcttctctagagggtgcagattccccatcccaacaacttccactaaagtaaagtagtcggtggcattttgtcagcatataacttctggctccttggacaactgtgttttgtcttaacaaggaagctgaccttacccttaaaacctttcaacaaatgaaatgttactcatggttgtttttctggttgctttcttatcgcacaggtgttatacaaagaaaacatgggcaagggaacccctctacctgtcactcctgagatggagagagtcaaacacaatcaagaaaatattagctcggtacttgggcaagaaaagaaaaaaactacttactgattttaaaaactatttcatgatttmaaataatacatattaatcctattttctaaagacaaattttgtgaacttctttctttagcaaatttatccttttttcctttgggctacttctagcctaacaccatttccataatacagttaattttgattttttatttcatctgatattttcaatcattttttaaaaatgagtttttccgtttgtgtggataacaacactgagttctaacagtctcaaatcctcatgtgattgtttaggaggcaccgtactcacaaaaatgaaaaaaaataacatggataactctgacagcctttccccagcagctgaggtccctgcttctctagagggtgcagattccccatcccaacaacagcttccactaaagtagctggtggcattttgtcagcatataacttctggctccttggacgactgtgttttcttaacaaggaagttgaccttacccttaaaacctctcaacaaatgaaatgttactcatggttgtttttctggatgctttctcatcgcacaggtgttatacaaagaaaacatgggcaagggaactcctttasctgtcactcccgagatggagcgagtcaaacacaatcaagaaaatattagctcggtacttggcgagaaaagaaaaaaactacttactgattttaaaaactacttttatgatttaaaataatacatattaatcctactttttaaagacaacttaaattttgtgaaatttctttagcaaatttacccytttttcctttgggctayttctagcctaaccccataataacaaggttgctttaatccataaagttctamtatcaagaagtaacagattttcctataaaacatccttttgcttctctctctccaaacttactctctatccactacccccaaggtctctttgttttagatatgcttgaaatttaggacgggtacgtgtggggtggtggagtaggtccaatgcggctctttcttaaatatgattttgttgtgtttttgtgtcaatgacttcaggttctaatttaccctgtcagatttggacaaagagaccttgggaaaaataatccctgatcccctccttcaagaataatgatataaattatgatccaatagtagttttggcaattattgattatcaatttacttacttaaaaatgaaagtgtcaccagaatggctttttgttttaccagttttcgttttttgtttgttgttgttgttgttctttagttttactgtagtctttaactgcaaactttagtaaaccatttcccgtaagcttgtgctctgtgacattatatatggttgtaaattacctagggattgaggtttgcagggggacttcagctttcagtagcaaacaaccttgtggtgtccacatttccactatctgtaggtttctccagtacttgagtacagtgcttctaaaacattagcacgcatcagaataacgtgcagggtttgtgaagccagattgctgggtcctgctctagtttctcattctgtaggtctgttatagagggggccagagaatttgcatttttaacaagttctcattactgaccttgctgtccaaggaccccacgttgagaatcactatttcaacasaattcttcctcttcaatgtcatttcctaaatctcccacgtttccaagaatgacactgaggggagatacygaggttgaggatttatcatgatgtgttactatgtttctcattttccactgattcgccatgatagtgatataagagccaaaaaccttattccttaatgataagctgaatgttgtatgaaactaaagcaagaggcagagcatagaggatagcaaagaaaaagagggtaggggaaaccctttgctttgtctgagggcctacagttttactgatatgtctatgagagtttaagtgctgcaaaacagtccagtaaaaaaacagctgctgtgggccaggtgtggtggctcacgcctgtaatcccagcactttgggaggccaaggtgggcggatcacaaggtcagcagttcaagaccagcaagaccaacatagtgaaaccccgtctctactaaaaaatacaaaaattagccgggcatggtggtgcacgcctgtaatcccagctactcaggaggctgaggcagaagaatcacttgaacccgggaggcggaggttgcagtgagcagggatcgtgccattgcactccagcctgggtgacagagcaagactcctctgtctcaaaaacaaaacaaaacaaaacaaaaaaaaacaaacagctgatgtattaggarcagcctcaaccttctcagtgtgattgaagctcatgcctgtaactcctgtttggatcatctctcaggggcttgacattgagagactagcggtaaaatgatggtggtttctcatccttttgaggaacaccacaggtctctcttgcagtcctcaagggtttcagggcaggtgcctatcctggttgtgtcttgctgtaactacacttaacttccttaggaaacatactactttccatctaacctaattgcccaaatggtttggggccctaaagataatcaaaagttatctgtaccatttccttttttggtaactgttaactctttttctttttggctttttggacccattggattcccataggttttgtacaaagaaaatgtggggaaagccaccgcaacccctgtcactcctgagatgcagagagtcaaacgcaatcaagaaaacattagctcggtattgtcttgagaaacaaaagtgcttttaattttgcaaaataactcttgcagtttggcctgctcctaaccctgtcccaggttaaaaacaaacaaaatgccagttacatttgcatctgctctaaatatcacactacatttactgtagccattaactatttttaagctttcttcttgagaggtgttctcactaatagtaatagattaaacatarcatttccccccaacttgcaatataattaatagtgattattacctcgtagtgactttcgggcatgactttgtatctcacaggtgttatacaaagagaacctggggaaagcaacccccacaccctttactcctgagatggaaagagtgaaacgcaatcaagaaaactttagctcggtattttagaaaggaaaaataaatccttaaaatcttaacagccctggcaaacatggttgtaccactaatttatcttacagtttttccaaaacttttgtgtatctttaaaaattcttccttgtccacttaaaaacaacaaaccaaccccacgaggtcacagtgattttacttctttcttaaacttttgcttcctaccgtaacattttaatagctttaccttcagtgtgatataactgagccataacatgagccataacaccagctaagtgatgattttcagacctggttttctgctgtctgatgcctagatgctcttttggcttccctaggtattgtacaaagagaacatgagaaaagcaactccgacacctgttactccagagatggagagagctaagcgcaaccaagaaaacattagctcggtattttctaggactaaaaagaaatagtgcaacaacttggaaaataacattttaacatcataaaaacacgcctttctcattcaactgaaaaacacactaaaattttaaaagagaaaaatgcaacatcttggaaagtaacgttttaacaccataaaaatttgcacttattcaactgaaaatttacactaaaatagacattaactgtgcttttacattccaaaccatcatactaaacataacaagttaattgccaatgttttccttcccctatactttgaggtagttctacgtaaccaactataacaaatttacttcctaacatcctcaatcttctgctctcctttagttttaagatactttatgacatgggtaatactctgaaatggatgccttctttggatatattttggggttttagtgtctggaggactttgatttctatattagcatattggtttatgaagtctggacayaacctaaggaaaataatcacttgttttaaaggacagttctttcaaattccctacaatgtcagatttagagccaaataccatcgaatatgttgatgctgtaattcctagcaaatttcaagaggtcactctcttttcaaaattataccgtgccccttctttgaaaatgagtttcattttcgaagtcaaaacaagtcctttctcttccactggcgggcccttctggtccccagattagcctgttccaaaattggtcatgtgtctcactgggccccttcagttgacccaagcgtccctcaccagctcctatccatctctatctgctggaaaggctttgaggtttcagatttaggacagcaccactcattcayggtctctcctgcatcaggttctttattctgatagtttccggaaacaaatacaaggcaaagctgcctatgtattggatacccccgagatgagacgggtgagggagacccaacggcacatctcaacggtgagtcaggaattctttaggattggctggctgcctgtcagaatgtgtaaaaarggatwtagtcacaccatcatattttcataaagcaaattcatgacatttcaggtgaaatatcatgaagactttgagaaacacaagggttgcttcacaccagtggtgacagatcctatcactgaacgagtaaagaagaacatgcaggacttcagtgacattaactaccgaggtattcagaggaaagtggtagaaatggaacaaaaacggaatgaccaagatcaggagactattacaggtaactgagcctgggttgggggaggggattaactttaagtgagggggtagaagaacaaaagtagcattacctacatcaagtcaaaacataaaggacttcaatctgtttttctagaggtgcaagaaagctcctattatctcatagtttacaaagctgatttctaccttatctttgttctcctctgaggaaaagacatgacccagaacctaagctggaataagtgtgattcaatcctttggtggttgttaaaattcatgccttggttttcaagttattggaaaactccaagaacacttgttctgatcactggtttccctttcaggttyacgtgtctggcgtactaatcctggttcggtttttgactatgatccagcagaagacaacatccagtcccgaagctkacacatgattaatggtgtgttagctraaaaaggcttacaacataaacatcaccatttagtatgctagagtcaakgactttcatttgggctctgaagttccttccctccagagttttccattttctgagctgcccatttggcataaaaataccttgttaactagtgagcaaaacttactttctagataagttcaagttagaaaaaattttgtttcactgcctcagtgcatgtctcccattattatcatttctaatttttcttccaaagaaaaaacagtagtaattctattggagaaataatgaaaatacataaaatacataggcaaagggaagagaaaggatttgacctgtaggaacttcctgagctctattgcatcaaggaagtttattcattacacaaagcaggctgcacaacttcattccttcttttcatgttaaaaagcagaatactagcctggaaaagagaatgagaccccttttctacaaacagtaaaaaaaaattagccgcgagtggtgttgtacacctgtagtaccagctgttcagggggctgaagtgggaggatagcttgagcctagaaagttgaagctgcagtgagccgtgattgtaccacygcccttcagcctgagcaacagagaccccatctcaaaaaaaaaaaaaaaggatattatgtagagacagtcctcaaaggatttatactccagttttctgatcaagacacagaagtaaatccatggttgcattctgacatgtgcaattttaaaggtctgcccatggtattttgggaacacagagaaagactctaaattgatttgcagttagggaggactttctggagaagttaaagatggagtctgaatgtgaatattactatttattcattttggtgagccaggaaaattggcagggtggaggggagatgttacaaatagactcttggatttgaaacctggctgtacaacttaactgttccatgacctttggtcatgtacgtaagctctcatctgtaaaaataagaaagacaaacctacatcagaataactgtgagggtttgacccatgggaaagtacttaaaaccatgcttggcaaagataacaataactgagattcaatcactgttaggcattactaccatagaaatttcatgtttgctacatctcccccaactgcatctctcccagtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacaggtacaagtgcctggcgctgattttggcagtcccacccggccagctcattgatggttactataagagatgctttgagtacaaaaacaaatttaaaaatttttcatcctttcctttaatgagaaaagactagaattgtggagggctgcatgaagttagatgtttcattttctttgatttctctttttggaaatcattctaagttgggggaaaaagayatcactcagctgctaaacacagattaaaggatacctagccatttttcttcttataaagaatttgccccctttttttcagcttacaaacatgcaaaaaccacagagctcccacaacaacgatcatcttcagttgctacccaacagacaacggtatcttccatcccatctcatccatckactgctggagtaagtgaataacaactcacttaaataaattattcttaatttttgatatgtgcaaacatgattataagtattaggtattacggttttttttaaccaaaccttctattttatataatgctcttttattacatgtttcatattaatgatatcagaaaactttcattatctaactcaaattaatgaaaagcattattcaataacttaaaaaaaaaacccaaacctagagcaaagcatcagttttggctcattggtctcacctactatcttaaacatttgctgggcatagtgaatcatgcctataatgccagcactttgggacgctgatgcaggaggattgcttgagctcaggagtttgagaccagcctakgcaacatagtgagacttcatctctactaaaaaccaaaaaattagccaggtgtggtggtgcatctatagccccagctactgaggaagttgaggtgggaggattgcttgagcctggaaatttgaggttgcagtgagccataactgcaccactgtactccagcctggatgacagagggagaccctgtctcaaaaatcaagaatgtatagatgtatgcaatgtgcccacatatatacatgccttatcttasatctcccctattaatatatatagaaatggtaagccaaatcatcttcacagttcaccagactacttcacaactcttagtttaaaaccctggatctcattcataatatcctcaaaagcctaatactttaggattgatatgaacaatctttgtatgaagacaactgtctttattaaatgacatacaagaaggtctaaataagtgttagacctattatatttaaggaagggaatactgtaaagttctaattttccctgaaataaaccaatgcattcaattccaatataaatcccaatagcatttaaagaaactgtgctaaccctaaaatttgaaaaagctgcaaggataatcaagtaaaatttgaaaatgataatacttaaggactcaactaaaaaagaacaaaacatactataaagctattaaaattaaatatggatttagcatggcaatagatacaaaatatcgatttagcatggcaatagatacaaaaatagatgaagtccagaaacagaccctaaaagaattataaatcagcaagaaaggggtaagttatttaattatatgatctgaggtaaccagttatctatttagtaaaataataaaattagatacccatctcaaagcataaactgtagctgtaccaaagatttagatgtaaaatacaaaattgtagaagtacaaagaataatacagaatactttttttttatttttagagacagggtctcactctatcacccaggctgcagtgtggtggcatgatcacagctcgctgcagtctcgacttcatggactcaagcaatcctccagcctcagccaccagaatagctaggactacaggtgtatatgccattctaggctaatttttttttttttttttttggtagaggctcactatgttgcccaggctggtctcaaacccctaggctcaagccctctgcctgctttggcctcctaaaatgctgggattacaggcatcagccactcagcccggccacaattattttaaaatataaaggggaaagccttcccaggcaaattccaaaatctagaagtataaaagtctggccaatttgatcataaaattttaaatgtttctataacaaataaatacaaacatgtcagactgggagaaaacatttacagcatacataacaaaaatattaatattgaaaaagaataaagaactctaaaattcactgataaattattcccctcgccctcaaaataggacttggaagactaagaatagataatttatggcaaaataaatataaatggccaacagaaaaaggtgttcaccatgactagtaaccaggaatataaaaataaaagtgctagtaaccaagaatataaaaataagataaagtacataatacaaagtatcaaattgaatcaaatatcatattgtatcatattcgaacattttaacagaaaacttaaaaaattaggtcaggaatagtggctcacacctgtaatcccagcactttaggaggtgggaggactgcttgagtccaggagtttaagaccagcctatgcaacaaggcaaaaccccatctctatttgtaaaattattttatacatatatatatatgtgtgtatgtataaaataagtttaaacacacatgccatttgacctaaaacttttaccttcaaaagctttttcttcagaaattatttgcccaaagataaacggtaggatgctcattatagtgtaagaaaaaatggtgacaactaaatgtccagaaaaatgaaaatggctgaataattcgtgatattattaaaatgtgaaattctctgcagcagtcaaaaagggtaagatacagctatatttacatggaaagacttccaagctatattaaatggaaagaacaaatcacagtattatttatagtaatgttccacttatgcaaaggggaaaggaaatctatttgtgaatttgaatatatgcatgtgattttgaatatatgcatgtgaatttcaaaatgcaagaaaaaaccatataggttacatccaaaactactaaccagtggctgctcctaggaagaaacttttgatattatcacttattatatacctccaaattattacaattttaacactgtggaggatagctttgagaaacttttactactcgtatgctcccaaattcccagagtgaaagatgacatgcaatagtgctacgggttttcaaattcttctctaaaatacaagactgacctcttcgaaaggtagaaaaaggccataaataaaattagcagcatattctgtcttttctgtcagtacacacacacgcacatgcgcacacacacacaatttcatgcatacataacttagtatgaagttcataaagtgtacaatgattttaagctttttttccaaccatctccataatctaattttagaatactttcatcaccataaaaaaaactgtattcaaaactcttctggtgaattaaaacaaacaaacaaatgctggtgcccattggcattcattctccatcccctttctgctccatccaatcctaggtatccatttcctgtcactatattatttggctacctaagacatttcatataaataaaaccatacaatatactgaccttggtgcatggcgtcctttacttttgaagttcatccatgttgtatcatgtgtcagtacttcattcttgttactaccccattcttgttactacccaataatagatctgtatggatataccagatcttgcttatgcattcatcagttggtgggcatttaagttgtttccactttttggctattatgagtaatgctgctacggacatggatgtacaaattattgtgcagacctatgtcttcattcttcttgggtatacacctaggagtggaatttgctgggccatagggtaatgctgtatttaacatgtgataactgccaaattcttttccaaggtggctgcactcttttccacttccaccagtggtttatgaaggacccaatttctccacatcctttctaatgtctgttattgtctgtcttttttatcatcaccattctggcatgtgtgaaggggtatctcattgtggttttaataatttgcattttccagatgactaattttgagcatcctttygtgtgctttttggctatttgtctatcttttttggagaaatgtctattcatatcctttgcctcttttggtgggggaaggcattragttgtaggagttcgtcatatgttctggatattaattgcctatcagatacatgacttgcaagtatttcctattttgtgggttccttttactttgttgatgcttgcacattctcttttgttcaayttaagtttgtggagtcagtcatgagagatcttacaaatagatgtgtgttaactgttgcaaatccaacayataatatttccccttttccatccccacgaatagaaaatcttccgtgccatgtatgactatatggctgctgatgcagatgaggtgtccttcaaggatggagatgccatcataaatgttcaagcaattgatgaaggctggatgtatggcactgtgcagaggactggcaggacyggaatgctcccagccaactacgttgaagctatttaggcatttcaaagcatcacacttgtctgcaggacttacagatcctgcagtcaatgtttcggtttagactctccactgttacctaagttctcaagctgcctatggtttttctgtgtcaatgtgatttatggtagtaccatcctttctcctttgggttttaaaataagttgcagaacagacactttaaaagcttctgcaatattatttctgtgccyagagtctttctccattataaacatgttttaacattatttcttttctaaaacagggattttgaatatgccaaacacattaaaggaaaaatagcagagatgttcaccttttccttgctgattgctaatgcttattatttctaattcagttctgaagttataaacttataatcaatacaaaccagcaactaataaaacctctaattctgcaactctgtggatggaatgagcattatttatgtttaatggttttaatatctacctataaaaattcaatgaagcaaattgtacataaaattactaaaaaattatctaaatttaaaaaatgtactgttatgcctaagagtagacattctcaaaattctatctatacttgcattcagcaagcttctattacagttttaagaacatctgtggactccaatcctaacttcaagggcatctttcccatctgtatccagtaggatggcagcatgtggcaaaggcaaagggagaagaagcaaccataatggcttaatgtttaagtttacagactgttcttcctagaaggtaggtaagtccctgtaactttacagccgtagtaatgctgcctcaagcttcttaatgtgtctgagactcacagggagaaaatgctcttgtgaagagagcgcactcacttgcgaatgaccaacgtacacctctatgccaggcactgggttagaggctgaagctcaagtgaagaacaagagacagttgatgcccttagggaatttgcagacccaagaaaaggcagattatgcttaaccatccaaatggtgccaaatggtgctactctcctgctcccaagtcttccatcttgccttaaactggataaaaatgcaagtaggcaacaatcctattgtgatttccaactcccaaacttttagaatactaaagtatatgctatctccattacaatgagccatttttttgtttggagacagagtctccctctgttgcccaggctggagtgcagtggcccaatctctactcactgcaacctctccctcctgggttcaagtgattcttgtgtctcagcctcctgagtagctgggactacaggcgtgcgccaccactctgggctaatgtttgtattttcagtacagacagggttttgccatattggccagactggtcttgaactcctgacttcaggtgatccgaccacctcagcctcccaaagtgctgggattacaggcctgagccactggacctggcctggctggtttagttttaaatttcctatttactttatcggtttgccaaggcacactttgcaggtgctattgcaaagaacaacagaacctttgtctcttacagatttttctttaaagcctggaaaatgttcaacatgcagctggctttccaagatccttgagttccacatccacaaattcaaccaaccatgaatcaaaaatattcagaaaaaaaaagatggtcacatctgtactgaacagctagactttcttcttgtgattagtccttaaacaatacagtataacatatttacatacatttacattatattaggtattataatcaagagatgatttaaagcacaggtccccagcctttttggcactagggaccagttttgtggaagacaatttttccacacagtggggaacgaaactgttccacctcagatcaggtgttaggttctcataaggagcacaaacctagatccctcgcatgtgcagttcatgaagaatttactgcggccagtgagctgacaggaggcagagctcaggtggtaatgcttgctcaccggccactcgacctcctgctgtacagcctgtttcctaacaggccatggacctgtaccactccacagcccgtgggttggggaaccctgatttaaagtatatgggagaatgtgcataggttatatgctaatattaggtcattttacactagggattttaatatccataaggtaggggtggtcctgaaaccaataccccatggatattgagggatgactgtatatataaaagtagagaataatcctacatccaccaactagcctcaaaaattatcaactcatggttaaccctgtttcctctccaccaaaccaatgcactcctctcattaccttgtaacttccttatactgaatctcattatagattagtcacctttcagtgtgtatcttataaaggactcttaaaacattaatcacaagaaaattaacacaccttaaaaactggcaatcaatatccaatgttctaatcttcctgccatctgcttgtgcttgttggtccaacgatactagggaagtcctttgtatatatctccactaccacgtaggctgcaaagagccatcttcaagaaactataaaagggagaaattaggtctatgggttacatctcaatcaaatctcactcaaatgtatgaactgtattgtgtcccaccctcccacccccaaattcatgttaagtcctaacccccaaggcctcagaatgtgaccttgtaaataggatccttgcagatgctgttaattcagatgaggccctaatccaatggccttgctatccttataaaagggaaatttagacaaatacacaggcacataggtagaaagtcatatgaagatgggagattggggaaatacctctacctgtcaaaaatggccagcacaccaccaagctagctggggagaggtatgggacagataacttccacacagtccttagaaggaacaaaccctgctgataccatatctcagacctctactattcaaaactgagacaatacatttcagttgtttaacttattaggtttgtggtactgttacagcagccctaggaaactaatacagtgtctttcaacatcactgtttaccctaattgttgttgttgttgttttccttaaaactatggagcttttcttcggctgccatcaacatgcttggttctgcagaggaagttaaggtcatgttggggtgaggcatttacttcatctggtgactagcctggcagtgccacctctgccctcgcccacaccatgtggactgcctctccaagcttgcctgcatctactcagcccttatttgacgaaacctctcttctaacaagttcaatgagaaactgaactcattaacaacaacaacaacagaaaaaccaccacctctggatttagaaaccagtggaacccataaaactatgcataaatcagaaaacctctgtggttaaaaagcaggccataaaaggggaaaaagaaaaggaagggttcatgtttgtggaggaatataacatacactttgtggtatttgaattaaactattcatactcatttcagatctcacgaaaacaacaaaacaaaaaaccaaaatgtagccaacaaaaacaagtaccagagtttagtttttatagttttatttcaggtaaaagtgcatttcttaaaaaaatgtttcaatatccagtttccattggcaagtgataacagttaaccctcaatgattcatgaaaagttttactgtgaatcaaacatagaattctgccccccctcaacagtcataaagaaccagaaatagtaactgtaagtgtgcctacttcaaacactgtataaagcagtggtcccctaaccttttttcaacagggaccggtttcgtggagacaatttccacagacacaggtgttggggtagatggtttcaggatgagactgttccacctcagatcatcgggtattagattctcataatgagcgcacaacctagatctcttgcatgtgcagttcacaatagggttcacgctcctgtaagaatctaatgccacccaggggtttgagacccctagtataaagcattacacaatcaaataaaactgactgcaccattatttccattatttgcaggtaactgaggaatgaacaagtacttctgttaggcttcaacttaaatcatttttaagacttatcaaatacaaatactttgtgaatgtaaaactaagctctcttagcgtttaccaaatgatcgggacaacaatattagagggttaataaatgactgatttggcatctatcagtctttttgtaagtgctatcagtcaggtctatctacaggaggtagtgcagaaagcaactgataattcacagaccatcaaggtcccttaacatcatggcaaatacgtaactgtagtttgagagtttaagtaggaaaaagaagtgtacttataaagtagtagtgtttcctagtatctgtaatttgagcaatagtaaaacacgtaagtaaaatcaggagaagccattctggaaaacacaggggtaacagaaattaagtaatcaagaccacattctgccagctagaagcaaataactaaattgactaacatgccatgcatgagcaaaaccttcctccataaaagggattgacaaactctttaaaaggccaggcagtattttgactgttggaagccatacagactctgctatactactaaactcagccactgtaccaggaaagcagctaaagacaataagcacagctgttccaataaaactttatttctggatactgaaattttaatttaatatgttttcatgtgtcacaaaatgyccttcttttgacttttttcaccattaaaaaatgtaaaaaccagtctcagctcacagatagtacaaaaaacaggtggcatgctagtttaccaatctgtgctctgtaaaaaacttaggagttaagactgccatccttcagtttctatactcaaaaccaattttgctcttaattgttttcttttagaaacttcctattctataaaaataaaaaattctttagacacttgttagctattcaatagtgtatcaaaataattgttagactatactctattttcagttccatgacactttattttgaagatgatcttcctagttatatgttgtttatccgtttaagaaacaaagctgccttttgttggaaatacttattaacttactgcttttgtgggagtattaataatgtattttaacataatctctcagggtatttatgaacatcaattataatactgtgctatgtacagaatagctctcagagactataggctatcagctatttctgaagtatacaggagtatataggacagcttgtctctctactaaatgtactatgcattaaaattccagctcaatctgccttttccattctcttcaactcatcacttctcagtgcatcaacttctatcagcatataagcttgctgcccagtaaattcagctttatctacaattataaattggcacactgtggccaaaaatattccctctgctacaagtagagtacaaaagttagagtttttttcttacttgtgacatcaacaatggaaaatattgtcttcaattttttaggtaagatgaacggttatcttttattccaacggtatttacagcttaccataacacatttggttttaactgttctttggagaaaggaaggcttagtatgtaaagaaaaaaatgattaggaccacatcggaaaatttaacattctatttcagaactgagtaaattctcacaactgtttagactactatattaaatatttatagatcttcaaacttcaatgacttacactttaacggctacttgcaaagagcaatatgtaaagcctggcacataayatacttattaactggacatcagaaagcacgaaacccaatttgttttacagatcaaactatcaataaattttgataaatttttaaaacctattacttaactttcggctacattttccttagtgctttcagggtagttcttacagattatttaaatatgtgaggaaaatctaacaccttaacagaattccaagaaaaactcacttttcgagaatcatattattcaactccatctttcaaatttcactttacgatgaaacaggaattttcaaccacataatataacagaaaattaagtgaccagaggtccgcagtataatgacagggcatatctgctagactgacttattcattatagcactactaaatttaactgccagattaatattaggggtagtgttgattttccatgtttattaataacgatgatccataatagaaggcaagatttatttagagactaaatatattctaatacttagaaatcaacttttatattaacaaaaacataacccacaaatactcatgagaaaatactttgtctactttgccttatcaataagattctttataacttga

SEQ ID NO: 12265 - DNA, 161065 bp, Homo sapiens
aggtgcttgggccgggtgtggtggctcacgcctgtaatcccagcactttgggagtctgaggtgggtgaatcacgaggtcaggagttcaataccaacctggccaagatggtgaaaccctgtctctactaaaaatacaaaaaaattagccaggcgtggtggcaggcacctgcaatcccagctattcaggaagctgaggcagagaattgcttgaaaccaagaggtggaggttgcagtgagctgagatcatgccactgcactccagcctgggtgacagagtgagacttcatctcaaaacaaaacaaaacaaacaaaaagaaagcagaaggtgctaatgtgccatatggctttcaactgcacttgacacaatattttgtaaattcttcaaaaatgagttagctgattttcaagcaatgtttaagtctgcagcagtagctcatctgcaactgataaaactcacatttgagaagtggtttgaggggcaacagcaagttaaaattataacaaagtccaagtcaaggccatagccctaacgttctttgaaataacctgccagttgattaaggtaactcttgtgaaattgttttttgagagtggatgaaatggcaagtgtagtaaatagaaactagactgtggcccaagaagttcaaaagcactggaataaaattctgaaactaaggaagggttcctaaaactcgtgggtatagctaaagtcatgggtttagctttgaaaatgtctctattttgaaatggcatcagataaaatgctatcttttgttatacttttcataatgttatacttttgagacttctatcagtccatagtattttataaaaacaaaattaaatttagacttataatagtctttgggatggtacattgaagtggaaaagaagtagctggggaaagatgcttactgcagaaggagggcatactttctgatactgcatgagggatgtcatcgggtgaagttaagaacgacaaaatatagtggactggaaacctattctcaggagaactgtagccatgaaaagtactgttattcattcctgacctcctggaaccaggccctaactcatcttctcagcaaaattgcacatttgctatggacctactgggtagtaccttctttgtttcccttttctgaatgtgagggttaattcaggttttatttttctgttccaccatgaaatgtcgtgagtgacgaggactctattgggctctcagtgaacagaagtgtcatgagactgtcatgagatccttgcttgcaactgaaagttatgtttgggcttttttttttaaaaaaaaatgttagaggaagtggaggtgaatattttgtgtgggcaaaagaggaacaaattatttctgatggaagctgcgctgtcacatattgtaatatttcgagacagggtctcgctcagtcacccaggctggagtgcagtggtgcgatctcagctcactgcaacctccacctcctggactcaggtgatcctcttctctcagcctcccaagtagctgggactacaggtgcacaccagcatacctagctaatttttggatttttttgtagagatggggtttcgccatgttgcccagactgggagaaacatattttaaggtataattagcatgttgtgttgttaaaatctcagtgataaacttgcatattagcaacagagctcttgtttccacattatacaatttcagtttattttcttgtatcattccaatgctttccctgaacttaaaataaaagggatcctccacatattggtggaacacattctttgcatctgttatttttctattctttttttgccacacaaatctgagaatgtcacctcgatttttggatccttcaagttcttcaatggaagaaatgtaagtccataaattgggttaaatggtttctagtggagtgtgtaatgataaaaaattatttttaaaatgtagttttggctgggctctgtggctcatgcctgtattcctagcactttgggaggctgaggtggacagattgagcccagaagtttgagaccggcctaggcaacattataaaaccccatctctactaaaaacacaaaaactgaggtgagaggatcacttgagcctggggaggtggaggctgcatgagccgtgattgcaccaccacactgcagcctgggcaagagagcaagatcccatctcaaaaaaaaattatattacagttgaaaaatcatagaatacaatgtttaatatgataactcaaatatgcattgttagagcctttgaaaaatgcaattttattaaattatttaatatttattgtctgataaatttaatttttatagtgcatgtgtaaaaatattatagacaatttgaacagtatttcagaagcactttcaacaattatattgtgtaaagtgtcctatgtatgcatgaataaaggacatgtataaagtatttagcatgaggaaaattgagtctttctcaacctaggcatcataagtttcaggagtaaacattcagtatttttttttgtattttttaaaaccagaacatttattgcatgactaatcatagacattcttaagatgaactggatgctgcaacagctgccctcttgggtttaagtattgttccttcatagaatccatgcctgaatctgtggtatacaatttttaggtgcctcattccaccagttccggtggtattttgtcttttagccttggcactccagttatactttctcttgcgcttggcagcgtagccacatttgccacaggtcgacttctgaaggtggtaggccttagagccacggcggcaacacaacgtgtgcgtcttattgcgacgctttccaaacaatgacgttcccttcgtcatctggcttctgcggccaagaccagagagaccggaagagaaggcacttccgctatatcacgctcagaagctcaacattccgtgttgaattagagtctgagccgagatggcattactgcactactgcttgggtgaccggagccagacactgcctcaaaaaaaaaaattctcccaggctcaagcaatttccaacctcagccttccaactagcttggactactggtgcacaccattacccttggctaatttttgtattttttgtagagatagagttttgtaatgttgcccaggttgctcttgaactcctgggttcaagcaatctgcccacctcagcctctctcaatgtgctgggattacaggcgtgagccactgcaccctgccttgttcctttacttgcttagtaaacttgctttcactttacagtgtgaactcacccctaattctttcttgcatgagatccaagaaccctcccttttggttgtaactgcccaacaggttctccttccctgctgcctagacagagctgattcatcaagacaggggaattgcaagagagagtttaattcatgtggagctggctgtacaggaacctgaaatttttttattactcacatgagtctccctgaaaactcggggatcagggtttttaaggataatttgataggtaggtgtcagtgagtcgggagtgctgaytggttgggtaggagacgaaatcatagagatctgaagctgtcattttgcactgagtcagttcctgggtggggtcacaagaccagatgagccagtttatggatctgggttggtgtcaggtgatccatcaagtgcagggaatgcaaaatatctcaagcactgatcttaggttttataatagtaatgttatccccaggaacaatctgggaagggtgagaatcttgtagcctccagctacatgactcctaaaccatcatctctcaccttgtgcctaatttgttagtcttacaaaggcagtctagtccccaagcaggaagggggtttgttttgggaaagggctgttaatgtctttgtttcaaactataaactaagttccttccaaagttagttcagcctatgcccaggaatgaacaagagcagcttggaggttaaaagcaagatggagttgattaggtcagatctctttcactgtaataattttctcagttataattgtgcaatggaagtttcaggttctggatcaggacccctttctggtaacacaaggatggttatgaatgcatccagatatccaaaaagttatctctgaaagccagagatttcctttccctatgggttcttcccttgcatgtcaacccaaggattcactggggacctagaattgtgcagggcagttaggaagagagagacaaaagagagaagaggtgaagtagttttgaagaagagaaagaaggtcccatgcagcctcagttttttttccaacaaacttttcatgctgggaaataggatcctggtttatttgtgggagggattttataggagggtgagaaaaaaatgccctttgagggtagagtctgtggagccctaattggggaaaaggagtcagcctgaaaggaccaggagaaagcaaagagataaagcaaataagctataaatctttcttcatggtccagaacatataaaaaaaaatagaggaagcagataagctgtaggtctctttttctttatggccaaggacatatggcctttctgtggaaagaacgtaaataagtcacaaactttctgctttcatttatcatcaaacgcctcagctaacagaagaatgcaagttagctccctgctaccttggcctcccaaagtgtggggattataggcgttagccactgcacccaaccaaatctcctcttctcatggctcactgcagccttcacctcctgggctcaaatgatcctccttccttacccttccgagttgctgggcccacacgtgcaggccaccatgtccagataatttaattttttgtagagaggtctggctatgttgcccaggatgatctcaaatccctggcctcaagcaattctgacacctcagcttcccaagtagctgggactacaagagtgcattaccaagcctggctactttttgtatttcttgtagagatgggggtctcacgatgctgtccaggctggttttgaactcttgagctcaagtgacctgcccacctgggcctccaaaactgctggcccatctcaaaagacttaatccatttcagtatcaactctcaaaagtcttaatccattcctgtatcagctcttagggcagaataccccctaaatattatctgaaccacacatgggtgagaatcaaggtgtgattcatcctgaggcaaaatttctgcccagctgtgaatctgtgaggccagagaagttatctgcttccaaaatataatggtgataaaggcataggatacatcccccagccctggtaaccacccttctaatctgttactgtaaatttgacgtttgtactttgcacgtgtaaaagcacaggcagtatttgtctttctgtgtctagcatatttcgcttggcataatgtcttccgggttcctggatccagccacggctccacatcaaatccccagcgagatcctagttccctgactattgagtagcttcagcatcatcggcaagagtggatggagtccaccaagcttgtaaaaatcggttttgacttagttcaacttgttaagaaatcatcttagtttctaatataagtggaccacaactttaagctttaaccttaaattttgaaacattaacttaaaataggcaggcagcaacgctgcttcacaggacaagaagtagtcagaaaaccaaagacatgctgcctgtgaaccagagtaaataacaggctctatttcggccccgcttaccccatgaaaccccgccccatcctccgccgcggctccgtcccgccccacctagccacgcccactgccgctccggcccggctccaccctctcagggtccctccccgagtcaggcccctctttccgacccgccccttgctggtcgcggctcgcccaggccccgccccctggcctcccagttttttctctccgctagcagtttccgtcactcccggaagcagattgcgccagggaaaggccttatcgctgtgtgtgtgtttcagtctacgtggattaaacattacttcgctccgtctgcctggattaaacgtgcactttgcagtcctcacttctccgtaccagtgatctggggatcgctacggaccttaaaatacccatagccccttcgcccctgcaacaggcacttctccccacgtaagtccgagaattgcttccctgtcggtttaaaatctctctcaggctgttccttgccccctgcctttctgccatgtagataaccatgtcgataaccccattcaggtcgtgttcctgcttaaaactctcattgacccctgcttcggccccgggcgaagtcaagtcctccctcgcgaggtggattcccaccagtcgagacccccgagcttcgcccttgtcgacgcctggaggggagcgcccgctgcccagctcctgaaggagccgcttcttctcccaggtcctgggattctgcagaccctccctgtcctgagacaccgtcccccgcgccacctagtgtcctccgcgcgccacctagtgtcctcctcacgccgggtccttcccctccccaggctgccccttcacagccactgcttttcctgactccgcgttgcaggaggtcacccgagtctgtcttgtgacacccactgtcgttccttcccaaatttttactccastggaaaatgtgctcttccgggaggtgggcatcgtattcctcccctttcctcctgaatgtgtgggtgagagggatcaggagaggaaaagagggggagcgacgggacagaaagaaaaactggggagaaaagaatgagtacacggcaaaatggatgataatttaggtactggcaaagagagcaagagtgcaagaggacgcatggagaaagtagcacggggagaaaagcacataaagaaattagggaaaagggagagcttcagggagctgaagggcagcaaaatagagaggggcggcaaaggaggaggcactgcagtcagacgcggggggcggaaaaggtaagagtcggagccgcggctgacagagccacgtggtgctgggactgaaggagaggggagtgggtaacaaaggagagtagagggagaaccacagcaaggaggaagcctaggaagttgggggtgctagagagtgggaacaaaggagatgtaacagggaaaagggaatttaacagggaagagggattttaacagggagagcagacagggagctcagatgggggaaaagaggcaggaatacgtggcggctggggacaatgggaaagtttggggagaaagagcaacaagaggtgaaataaatttcgaagcattgggcagaatagacataaargagggaataaagaaaggggagaaaaacagcaaagggaaaaaagacgtgcagaatgagagcgggaaacacatagtagtgaagagagtgggcgaggaccccacccagatgagctgtgagttgattggatatggatggtggttttaatgtattgatttgtgactttatactctaatttaaaatttgtttctttaaattgtactcatgaggatgaaaattaccactcttttctacaaggcttgtgcattttgtatttrtttatatcaaaagatatttggaatccctatttagccacagggcagtgacttgattyagtcattttgtaactcttctttccagggagggagtagaggatggaggaggagagaaataggcaagaaatgactgactgtcactacaagatgtatctttggttttttgtttgttttttctctttttgagacagggtctctgtcgcccaggctggagtgcggtaaaattatatcggctcactgcagcctctcagctgcactccatcctcctcagcccctgaaggtgctgggattacatgtgtgaaccacctctacaggcctacaatgtatgtctttgaaggagagttgagagtgttggttttttgttttgttaatggatttacttttttccttgtagttgctttacagttaattcattgttattttggaagcttgatttaaattttagtttattcagtttcttctataattactaacttctgaaataagatttgatgtcatcctgtaatcagctgatgtcattaatttctcaatattgcctttttttaacttttaccccataatttattagatttttcaaaaactttccaaactgttaaagcgtccagtgcggtaaactcaccacgaagtacattagattcctcagaacttcttcattttataactgagaatttgtaccctttgaccaacatttctccactttccccacccagcatcctgtggtaacaactgttccgccttattactatgaattggacttttttagattctacttgtgagaacatacagtagttgtctttgtgtgtcagtcttatatcgcccagcataatgtcctccagattcatccatgttgttggaaatagcaggattttatttatttttatttttattttttatttttgagacagagtctcgctcgctctgtcgcccaggctagagtgcagtggtgtgatctcggctcactgcaagctccgcctcccgggttcacaccattctcctgcctcagcctcttgagtagctgggactataggcacccgccaccacgcccggctaattttttgtattttttttttagtacagacggggtttcactgtgttagccaggatggtctcaatctcctgacctcatgatccacccgcctcggcctcccaaagtgctgggattacaggcgtgagccactgtgcccggcaggattttcttttttatggttgaataatattccattatataaatatacacacacacactctgtatatatatatatatatatatacacatacataaatatatatacacacacattttctttacatattcattcctggatgggcactttggttgtttctatatcttggccgttgtgaataatactgcagtgatcatgagggggcagaagttcctaagttttttgttttttgtttttttaagtagagacatggtcccgctgttttgtccaagctggtctctaactcctggtctcaagcgatcttcccatctcagcttctcagagtgctgggattataggcatgaactaccacacctggcctagatgtctcttaaacatactgattggattgcctttggatttatacccagaaatgagattgctggattgcattgttgttctattttgaatattttgaagaacatccatagtgtttttcataatggctgtactgatgtgcactcccagcagcagtgtacaagggctcatttttctccatatcattgctaacacctctcttgcctatttgataatagccttcctaagaggtatgaggtgacagcttatggtggttttgatttgtatatccctgatgattagcgatcttgagtaccttttcatatacctgttggtcatttgtatgtttttttttgagacagagtctcactcttgttgcccaggctggagtgcaatggcgtgatctcagctcactgcgacctcatcctccgaagcacctgagattacaggcacctgccactatgcctggctaatttttgtattttagtagagacgggggtttcaccatgttggtcaggctggtcttgaactcctgaccacaggtgatctgcccgcctcggcttcccaaagtgctaggattacaagcgtgagccaccgtgcctggcatttgtatgtcttatttgcaaaatgttcaggtcctttgccccctgtccccccyccgctttttttttttttgagacaaagtcttactctgctgcctagactggagtgcaggggcgccatctcggctcactacaacatctgcctcctgggttctagcgagtctcatgcctcagcctcacaagtagctgagattacaggcatgtcccaccatgcccagctaattttttgtgtttttagtagagatggggtttcactgtgttggccaggctgatcttgaactcctggcctcaagagatctgcctgcctcggcctctcaacatgctaggattacaggcatgagccactgtgcccggcccaacatcaaagaactttaaaaggcattcccttcctgacttaaggaacaacttctcattgtccaggccttcttgttgtacagccaacaaaatactgcaaatctccaaaatattcttcaggatgtttattgaggaaaattttattgaaaggagccacacaatccaaagctgtattgttcaagggtcagctgaattgaggagcaagtcctaagctgagcccacggggagagtgggcagctggagtggtggtgcattggtcctgagggcrtggaacccagagctgcagcacagcaggcactctcsatagtgacttctgtggggtccatcactttgggggctrcatttgttattttggagtattttgggcggcaagttaagatggttatagatgcattttggactatctaaatgtcaatatggagagtttccttggaagatgttgggtctcactggggtatgtgcatcattggagacatctgttttagtagatggtggtgccagtgttcaagggtggggtcattatgaatggaatcgagtgtcttgggtcattgagtcctcaggtatctttgtgtgtattaggtcagcaggagtttatgagttgttggggcatgtgggatttcgtagcacgatatggggagcactatggagtatctgggaagggtgtggaccccaaggaagtttgtaaacctgtctcagtttaggaggggaacgttagggcctcaaactctagtgacaaaaggctttcgttagggagggttttctgtggtgggtctatggcaggatggtggcttagggaagatttttcaaagaatcagagaatatgatatcacaacgacctgcagcacaaagatttcaactgggactgtcctcggaagatacagctgttactttctcgctgccaggacagtggtgattactttccccccacctctgtctgctgcaacaatcacagggagctacgaggcaaaatgctttaaactcagtgtggaacagggatattttctccaggcaagagggtccactaggtgctggggaggcagtttggggagaggatgggtaatgctctttggagaatgacaggcctagtaattgcagggtgtaaaggaaaaaacaaattttttcctttctactctcacacttaacacagaactcttctgtggccagtgttggggagttttctcctacacactaaaaaattctccagcagacamcagctagattgccttakaattcaatttaattctggcactgtctacctggagttagagtcatctcccacaggttgcccacaggtaaagggctcagtctcacaagacctccccggctcacttcagctaccatttcgaaagtagtaggttgtcacctatacttctgacctactgactccaaattggcattcctactaccccagccaaaggtttgattaatttgctaggatggctcaccgaacttagagaaacacatttaccagtttcttattgttgaaggacaaaatcacaacaaattcgatccttttgtagttaataaatgtgatgattgggttttcacactcatgtgagatgtgcttccctcaaaccttgttacgatgtcgtgataaggagggaaattattacaaattcattttttaactcctgttcttgttttcttttttggaattttcttttttcctaaacgtgacttatttcaagggtcagtttgctaatgtggcgtttagcatgagagacttcattctggcttggtctggtagtgcgggaggctcgtacaaaacaacggcctttccataaaaatgaacaaaataatgcgcttggccaggacatgggtggagctggaggcgattatccttggcaaactaacacagggacagaaaaccaaatactgcgtattctcactcataagtgggaggtaaatgatgagaaaacatggatacgtagagggcaacaacacacactggggcctacctcagggtggagggtgggaggagggagaggatcaggaaaaataactaatagacattaggcttaatacccgggtgatggggccagacgtggtggctcacacctgtaatcctagcactttgagaggccgaggcgggcggatcacctgaggtctggagttcgcaaccagcctgaccaatacagtgaaaccccggctcttctaaaaatacaaaatgagccaggtgtggtggcacatgcctgtagtcccagcaggaggctgaggcaggagaattgcttgaacccgggaggcggaggttgcagtgagccgagatcgtgccattgcactccagcctaggcgacagagcgagactctgtctcacacacacacacaaaaacccaggtgatgaaataatgtatacaacaaacccccatgacccgtttacctgtgaaccaggctgcacctcctgcacgtgtacccctgaacttaaaatataagttaaaaagagaaaaaaaattggcctattataaagtgtaacaactgcaacgtctatttttacctctagggaattattttaaacattgtttactgatggtggtattgcccattaaatgcatgcacacacacagaccctaaagcttatcgtttccttccactctgccctaattgaaacaaaacatactactaactacatttctgcccgtatgagtacccctcttctgtgctgaaatcttatttatactctccgtcttcacttcttgcctcccattccctcttgaatgcatccagtcaaacttgcatatccaccattccactgataactttatttttcagagtcaccagtgacctccccatttctaaatccaatgtatttcttttcctgctttagtctttcttttcctgtcaggagctttctgtttaattttcttgtcacctccctgaccattttcctctgctgctgtgtccggacttcgaatgtttctcaatgtgggaaagactcatggcttagtccttgaacctcttcttatctctgtccacacctactgtctttcctcatcatctcatctcatggctttaaaccccactgtattagtccattctggaattgctacaacaaaattccagagaccgagtaatttataaagaaaacaggtttaattggctcacagttctgcaggctgcacaggaagcatggcaacatctgcttctggggagcctgtaggaagattccaaacatggtagcaggcgaagtaggaacaggcgtctcacgtggcgggagcaggagcaagagagagtgaggggggaggcgctacacacttctaaacaaccagatgtcgtgagaactcactgtgataaagaacagcaccaaggggtggtgcgaaaccattcatcacaaatccacccccatgatccatccacctcccaccaggccccaccagtaacggtggggattacaattcagtgtgagatttgggccagggacacagagctgatccatatcacccacctactcacctacacgtctccatgtcccctgcaggcctgtcccctgaactctagaattctgtgtcctgttgtctcctctgttgtctgttcagccgtctaagagacgtctccacctttatgtgtctaaagtgacttcctaaactccctaagtacattcccctgcgctcctgcacatctcagatgacggtggccctatacttcctggctctagctttacatgtcaggatatatttgaaatagagaagatatgacattatatagaagggttttaattcaaatgataaagaaaagttacatttacctaaaatggtagggaaatgcatagtttctaaaagtgctgtgagctgtgggagaaaaatgtttgaagacctcgtccctacctgatctgctgcctcgggacctctctgacctcatttcctacctgtgtcctcctcactccctctgctccagccacacaggcctctttcctattcctggagccgagggtgtctacctgggctgtccctgtgcctagaactctctggcccctcagttgcaggtaatctggcaagatttcccccatcccgagctgcaaaggtgccctctcccaccagcatcacatgagacttcccactcatttaaacaaaacttactactatgttgtttttacattttgaggatctggggaaaatggcaacccaaagaaaagtaactttgaaacaaccaacatgcttttagtttcctgattttgctccattcagcccctttcagcttatgaagccaacctcctccccttagctcacagaacactcctttcattttaagaatgaggtgttgtctgattctaggattgcaaataaaagccaataaaggcaggtccatattttctgctctgtgtgtttctttctggccctttgccttccactttctacagactggtgacagcaaggccccaaggggaggtcagagctgggagactggggctgtggtagtcttgccccctttgagactactcaaccctcgcttcacactagagtgccaaggcatttgtaacacatggttcattcccccttatagagattctccttccagtagttagggtggggcccagcctccgtaatgttttaggtacccaagttgattttttttttttttttttttttttttggtgacagagtctctgtcgcccaggctggagtgcagtggcttgatcttggctcactgcaacctccgcctcccaggttcaagtgattctcctgcctcagcctcccaagtaactgggatttaaggggtgtgccaccatgcctggctaatttttgtgtttttggtagagagggtgtttcaccatgttggccaggctggtctcgaattcctgacctcaggtatccacccgcctcgacctcccaaagtgctgggattacaggcatgagccaccgctcccagccccaagttgattctcatttgtatccagcattgagcttccagcctctgtgtcccccatttccgagggcagagctcagcctgtgacccacagaggtgacggggggctgtgcgctgcatggggtttgatcagggataggtccgtgccctgaatgggagctcagtccagcctagctacacactgcwscwgcctgtgtgtgggcttctcccagaggggagctaatgctgaagaaaacrgtgaaagattcacttggtctttgtgtaggaatttattattcttgcatcccccctggtgcagtgggctgtctctccacaggctgagttcttccctgtgtgcatggttgtgacacagaaaggaatgtgttgtttccaarcattaaacaacagattttttaactttcaggtttgatgtgtgaataattacattgactgagaaagaaacccagaagaggaagaagaggaaggaaaaggagtcagtgatggctactcaggtagagtgatactttactcaagtgaagtgatattcttggtgggtcattctgtctccttcctttgtgaagtacagggcgtcggagttgcaaatcttctctgagtctgaagtgtccttcctgacacatttgctcatgctcatccatgcttttcctcagttcctctcatcttatttagattccatctcaccatgatccagtgacatgaacttgggaagaggctgcactgggcatggtcctgggaagggctcacacccagacatggatggagatggggtgagggtcccgtggtatcagagctgttgggcagcagggattgtttaggggccacatctggatgcactgtcagctttctgtagaccaggaatagagaagctgcatgtggaagtcacatattaatgtgcataaatacctagtaaattatcgaaaggggccaggcgccgtgtctcatgcctgtaatctcagcactttaggaggctgaggtgggcggatcacttgagctcaggagtttgagccaacatggtgaaacctcgtctttactgaaaatacaaaaattagccagtcatggtggcaggggcctgtaatcccagctactcaggaggctgaggcgggagaatagcttgaacccggaggtggaggttgcagtgagccaagatggtgccactgcaccccagcctgggtgacagagcaagacttcatcctcaaaaaaaaaaaaaatatggaaaaggaggcgtgtaaggggagatctttctgcctgattttatactacatttgaagctgtatgaatgagtcactatttctaactgccttaatgacagggaattgaatggaaaactagatacagacattagagcgtgttttattccatcattgatttaaaaatatgaaatcaacctgaatgtcagattctagccatggtcagaatatccatctcacagagactgcggtgttcctkcggggactcttaccagcagttgttttaagttttaaggttataattttgctcagatgtaagagctgaacatttgttatcagagaagatggagccaaattctctcactgcaccaattattattaaatattatatttattttaaacatcacatgatgtatatatttgtttttttggtaaaatttcaagcagagatgcagtttaggcattaagaagttaatacaacacgaggatgataggaaataattttgttttgttttttgctttttgttttgtacggagtctcgctcttgtcacccaggccggactacaatggcgtgatctcgactcactgcaacctctgtctcccgggttcaaccgattttctcttgcctcagcctcccaatagctgggattacaggcgtgcaccaccacgcctggctcatttttgtatttttagtggagatggtggggggtttcatcatgttggccaggctggtctcgaactcctgatctcagatgatccgcctgcctcagcctcccaaagtgctgggattacagtgtgaaccaccacacccagcctgtaaataatgttttattatatatgaaattcatgctaaatgagattttagctgttctggccaaaacagagggaaaaaaaaaaaaagtaactgtgagatgatgggtgtgttaatttgttaaactctaatgacttttttttttactatccataccataataccatgttgtataccttaaatatacacaatgtaatttatcagcaaacaaaaatgggcatcaaggaaacattttagcttttttttttttttttgagacggagtttcgtcttgttgcccaggctggagtgcaatggcgcaatcttggctcactgcagcctccgcctcccaggttcaagcgattcttctgcctaagcctcttgagtagctgggaccacaggcatgcaccaccgtgcctggctaattttgtatttttagtagagacagagtttctctatgttggtcaggctggtctcaaacttccggcctcaggtgatccacccgctttggcctcccaaaatgctgggattacaggcatgagccaccgtgcccagctttagttttacacagaaagaaatttataacctaagaaaaggacatcaaggcatatatattttaaaaatttaactacagaatatgaaatggctcctagaatgcagtaaaggaaaactgagcaaagaatgaaaattattttkgtttgatttccacaaaataatgaaacctcctcacagtccaaggaattggaaaatggaaatacgaagggttttcattttccccatagcctcaaaatgtaaacagaacatagtagtaagttttttttttttttttttattgggtgggaaatccacccaatatgtgtcgttggtgtatgaggacaccattgcaccttagggtagtgggaaatcttgccagatccaggaaaataggaaatgcaccatcctaaagaggcaatcactctttcagttacccaacctggaggaacccgggtttcttttccctgtcactttctccatcatccctcatgtttccgtggggagctacagttgtaagttctgtggcaagagtcagtgagaggtgtcaagatgcatttacgtgtcattatgagattttagaaaacaattcttcagtacatgttctgttgtgaaatttcattgtgccagtttttcaaagatacatctttttttgttaataagcagtaatagcttgttttgcatcctctttggaacaatctctaaatgaagacatatggatcttttataatttttcaccatggctgccacaatgctctcttcaccacaggtgtttgagggttccttcaggttggacagtttaaagagtggttgcttctgttaggacgctataccacaaaagcaaaaataaataactgatctttctttggaaggcctggctcgctgtgtgattataaaatactgtgtttttttaagatctaatattttgttgcttacattttatttgcttgaatctttaatttgaatttttctgtatatcttgttgtagattatatttgattataaagttttagattataaataacataataggttcacaagtagattggcaaacccctccattttctttccaaaattattatggttctccttttacacaacacagccacatattatttaaattccacatattggccgggtgtggtggctcacacctgtaatccaggcactttgggaggccaaggtgggtggatcacctgaggtcaggagttcaagaccagcctggccaacatggtgaaaccctgtctctactgaaaatacaaatattagccggacatgatggtgcacgtctttaatcttagctacctgggaggccgaggcaggagaatcccttgaacttgggaggtggaggttgcagtgagctgagatcgtgccactgcactcctgcctgggtgacagtgagactctgtcttctaaaaaaaaaaaaaattcccacatattttgtttgtgttttcatggctctgaattttttcagttgcaggcctttatgtcaccatgtcttccaaaaagaatcgagtttgtcagtctttgataatatctttattatgtctttcattaaagcttgtttgcttatgtaaagttcagtaatgttagatatattcacattatttgttggactcccagaatgcatatgttcttggtgcttgatggtttttcatgggcccattagactctcttcattttctttattttatttaattatttattatttattttttgagatggagtctcgctctgtcgcccaggctggagtgcagtggcatgatctcgactcactgcaacctctgcctcctgggttcgggcaattgtcctgcctcagtctccctgagtagctgggactacaggcacgtgccaccacacctggctaatttttgtatttttagtagagacggggtttcaccgtgttggccaggctggtcttaaactcctgacctcaggtgatctgcctaccttcgcattttctttatttttggagacagagtcacactctattgccgaggctggagtgcaggggtgggatctcagctcactgcaacctctgcctcctgttcaagcaattctcatgcctcagcctcagattacaggcatgtgccaccatgcctggctaatttttgtatttttagtagagatggggtttcataatgttggccaggctggtctcgaattcctgctctgaagtgatcttcctgcctggcgttctgaaagtcctgggattacagttgtgagcaatcatgcccggcccacatttctttttaattcttcaaagccaagatgtaaattgccatttctttcatgtaggtttgtacagattcagttggtttctttttgtagaccgtatttccctgtttctttgtatgttttattgtcttcttttgtgacttcagcatttgaaaaaatcagctgcctgcccagatttggtggctgctttgttcagggaggacattccaatcaactaccctagattctggagacttcccatgctttttctctgggcctttgcttgtcatctccctattgaagaggtttgctgctttctactcagaagctcccctattttctgtactattgtggatagactctggtactgcagatatctgtggtactagatcttcaccctcatgtctttctgtgttattgcagacacyggtttacgtcagttatctttttgctcagtggcscctaacctttcatcctgttcctttcagtgctaccacaggaggtcaccactaaggcaattctcagcctagccatggaggcagggacaccttagagagtgcttattagggcaaggtcaaggggagccctggaagcaggaccacgcctgagaccccagaactgtagagtcaccagtatgtgatcccagctcgggaaaccacagcctgtgagaagttccatgtgggtgatcccaacaaaactaatggggcagggatccccaggacactggggacctaactcctactccaggatgtctagaaggtgggacatagagtcaaagaagattattgtcaagccttaagatttaatatgtgtgccctatttgagtttcagacttaacatgggagtggctacctcttctttcctgtttctgcattttggagttgaaatatttagcctgtgtctacgccaccrttggatgttggaagcacttaagtcgtttgatttcacacgttcacagctggagagcagtttgcctcaggatgaaacacatttttgagtctcacccatatctgatttagattatagttagatgcagctgtagactatagacttttgaattggtagtagaaaaagttaagactttggggggccattgggatggaatgcattttrtatgtgaggagtacatgaattttggtggggcaagatggaatgctgtggtctgagtgtttttctctcctccacaattcatttgaaacttaatctccaatgcccaatctccaagtattatgaggtttgggttttagtaggtgattggatcctgaggggtctgcccttatcaatgggatatggtgttctggtcagtgagatatcaaaacgcttatcctacggagttcactgctttttggcccttctgttccttctgccacgtggggacacagcattcctcccctccagaaaatgcaacaagacaccatcttggaagcagggatcatccctcagcagacatcagtccttctggcaccttgatcttggatttcccagcctgcagaattatgagaaatatatttttattgttcataaattacccagtctgtcttatttggttatagcagcacagacagactaggatattctgtaaccataatgtaactgtttgattgttttgattcaactctaattctcagacatctgggttcagatgcttgctctgccattttcaggttgttgacctaggcaagtttgttagcgtgtctgtgacacagtaacatggaacaagtctctctctcataggctatcatgttgttatttgaattagaacatgtaaagcatttggaataatgcccagcacgtggggagtgttccaaaacttcagtcattgctgttgctctggtcatcacagtttttagtttctgacctttaaagccgctgtagacattgtcatctctgaaaacaccactcatatactagctcacctagacacagttgatgtatggagcataatatctaacactttttaagggataaccatgtgtttttcttatttgtgtatttcttgtattgtccacaaaaatagaactatacactgatgtagagaatataatagtctcctattgtattttataacaaactaaaattagggaccaataactttctcacagatgccatatagatatgtcaaaacacacacttcaaagtgatgtgatagttctctcctcattttgtgtaaacaraagagctctcatattgcttctttttgaaatgtgtttttcatttcaggggcatttgacattcaaggatgtagccatagaattctctcaggaggagtggaaatgcctggagcctgtgcagaaagctttgtacaaggatgtgatgttggagaactataggaacctggtcttcctaggtgagtataatttccttctagaagttcagattcgcccttgtgcatttttgtatttyctctgttgtctttcttgggaacccctccgttatttgagactgaagccttattggttcaaaaataaaaagcttcacaatgctgcatctggcctttcactgtcacctttgtatatatattctgctgccttctttstacatcagtggtggttccagagctgaagttcgcagagaactttatggcagagttaaaatatccaattccctgttttctgtccatgtgcttttttgtttgtttaaaacaggttcttgctctgttgcccaggctggagtgcagtggtgtgatcacagctcactgcaatctctgtctcctgggctcaagcaatcctccaccctcagcctcccaagtagctggaattatgcgtgcgtgccaccatgcccgtgtagagacagggttttactatgtcactcaggctgctcttgaactcatgggctcaaggaattctctggtcttggcaccccagagtgctgatattataggcttgagccagtacgcttggcctatccctgaccctgtgatccacccgcctcagcctcccaaagtgctgggattacaggtgtgagccaccacgcccggccaaagcttatattttttaagtccacataatttgttttaagtgaccgctactttaatctggtgcattttcatgtattgtaaatgaactttgtttttatttatttaataatcagttccatatttttgaggatactcagttttctttgttttatgtttctttttgaggtagtgttgtattggggaatgtatatcattttatatattttacaagatttctttctttagtacagatggtatagctcaggagcagtttctctaaaacttacacaaactcaatagtgttgtaataagacagtttcagttatttcttttactcccatttctcctgacttaattcctactattaaatttgttaatgagaccgggcacggtggctcacgcctataatcccagcactttgggaggccgaggcgggtggatcacgaggtcaggagatcgagaccatcctggctaacacggtgaaaacccgtctctactaaaaatacaaaaaattagcagggtgtggcggtgggcgcctgtagtcccagctactcaggaggcagaggcaggagaatggcatgaacccgggaggcggagcttgcagtgagcagagattgcgccactgcactccagcctggtgacagagcgagactccatctcaaaaaaaaaaaaaaaattgttaatggaattgattacagttcttctcattggaaattttttaataccttgaatatatttttttaatatagttactatcttcattgtagaaataccatgaaagagattggtcatactttgtttttgtttgtttgttttgttctgttttttgagacggattttcattcttgttgcccaggctggagaataatggcgcgatctcacctcactgcaacctccgtctcccaggttcaagcgattctcctgcctcagcctcctgagtagctgggattacaggcatgtgccaccacacctggctaattttgtatttttartagagatggggtttctccatattggtcaggctgatcttgaactcccgacctcaggtgatctgccagtctcggcctcccaaagtgctgggattacagacgtgagccactgcgcccggcctggtcatacttgttatatcagacacattgcttttctgtagtaagtttcagtttcctaaatataacttgctggattttctttaaatcacacttttttttttttttggaacaagtgctatattataataattattctcctgtctgctttcaagtccatcatgttatactgaattattattttcaaatcttactttattatacatgtagcccatttcttgcacttcaaggacttctcaactgatgtttataaaacctatatattttttcccgtcatgcytagggaatgaggaataaattttttttwaaaaattatattttatccagaagtgtttttcctaagttttcttctaggatttttgtagcctgaggtcttacatttaagtctatatccatcttgaattaatttttgtatatgatgagagataggggtccagtttcattcttctatatatggctagccagtttttccagcaccctttattgaatagaatgtcttatctcaattgtttttgttgactttgtcaaagatcagttggttgtaggtatgtggctgtrtttctgggtttcctattccattccattggagatctgtggctgtatttctgggttccctattctgttctattggagatcttctattttaacagaagcatttatatctaacagttttctatcttagcactgttttctgtgcatacataagttttggcatgttctattttcattttcctttgttttgagatattttatcatttcccttgagatttccaatttgacatattggctgtttaggaatatgttgtttccacatatttkttgatattctaattttttttctgctgttgatctctagttttattttattatgaagggataagttacactttatgatttcagtctttaaaatgtgttaaacgaggtcaggagtttgagaccagcctggccaacatggcgaaaccgcgtcgctactaaaaatacaaaaattagctgggcgtggtggcgtgcgcctgtagtcccagctactcgggaggctgagtcaggagaatcgcttgaacctgggaggcggaggttgcagtgaaccaagatcaygccactgccttccagcttgggtaacagagcgagactcagcctcaacaaaaaagaagtgttaaaaagttttacttttaaatatttcttttgaagaatgttctgtgtgaagttctgaaaaaattctttcgtgctgtttttgggagatgcgttgtgcatatgtaggttaggtccaatttaacgtatagtttaggttgcctatttacttactttttttctgtctgtcctatttataaaagtggtccgttgaagtcttttattattactgtggaacttttctccctttagttatgtttctcttgcttcatatattaaggatctctaatattaggtgcatatataactataattggtatatcttctagtgaattaaccctttaattattagataatgctcttctttgtctcttgtaccagttttgacataaagtctgttttgactgataccagtttagccacctccgatgtctttctattaccatttataagggatatcttttttcaccctttcaattcagcctgcgtgtgtccttcaaataaaaatgaatcttttgtggatagtatgtagttggagcctgtttttaaaattcattcagccagtctctatcttctgattgtggagtttaagccacttacacttaatgtaattactgatagagaaggactcactcttgctgttttgctgaatgtttcctatatctcttagatttttttgttcttcatatccgttactgcctttgtgtttatttagttgattcttttgtcttgacatacttttatttccattgtgtgtgtcttctatacattctttgtggttaccattgcaattacagaaaacactttagatttataacatcctgttttaaactggtaacagtttgacttcagtcacatagaaaaatgactcctttacaggtctgctcccatgttatgtttttgatatcccagattacttccatatatactgtgtctccatgaacgtgtatttaaaccttgacaacaatttcctgctttcttagttttttcagattaatatttgcccattttgcyagcgtgtcttcttctgcatcccaagtctccttaacattgttgtactatcaataaggttttatgttgtctttttgtgtgtgtacaaaataaattcatccatctcctcttcatggctgttatcaaattttttcttcaggattatattgtaggaacattttttcgcatatctcttgatatgtagggttgttgagcatatgcctggaaatataactcatgggacattcaatttgataaaattcatagcatatattataaagacataagtctgctttcttcccatatcctcacactgcctcctttttaactgttttcccttgtcctgtgcccatagtataattcacgtatttaaatattggccagtataatgctacttctaaattagtttctttttttgtccaaagtcaggattttaactgttcctggtgaaattatatacctacagctctgcaagcacaaaccctgctgccccatgcacattactccttgccctttcctcttgccttttctcttccctggcctttcctaaaatagtactttgttccagacggaatacctggctacttactagcatataagttttacactcccattattgcataactccttcatctcccacactactctcactctgtaagggatgaccgtactcattcacttgatcacttcctttttttcttttttctttttttttttcatatggagtcttgctttgtcgctcaggctggagtgcagtggtgtgatctcggctcactgtaacctccacctcccgggttcaagcaattccctgcctcagcctcccacgtagctgggattacagacacctgcccccacacccagctaatttttgtatttttagtagaggtggggtttcatcatcttggccgggctggtcttgaactcctgaccttgtgatccacctgccttggcctgatcactttctgagaacactgtctaaatcattatgtgcagggaatgatgactcagatactgttattcatggggatggctgaataatgcttttggcaacacagcatggctcttgaagtatttctttatacactcttagtatttggggtgacctgttacctgcagtacctgcttgggcagtttttgaaaaaaacataatgtttgatcctgcaaacgtaggtgcatatcttactttctttgtaaattggatgtagatacatgaatcccgtgggcatactaactgcttgtgtgttaaatagtggtaatttacctcaagactttttaaacaagttagtgctgttagctagtctagaatattgttttttagtaaagactcacagatttctttgttaaataaagcatatcaacattgttttatgtttataatgagatagcatattggctttaccctagtcagcatggctacctatagtagatattgtagattgggtggttgaaacaacagaaattcccttttcacagatctgggtggtgagaagtctaacatgtcagaaccagccattttggttcttggcatggcatgggccctttttccggtttaccatggctttctctttctgtgtcctgacatggcagaggaccgaattgcctcccaaagaccacacctccaaatactatcacattgaggattgggtcctcaacataggaattttggcagacattaagtctttatatcaaagcagccttcatygtatctgtaagttttcattttgtagtttcttycaaacagtgtttgttgtcttttatcttagttcatatgcttttcaagtagaaatctcttgatgatatatattttgtggccagttaactaggtaattagaggcaatgaataggaccaggtgtggtgactcatgcctgtatataatcccggcactttgggaggctgcagcaggcaggttgcttgacctcaggagttcgagatcagcctgagcaacataggaaaactctgtctctaccaaaacwacaaaaaaattaggtgggcgtggtggtgaacatctttggtctcagccatttgagaggctgaggtgggaggatcgcttgagtcttaggagtggaggttgcagtgaggcaagattatgccactttactccagcctaggtgacagagtgagactctgtctcaagaaaaaatgacaatagatagggagttgctctattgattgttacataggtgtaggcatgaaatcatagtcagtatttttccttccccactttttattctgtattatgttgtgtatttacctttctcccatccaagtagtaaccagatctgacactgtttagcttctgagatcagctgtgttccaggtggtatggccatagacatatttatctttcttttatctttaaaagtcagtgatctcaacatattttctagttatcatatgctgtctctagaatatatgttcttgcttattataaagggagatttgtttagaattccatactataaatttgtgtatttgcatatgatgcaaacttgtatatgcaatatacaaatttatagtatggaattctaagtatattgtatattgtattttacttacctgctggttttatcatgggttaatagagtgttttatttattaatttatatgatgattattaattagtttatcttgtgaatatttaccattacactatatcttgctgtrgtttggcatttgtttgtacacagtaaatatgaagtaaatatatataacttttattctcttatgagagagccacattttctgccaatcggttcgtaatttggtgtcattggttgcaaaatacttgttttagtgccaatatatgtttgcacaacataagtcttttggtcataggatgtttgaaactaggctttcctaaacttaatttgaattacatgtagtcaccctttctttactrtagacttctattcattttgtatttctaaaaataaaagatcatggtggagaactctcacacctgtctagtataaagattatgtttagtgtaggtatgtttccaatataaaatrtttgtttatcaatagtagtagtttaaaaaaaaactcatgttcattatattttgcaggtatctctyctaaatgtgtgatcaaggaattaccaccaacagagaacagtartacaggagaaaggttccaaacagtggcactggaaagacatcaaagctatgatattgaaaatttatacttcagggaaatacagaaacatctacatgaccttgaatttcaatggaaagatggtgaaacaaatgataaagaagtgccagtgccccatgaaaacaatcttactggtaaaagagatcaacatagtcaaggggatgtagaaaacaatcatattgaaaaccagcttacatcaaactttgagtcacgtctggctgaactgcagaaagttcaaactgaagggagactttatgaatgtaatgaaacggagaagacaggtaataatggttgtttagtttctccacacattagggaaaaaacgtatgtatgtaatgaatgtggcaaagcctttaaagcgtcttccagccttattaatcatcagaggatacatactacagagaaaccttacaaatgcaatgagtgtggcaaagcctttcatcgggcctcactactaactgtacacaaggtagtccatacaagagggaaatcatatcaatgtgatgtatgtggcaagatcttcagaaaaaattcatattttgtaagacaccaaaggagtcacactggacagaaaccctacatatgtaatgaatgtggcaagtcctttagtaaaagttcccaccttgcagttcatcagagaattcataccggtgaaaaaccttacaaatgtaatctgtgtgggaaatcctttagtcagcgtgtccatcttagacttcatcagacagttcatactggagagagacccttcaaatgtaatgagtgtggcaaaacctttaaacggagctcaaacctcactgtacatcaggtaatccatgcaggaaagaaaccatataaatgtgatgtatgtggcaaggcattcagacatagatcaaatcttgtatgtcaccggagaatccacagtggagagaaacaatacaaatgcaatgaatgtggcaaggtcttcagtaaacgttcaagtcttgcagtgcatcgacgaattcacactgtagagaaaccttgcaaatgcaatgaatgtggcaaggtcttcagtaaacgttcaagtcttgcagtgcatcagagaattcatactggacagaaaacttacaaatgcaataaatgtggcaaggtgtacagtaagcattcacrtcttgcagtgcattggagaattcataccggcgagaaagcttataaatgcaatgaatgtggcaaagttttcagcatacattcacgacttgcagctcatcagagaattcatactggagagaaaccttacaaatgcaatgaatgtggcaaggtcttcagtcaacattcacgtcttgcagtgcatcggagaattcatactggagagaaaccttacaaatgcaaagaatgtggcaaggtcttcagtgaccgttcagcttttgcaaggcatcggagaattcatactggagagaagccttacaaatgcaaagaatgtggcaaggtcttcagtcaatgttcacgtcttacagtgcatckgagaattcatagtggagagaaaccttacaaatgcaatgaatgyggcaaggtctacagtcagtattcacatcttgtagggcatcgaagagttcatactggagagaaaccatacaaatgtcatgaatgtggcaaagcctttaatcagggctccacactcaatagacatcagagaattcataccggagagaaaccttacaaatgcaatcartgtgggaattcctttagtcagcgtgtccatcttaracttcatcagactgttcatactggagacagaccttacaaatgtaatgagtgtggcaaaacctttaaacggagctcaaacctcactgcacatcagataattcatgcaggaaagaaaccatataaatgtgatgaatgtggcaaggtattcaggcatagttcacatcttgtaagtcaccagagaatccacactggagagaaaagatacaaatgtattgaatgtggcaaagcctttgggcggttgttttccctcagcaaacaccaaagaattcattctggcaaaaaaccttataaatgtaatgagtgtgggaaatcttttatttgtcgctcaggcctcactaaacatcgaataagacatactggagagagccttacaactaaactcaatgtgacaaggccttagacgttgtcctagtttctggaatcaccgaataattcctacttactgatataccttgtatatttaccccttctcttgaaatccctgtggaattgtaatctccagtattggaggtggggcccattgggaggtgattgaatcatggaagtggatttctcaaactgagaaagatgtagcgtcatccccttggtgctgtcctggcaatagtgacttctcttgaggtctggctgtttagaagtgcatagcacttccctgtcgcttgccctcattctcaccatgtgaaataccgacacccgctttgccttccaccatgattttaaccttcctgaggcttccctagagggtgatcagatgccagcaccatgttttcatttaagccttcagaaatatgagccaattaaactcttttctttatacattagccagcctcaggtttttttttgtagcaatgcagttatgacctaatacatttacacatgcagtaaatatacctaagttttaagctagtattcactactcactaggtgtaagaatttgtatatatattccaggatgtatacatcctggagaaaaatcacagaagtgtaatacgtgtggcaagaattctactcaaaagccagaacttgtaaatctaggtaattaaaagggcatagatgtatgaaatgaaatgagggtggcaaaacctttactagagttcaatcactrcttgtcataagagagtttatactgaaaggaaatcatataaatgtatgtgtcagaggctttccccaggcattggaactcactaggcatcagaatatacatctttgagaggaaccacagaaatgtaatgtgcatgctaaggtttttacccgaacatcaaaatggaaagagtattcatactagagacaaccttccaaataaatggttttaaaaaatgaaatgttcaaagacctggaatcaacccaaatgcttatcagtgatagactgaataaagaaaatgtggtacatatacaccatgggatactatgcagccatagaaaggaatgagatcatgtccattgcagcgatgtggatggagctggaagccattatcctcaggaaactaacacaggaacagaaaatcaaacagcacatgttctcacttaaaagtggaagctgaacaatgagaacacatatacccagggaggggagcaacacacactggggcctgctgatgggggtgggaagggcagggaagtggagcatcaggacaaatagctaatgcatttttgccttaataccaggtgatgggttggtagatgcagcaaaccaccatggcacacattttcctatgtaacaaatttgcaaattgtgcacatgtacccagaacttaaagtgagacaaaaccaatgtccacgcctttgcagtttgattgaacgtataaaggagaaaaatcctgtaagtatgctgaacatgaaaggacctggaagcagtagtgtgtcttcagcctttaccaaattatccctacttgagagaaaacttggaaatgtaatcaatgtggcacaaatttcaaccagttttttaaacagactacacatctttgaaatcatactagggataaccaaatctgcttctccaagattggcctggaatattattacagaataactaccagacaacatttgttaaaactcaggacagtatgtattttaaaggagcaagtgcatgtgtgaaaatggctcattcagtttataaaatattacattaaatttgaggtttctgttttttttmttttgtgacagtcttgctctgttccccatgctgtagtgcagtggcaccagttcacctcactgtaacttccacatcctggtttcaagcaatttgtgcctcagcctcccaagtagctgggattacagtcatgccaccatgtccagataatttttatatttttttgtagagatggtgttttaccatgtttgccaggctgatctcaagctcctggcctcaagtgatttgccaccttggcctcacacgttgctgagattacagrcatgagccaccacacctggccaatggggcgtttcttaaaatagctactagactatgacgtttatcctaaggtttgaagtctatcatcttccttacatatccttcattgtggtatctgggaatgaatcaacaagatgagagagcctccttcattcagtgtggctccttcatttccatgcttcctgaagattaaggtcactgaattttaaaattcaatattctgtgagttacacaccatggagtaactgggagaataatgtaagtttatgatgtaagttgtgcttgtgttccaggtgtccatgaacacgtagagtgccactttgggttgtagaaaataattgcacaaccaactgactgaaataccagtgaggacattgatggaatattaagggtattcatgagaggcaagtgataggttactagggatggattgtgtgggagaaataatgcagaggaaatgatgatcatctccattgaatgacagctgttatatagcaaagataaatgtaaaattagtcttattcttggaagtggaagacagcagttatcagagaggagaatttaatcaaaagaatcagaatagcatggtcacaggccagattcacattgaagyatttactctatattttactgctgttacattcaaaatgtatcagaagtctcatggttcaattaataaaatgttattcgttttcrtawctcagtgacgttcctttcaccaacacagatttatcccaccttagtaaagaacttctaacagacactgcattacactctgctggttaaaataatgtgcgacaattgttttctatggcgaaatcaaacaacatagatttttgcccataccatagtccccctttaacccacaagatgccttccaagtgtcctctagtggatacctgaaagtggatagtacccaaccataaatatatagtttcagtcaagttttgaggtgtgacagcaaagctagtactgattatttttattcacacttgtacagaagatttatgataaatcttagcatcttcatctgtatttttttcttattaaatcaataacctttcactttttaacttaaaggaggcgctttacagctttcttgctttctcttttttttttttttttttttttttttttgttagggggttttgctatgtcacccaggctgagtgcagtggttattcacaggtaagatcttagcacactgcagcgtcaaaaagtggtcctcccacctcagcctccagactacctgagactacaggtacatgctattgtgtctagcttacagcttctctgagatatccaagttgcaagcctcactacttttgtgctttggggccataattaagtaaaataggagatacttgaacacaaacacgatgatactctaacaacgctaactgagatgactactaagtgactgagagaggggtaggttattctgtgtggctacaccgtataaagggatgatttatgtcctgggtggaacaatgtgaaatttcatcacattagtgagaacagtgtacagtttaaaatttccgagttatttattttgggaatattccatttaatgtttttgggccacagttgccactggtaattgaaatcatggaaagcaaaacagcagctaatgtgggatgactgtaccaatgtcttggggggagggagccagctgattgtgagatgtaagtttgtgattctgagatagcagctttgcaaaaaactgcaatttgtcaattcaccaatattgataatgtgcaagcttggtgagctgagaatattcctgaaaacctttgttcccactgcgaattcctggggacagttatgagttcctaatgacgtcaccacaaagacattttggagtgtttggtaaaggctgtttcttttcagtgattgctggaagcagatgggatcaaataaaaatagaacattgtgggctcccaaggctgaggtggagctggaggatgccggccagactgcggagcagcagtcttccttgtgcacatgcctgaagtccgcgtgggtgtttgaggaagtggggatacagcatttaatgaaaaatttatgcttaagaagtagaaaatggcagtcttcctagataattttcaatggccagaatgtgaatgtattgacgagtgagagaagaaatgttgtggcgtctgttgtgacaggtatattgttttttacaggctggtggataatgacgcagcagtggtgtattgtaggccagaacagttgaaccatgcctttcacacatgtggtgtatttcccacattggctttcttcatgataaatgctgtatccaatgctcaggtgagaggtgatagctatgaaagtggctgtttaggaagaacaggtccttgagtttggcttttcgttggtttcatgttgatgtttggggtacttattgcttccatgtggattctttttggtgcatatgttacccaaccactctgatctacaaatttggaagaactgaagagctgtggacctgagatcactccttaaatcacattttctttgtgttatattctgtttgtagataagtttttatcttagtacacgttgccaaatggagtagcttgtacatgaaatgttttctttacatttttatgttgtgttattttgtcttttttgttgttgttgttgctgttgtttttgagacagagttttgttcttgttgcccagactggagtgcaatggcgcgatctcggctcaccacaacctctgcctcctgggttcaagcgattcttctgcctcagcctcccaagtggctgggattacaggcatgcaccaccacacccagctaattttgtatttttagtagagatggggtttctccctgttggtcaggctggtctcaaactcccaacctcagatgatctgctcgcctcgacctcccaaagtgctgggattacaggcatgagctaccacaccctgcctatgttgtgtgtttttaaagttttatgaaatttctgttcttcatttttcattgcatagactgttaatatgtatatagtacaagactatatggcttggataatgagtatcttttattcctgagatttagaacttgatctgttccctaagccagggttatatcatcatgtcattttagaagtaaccactctctctctggccgggtgcagtggctcacgcctgtaatcccagcactttgggaggccgaggtaggtggatcacctgaggtcaagtttgagaccagcctgaccaatatggtgagaccacatctttactaaaaatacaaaaattagccgggcatggtgtcaggtgcctgtaatcccagctacttgggaggctgaggcaggagaatcatttgaacgctgtgggtggaggttgtagtgagccgatattgcgccactgcactctaacctgggagacagagtgaaattccatcaccgcccccctaaaaaaagtaaccactctctctcagtatctctaatttctgaagatgtgcaaaaaatataattttatatagctggaatgagcactgagccataaaaggtatttcagcaagttgtaatttattttggcctaaaaatgaggtttttttgtaaaggaaaaatgtttgttcttatgtattgaagaagtgtacgtttatataatgattttttaaatgcccaaaggactagtttgaaaacctcttccaagaattcctctaatatgaccttatatgaaaagggataatacatgatcaaataaactcagttttttttatggttactgtaaaaagactgtgtaaggcagcttagcaccaggcttctcataaaagcagcttaaattatccactggggttatcttttgacaacctgctattatctggtgttacacaattcaatagcaagcaagtttcagacaactgcagttcaaaagcatgaaccatataacaaaaagtggaataattaaagataaggcacttcttcccaaagggaattatcacctagtgaaaaattacgcatttcatctactcagttactgactgcaagcaagtctctctgctctagctctcaagctttgggtgaatgtccctgcgaaatgtatcttcaagttgaaagttcacactccagtcaaaaactccttttactgagtttgcagtactgtatttgcatgtgtgtatttctctggacctttattgctacttttgctttcctttgttacacagactttgtgttgcactttcttctccagaggggtgatatagagccctggttatatgaataataccagtgatagtgtccacagctcaaatgcaagcccatttgtcatcactcctttcatctctctgagaggatttattgtgtgcagagtatgaagcagttgtggagctctgtgcctttgtcaagataccatcttgtttgatgacttctttctttgttgtttttccttgaaaatgtcagtaagctctgttatgcttctagcaaattgtgagactgtttgtttccaccctcataacctgttgcaataaatattatttctcacayattttaatattattaartttgttggagaaaacaaaccataaaaattcatttgctgttcagttttcaattacaataaagaaatagaacattgttaatttctgagacttgatggacagtaatatggaaaatcttttcgtttgcctatttgtgcatctgcatcggtgaaatttctcatatttttaacctattttctaattcaattttttttctatgatatactttactttgtagagcaatttttggttcccagcaaaattcagtggaaggtacagagatttctcatatagctccttcccccacatatgcatagccttccccattgtcaacatcctccaccaaagtggtagattatcatccaacatccctagtttatagttggctcacacttgtacattgtgtgggtttggacaactgtaaaatggcacatattcacatattatggtaacatacagagtactttgactaccctaataatcctctttgctcagtctaaatttgtgtatttctttcacttctgtcacttattgcttcacgttttgcagctgttttttagtgcatacacactgatggttctgaaatcatctttgtaagttgacatttttatcatgtaatctccctgtttttccctgttatttttattttctctgaagattacttcttttgttccagtcaattttgcaagtttatttgccaaagttaaggatgcttgcctgtgacacagcctcaagaggtcctggccacatatacccaaggtggttggggcgcagcttggttttatacacttttaggagatatcagttaatgtgtaagatgcacattggtttggtttggaaaggcagggtaagtccaagcagggagggtgcttccaggtcatcgggtagataaaagacaaaggttgcattcttttgggtttctggtaagcattttcaaaggaagcaatcacacacatttatctcagtgagcagagggatgatttgaatagaatgggaagcatgtttgccctaagcagttcccagcttgacttttccctttggcttagtgagtgttgggtgccaagatttattttcctttcacatttccccttttctcctttaaaaatctttgggagaggctgggtgcggtggctcacgcctgtaatctcagcattttgggaggccaaggcgggcggatcacgaggtcaagagatggagaccatcctggccaacgtggtgaaaccccatctctactaaaaatacaaaaattagccaggcgtagtggcacatgcctgtagtcccagctactcaggaggctgaggcaggagaatcacttgaacctgcaaggcagaggttgcagtgagcccagattacgttactgcactccagcctggggacagaacgagactccgtctcaaaaaaaaaaaaatcaggtttcatctgatccttcatggctaggacagtttattttcaggtgggcaagtcccatgttatttggaaagctcatttttagcagtttgtaaagtgtcgtgtcctatgaagagaaaatagcaggaggaaggaagaaaaacaaagaataatcctggaaaatagatacaggccatattactctgaagtccatacatcagtagataggtatgaaagtggcttatgtatgtgaataggttgctgttattttcttctgaagtttaagttgtctagcttcagttatcagggcttcaagaaaatacagtttagttttcagtgatttcaaattagaaaatatgggggaaaaaagaaaagaaagaagaaaaaattgaaaacattatttcagagacatgtagctggaaaaaattagaattcagtccaaactgtggaaaatcataaaaattgaaaaacgtaagctgggcgccatggctcacgcctgtaatcccagcactttgggaggctgaggcaggcagatcacgaggtcaagagatcaagaccatcctggccaacatggtgaaaccccgtctctactaaaaatacaaaaattagctgggtgtgttggcacatgcctgtagtcccagctactcaggaggctgaggcaggagaatcgcttgacctcgggaggcagaggttgcagtgagccaagatcgtgccactgcattccagcctggcaacagagtgagactccatctcaaaaaaaaaaaaaaaaaaaaaaaagaatactcagaaatagtttccaaattctggagaaagcaggtagagagaaacaaatatgttccaaattttcttcacagcagtatactttcctcaattgttaaatgctgtcggctgggcacggtggctcatgcctataatcccagcactttgggaggcaaggtgggcggatcaccttaggtcaggagttcgagatcagcctggccaacatggtgaaaccccgtctctacaaaaattacctgggcatgatggtgggtgcctgtaatcccagctacttgggaggctgaggcaggagaatcgcttgaacctgggaggctgggaggcaggggctgcagtgaacccagatcatgccattgcactccagcctgggcaactgtctcaaaaaaaaaaaaaattgctgtcaatagctcaaaagaaaagtttccttgactctgcaaaacaaaacaaaggatcaaaagaaaaaatcagaaagattactttagactcctattagttcagtccatgcagttaatgtgtgttgtgtttgatattcatgaacattttagttatccatgaaagttttgaaagttctttcctctattcctctattctaatgtcacattttccaaagttatcagaaacttgcattccagagcacctatcaaattcctgtagctgattataaaccaacttttgaagaggatccaaacaagacaacaattgcctgtggcaacaaaatgtctcaggacagctgttattaaaaccacaattgactataatggaaattttggttacttctgtgacataccaccattttacataatagtcaataataataataattattattattttttgagacagagttttgctcttgttgcccaggctggagtgcagtggcacaatctgggctcaccacaacctctcctctggggttcaagcgattctcctgcctcagccttctgagtagctgggactacaggcatgcgccactacacccgactaattttgtatttttagtagagatggggtttctccatgttggtcaggctggtcttgaactcctgacctcaggtgatccgcctgccttggcctcccaaagttttgggattataggtttgagccaccatgcccagccaacaattataattattaataacatgtggctgggcacagtcactcacatctgtaattgcagcactttgtgaggctgaggtgggttgaggtcaggagttcaagaccagcctgaccaacatggtgaaaccgcatctctactaaaaatacaaacattaaccaggtgtgatggtgcacacctatagtctcaggtacttgcgaggctaatgcaggggaattgcttgaacccaggatgcagaggttgcagtgagccaagatggtgccwctgcactccagcctgggtgacagagtgagattccatctcaaaaaataaaataataacatatagtaagtcatatcagaattataagagttttccataattttggaatacatgccaatttcatatttatacaagtacagcccacagaaagccaaacaccattttgtatttgacaatgcttcctgtatgatttttataccaaataagccaaatatgtctcttctggatttcaggggattaacaaaagtttaatgacgacgcaagttaaaatgtgactttggaaagcttgtcaaatataaaaagtttaaaacacttgatatcataaaataggatcacaggccattataaaataagtgattcatttaaccaaagtggtatcgcaaagatttcaaaaaaaggtggcaacctttattttttgagagaaaagacttaatttcccaaacaatattccctagtaaaaatggcacaaggccaattaaattggtttttcaatattttataaacaaactataaaattttaatcatcttgcctgtaagtataatttccatgagcctttttatacactatataatctttattaaatagtgggctaggctgggcacggtggctcatgcctgtaatcccagcactttgggatgccgaggtgggtgaatcacctgaggtcaggagtttgagaccagcctaaccaacgtggtaaatccccatctctgctaaaaatacaaaattagctgggcatcatggcacatgtctgttaccccagctacttgggaggctgaggcaggagaatcacttgaacccatgaggtggaggttgcagtgagcccagatcgcactattgcactccagcctcggcaacagagtgagactccatctccagaataaaaaaaaggtgggctaatgctccaagacaaccttgttaatctgacgcaggggctcatatgctggtcttgcaacaatttgcctttgaaattgatagttaatttctagagaaaccaaacttatttcagctctaaaaattgaccctgacaatctcacatgtccacttctttcagtataaccactggtacttgaggagttgaatagttttaatttcttgccctgtgtttcacaaacacagtttattttgattaggaacttctactgggtmtgaagatgaggcttgaactgctgtcagtgtttaagatttagcaagacttggtgtcctttttagacccaggagtcaaagccctttaactgaatggaacagggacctaaaagcatatacggaaagttatatggacataataaacttaatttaaaaaaatttaatttaaatttccttgtaaccaaaccaaacttagtaatactgacacaggaattactttgataaagtgtgagatctgtttagtaggccagttttccaaaggcaaaagaaaagcccttctacagtgtgactgctgttccctatgggagatattatgtttggaaagaaacatttcctttagacctcaaaaataaaacattttatagtgtcaggccacaacagttagaacccaaagaaaaaaaggctacaggagctgaaaattaggtgaaaaagttatgatttcaggccttttaagaggggagagaaagctgaaaacagtgagattccataaaacttgaactttacattgaataaattatgtttcataatttatttaaagcaccgcttaacaaaattttgtagtttgaaccaattctttagtgtataagtggtgttttttaaaatcaaaacccaatctctagaaagaccattataatttccctttaattatagtgaatttgatcacataaaactttttttcatcaatcttattatgacttacacagaccattcatgacatgtgtgggatttcttgtttttcctgaacattcatctttcttatacaatcagtcattttattccaggacaaaatttctgatacaagattctttctcatatagaattatttttctttaagctttcctaccaaaaatatttatttatttatttttgagacagagtctctctctgtggctcaggctggagtgcaatagctgaatcttagctcactgcaacctccatctcctgggctcaagtgattctcctgcctcagccttcagagtagctgggattacagatgcacactgtcatgcctggctaatttctgtatttttagtcgtgttgtattttgagacttctaccagtccatagtattttctaaaaacaaaactaaatatagatttataataatcctttggatggtaaatttttgtgggaatgaagtagctgggtactctggaggctgaggcaggaggatcacttgaatctgggaggtgaaggttgcagtgagccgagatagtgccactgcactccagcctgggcaacagagcctgtcttaaaaataaataaataaataaataaataaataaataaataaataaataaatagaagtagctggagaaaggtgcttactgcacaaggaaggcatactttctgatactgtattagggatgtcatcaggtgaagtcaagaacaacaaatcacaatggactggaaacattctcaggagaactgtagccatgaaaaggactgttgttcattcttgaccttgtggaatcagtccctgactcatcttctcagcaacattgcacatttgctgtgaaacagaaactacggggtaccttctttattttccttttctggatgggagggtttattcaggtttcatttttctgttccacaatgaagtgttgtgagtgaggagaactctactgggctctcaatgaaaagaagtctcatgagactgtcatgmgatccttgcttgtgacttgaagttacattttggcttattcttttatattttttagaagtgggggtgaatatttggtgtgagcaaaagaggaacagattatttctgctggaagctgcactgtcacatgttataatattttgagacaggatcttgctttgtcacccaggttggagtgcagtggcacagtctcagcacactgcaacctccacctcctgggctcaggtaattctcctacctcagcttcccaagtagctgggactacaggtgcatgccaccaaatccagctaatttttgtatttttttgtagagatggggtttcaccatgttgatcaggctggtctcgaaatcctgacttcaagtgatccatccaccttggcctcgcaaagtgttgggattacaggtatgagccaccrcaccctgccaaattagtatgttgggtttttaaaaatccaactgatacagctgtacattagcaacagagctcttgcttttacattatacaattttagttcattatcttgtatcattccagttctttcactgaacttaaaatgtaagggaccctccatatattgatagaatacatcctttacatctgtcaggtctccgcatatttttttgccatacaaatctgaaaataccaccttgatttactaatcctataagtttttcactgaagtacaaggaaagaaatgtaaatctttaaattggattaaatcgtttctaggaaattgtataatgattttaaaaattatttttaaaattacattttggccaggcacagtggttcacgcctgcaatgccagcactttagaatgtgggggtggggagatcgcttgaacctaggagttttagactagtttgggcaacatggtgaaaccccatctctactaaaaatacaaaaactgaggttggggtattgcctgagcctggggaggtggaggctgctgtggggtgtgattacatcgctgcactgcagcctgggcaacagagtgagacctcatctcaaaaaaaaaaagaaaaaagttttgctacagctgtgaaatcattagcctttgaaaaataattcttctattaaataatttaatatttattgtctgttagatattaattttatagtacaggtgtaaaaatataggtaatttgtctaaacagtatttcagaaacacttccaacaattatattgtgtgaagggttctatgtatgcatgaagaaaggacatgtataaagtttttagcatggggaaaattgagtttttatcaacttaaacgtcaggagtttcaaaagtaaacattcagtgttgaaataaaaactgtctgaatctatctatctaatatatatgttttttttttttttttttttttgagagagagtggttgtgttgcccaagcaatagtgcagtggtgtgatctcaggtcactgcaacctccacctcccaggcttgagcaatcttcccacctcagcctcccgagtagcagagactacaggtgcatgccaccacccttggctaatttttttttttttttgtagagatggggttttgccatgttgcccaggcttgtctcaaactcctgggttcaagcaattttcacacctcagcctcccaaagtgctgggattacaggtgtgagccagtgcaccctgccttattcctttactttcttaaaaaacttgctgtcactttactctctggactcccccctaattctttcttgcacaagatccaagaaccccttcttctgggtttaactgcctaataggttctctttttctgctgcctagacagagccaattcctcaagacagggaaattgtaatagagaaagagtttaattcatgtggagctggctgtacaggagactgaagttttattattactcaaatgagtctccctgaaatcttggggatcagggtttttaaggataatttgatgggtaggggccagtgagtccagagtgatgactggttgttcagagatgaaatcagagagttgacactgtccttttgcactgagtcagttcctgggtggtgtcacaagaccagatgagtcagtttattgatctgggtgtcaggtgatccatcaagtgcagggactgcaaartttctcaaacactgatcttaggttttaaaatactgatgttattcccaggaacaatttgggaaaggtgacaatcttgtagcctctagctgcatgactcctaaactatagtttctaatcttgtgactaacttgttaatcctataaaggcagtctagtcccaagcagaaagggcatttgttttgggaaagggctattaatgcccttattttaaaagataaactaagttcctcccaaagctagtttggcctacacccaggagtggacaaaggcagcttggaggttaaaagcaagatggagttggttaggtcggatccctttcactgtaataattctcagttataatttgcaatggcggtttcaggatctggatcaggacccctttctggcaacacgaggatggttatgaatgcatccagacatccaaaaagccacctctgagagctagagatttccctttcctataggttcttcgtcccttgtatgtcaacccaaggattcactggggatctagaactgcgcaggccagtctaggaagagagagacaggaaagagaagaagaggaggtgaattagttttgaagaaaagaaagaaggtcccgtgctacctctttttttctgacaaacttttcatactgggaaatagaatcctggtttatttgtagtaaaactaggagtccagggattttataggagggtgagaaaaatgcacttttatggtatagtctgtggagacctaattagagaaaaggagtcagcctggcaggaccaggggaaagcaaagagataaagcaaataagctataaatctgcctttctaggccaggtgcggtggctcacgcctgtaatcctagcactctgggatgccaaggcggtcaaattgcctgagctcaggagctccagaccaccctgggcaacatggtgaaaccctgtctctacgaaaatacaaaaaaaagaaaaaaattagttgggcgtggtcgtgggtgcttgtagtccctgctactctggagcctgaggctcgagaattgcttgaacccaggaggcgaaggttgcagtgagctgagatcatgccactgcaytccagcctgggtgacagagggagactctgcctcaaaaaaacaaaacaaaacaaaattttaaaaaactgcctttcttcatggtccaggacatataaacaaaatacaggaagcagataagctgtaggtctgtttttctttctggcttaggccatatagcccttctgcgcagataacatacatagctcataaactttctgcttcartttttcatcaaacacctaacagaagaaggcaagttagctccctgcttccttggcgttatctttcatttatgtatttgtttatttattgagacaagagtctcactctgacttccaggctggagtgcagtggtgtgatcttggctcactgcaacctctgcctcccaggctcaagcaaatctcccacctcagcctcctcagtagctgggagtacaggtgtgggtcaccattgccaggtaatttttgtatttttagtagaaacagggtctcaccatgttgcccaggctgggctggaactgcccacctcggcctcctaaaatgtggagattacaggggcaagccagtttgcccagctgaatctcctcttcttataaagaaatcagccagattggatcagaacccactttaacaagcttatttttacttgatcactcctgtagatgccatatatycaaatacagttatattctgaggtactgggtattaggacttcaagatagggttttttttgtgtgtggaaatttttctgctcataacacactgtgttctggactcctaaactttatgtccttcttacatgcaagatcccttcactcccatcagaacaaaaatcttttatttatttatttgagatggggtctctctctgtcacccaggctggagtgcagtggcgtaatcatgacttgtcacagtctcgacctcctgggctcaagtgatcctcctgcctcagcctcccaatagctgggaccacacatgcaggccaccatgcctggctaatttaattttttgtagagatggggtctgactatgttgcccaggctggtctcaaatccttggccttaagtgatcctgccacttcagccgcccaagtagctgggactacaggagtgtgccactaagcatggctaatttttatatcttctgtagagacggggttcttgctatgtgcccaggctggtcttgaactcctgagctcaagtaatctgccagactcggcctcctgaattgttggggttacaggcctaagctaccttgcctggcccatctgaaaagtcttaatccatttcagtatcaactctaaggcccaaatatcacctaaatattatctgaatcacatatgggtgagacacaaggtgtggttcatcctgaggcaaagtttctgcccagctgtgaatctgtgaagccagagaagttatctgcttccaaaatacaatggtgggacaggcataggaaacaccctcagccctggaaaccacccttctactttgttaytctgaatttgatgtttgtacttagcacgtgtaagtaagtgcatgaagtatgtttctttgtgtgtgttgggaacgggtgctcagtgtcgcaaaaatcaacactgagacaaaggatctctcagcaaggctagtttactttctgcagaaagggtgctgctcactagcagtcttgccacgagagtacacawgaacaaaagagaagggtcatttataacctgacgcatctggccrggcgcggtggctcatgcctgtaatcccagcactttgggaggccgaggtgggcggatcacgaggtcaggagatcgagaccatcctggctaacgcagtgaaaccccgtctctactaaaaatacaaaaaattagctgggcgcagtggcaggtgcctctagtcccagctactcgggaggctgaggcaggagaatggcgtgaacccaggaggcagagcttgcagtgagccgagatagcgccactgcactccggcctgggcgaaagaacgagactccgtctcaaaaaaaataataataataataacctgaygcgtccaccctactgctgtgtctggtttccattggctggaatcggacccaattctgtgcttgacctgattggctagcaccttagaacttcccaaaagaggcaaaggcagaggagaacaaaggaagagaggaagtaacttgtggaaggctgagagaggcaaaaacacttccaaataaggaagaggaataggctgtgacctaatgcttgcttggaacaattcaggcatgccagggcaaatatctaggctaaaatgtgggagctaagaacacagagtatattgatttatctattatggctagcagatatttaagaatattagcacaggtctttgagtamattttgcttctaagagaggttactatctattctcaattagactgggaggaaagtccctttgaagaggaacctctacttatttcattttctacactgtgtctagcacatttcgcttggcataatgtcttctgggttcctggatccagtcactgctccacatccaatccccaccgagatcccagttccctgactactgagtagcttcagcttttctggtaagactggatggagtccaccaggctcggaaaaatcggttttgacttaaatcagttcaacttgttaagaataaatcatcttagtttccagtataagtggaccacaactttaagattcaaccttaaattctgaaacattaatttaaaatgggcaaggagcaacgctgcttcacaggacaagaaatagtcacaaatactcccaaayctggaaaacaaaatcctgctgggtgagaggcggagtggagaacaggccccgcctcggccccgcccacccctggaggccccgcttcrtcccagttttcggtccagccaagccccacctagtcacgccccctaccgccctgggcctcccaccaccctttcgggccactcccaagtcaggccagtctttccgcccagccctttcctagtcgcgccccgcctaggccccgcccccaggccgcccagtttttctttccgcgcccagtttcctgcacacccggaagcagatcgcgctggggaaaggccacgtcgctatgagtgtgtttcagtctacctggattaaacgtttgcttctcttcgtctaccttgattaaacgtgcacttcgcagtcctcggttctccatacccgtgacctggggatcgctacggaccttaaaatacccgcaacagccccttcgtcccaagtaagtaggagaattgcttccctttcggtttaaaatctctctgaggccgttccttgctctctgcctttcttccttaggaccatgtagacaaccccattcaggtagtgttcccgcttaaaaccctctgcttgggccccgcgccaagtcgagtcctcattcgggatgtggactagcgcccttcgcgatccccgagctcctccgtcgtctgcccctggaggggagcgcccactgtccggctcctgaaggagccgcttctcctcccacgtcctgggattctgcagaccctccctgtcgtgagacatcgttctccgcgccacctcgtgtcgtcctcacgccgggtccttccgctccccaggcttccccttcacagccactgcttttcttgactccccgttgggacaggttacctgagtctgtcttgtgacacccagtgttcttccttcccaaattttactccactggaaaatgtgctcttccgggaggtgggcatcctattcctcccctttcctcccgaatgtgtgggtgagagggatcaggagaggaaaagacggggaacgacggagcaaaaggaaaaactgaggagaaaagaatgagggagacccataaatacacggcaaaatggatgatactttagggacttgcaaagagagcaagagtgaaagagaacggatggaaaaagtagcagggggagaaaagcacacagagaaatttagaaaaaaaggggaccttcagagagatgaagggcagcaaaatagagtggggcggcaaaggaggaggcactgcagacagacagacagtggggagaaggtgaaagagttggagccgcggctgacagagctacgtggtgctgggactgaaagagagggagagagggcagtgggtgacaagcagagtagagggagaaccacagcagggagtaagcctaggaaattgggggtgctagagagtgggaacaaaggagatgtaacagggaagagggaatttaacaaggagagcagagagggagcttagatgggggaaaagaggcagaaatacgtggagattggggacaatcggaaagattggggagaaagagctacgagaggtgaagtaagttgcagagcattgggcagaacagacataaaagagggaataaagaaaggggtgcaaaacagaaaaggagaaaaaaaagacgctcagaatgagagagggaaacacatagccgtgaagaaagcgggagaggaccccatccagatgcgtgacagttgattggatatggatggtggttgtaatatattgatttgtggctttatactctgatttgaaatatgtttaagttgtactcatgaggatgaaaatcaccaaagttttttctataagccttgtgcattttgtatgtatttgtatcaaaagatatttggaattcctatttagccagagggcagtgacttgatccagttatttgtggtaactctcttcttcccartgatggagtagagcataaaggaggggagaaatggggcaagaaatgactgactgtcactacaagatatgtctttggtgttttttttggctttgttctgttttkttttggggggggacatggtctctctctgccgcctaggctggagagcagtggcatgatctcggctcactgcagcttctacttcctggcctcaagcagtctttccacctcagcctctcaacgcactggaattacagatgtgagccaccacactaggcctacaaggtatgtcttcgcagaagcattgaaagtcttgtttttttgtaatgaatttacttttttctttgtagttgctttacagttaattaattgttattttggaagcttgagatacattttattcaattgcttctttcctatagttgctaactccagaaataagatttggtggcatccaataatcagctgatctcattcatttctgaatattaagtgccatcattttttgaacttttaccccataatttattagatttttcaaaaactttccaaactgttaaagtgtccaatatagtatagtcaccatggtgtacattagcttcctcagaacttcttcattttataacagaaaatttgtaccctttaaccaacattttccattttcaccccccagcagcctgtggcaacaactgttctaccctgttactatcaattggacttttttagattccacttgtgaggtcatacagtaattgtcttttagtgtctgtcttatttcacctagcataatgtcttccaggttcatccatgttgttgcaaatagcaggattttcttctttttagggttggataatattccattatatatatgtacacatgaacactctgtatatgtctatatacacacatatttattcatggatgggcacttgggttgtttccatatcttggctgttatgaataatactgtagtgatcatgggggacagatattttgtaaggttttctttttttttgagacagagcctcaccctgttgtccaggctggagtgcaatggtgcaatctcagctcactacaacctccacttcctaggttcaaatgattctcctgcctcagcctcccgagtagctgatattacaggcacccgccaccacgcccagctttttgtgtttttagtagagacagggtttcaccatgttggccaggctggtctcgaactcctgacctcgtgatctgcccgccttggcctcccaaagtgttaggattacaggcgtgagccgccacacccagccatttttttgtttttgtctgtgttttttcagcagatacatggtctctgctatgttgtccagcatgatctctaactactggtgtcaagtgatcttgtcgcctcagcttctcagagtgctgggattacagccatgaactgctatgcctggcctagatgtctcttmaagatactggtttcatttatttcctttggatatatacccagaaatgggattgctggattgcattgttgttctatttttaatattttgaagaatgtccatagtgtttttcataatggctgtactgatgtacactcccagcaacagtgtacaagggctcatttttctccatatcatgctaacacctgttatctcttgcctatttaaaatagccttcgtaagaggtatgaggtgatagcttatggtggttttgattagcattcctctgatgattagtgatcttgagcatcttattatayacctgttggtcatttgtatgtcttatttggaaaatgttcaggtcctttgcccatttttattgagattatttggggtattttgctgtagaattgtaggagtttttatatattttggatattaaccacttattaaatatatggtttgcagatacatacttccatcttacaaattgctttttcatttagttcattgtttcctttggtgtgcaggagctttgcccctcccccaccccacccccaaaatggagtctcactctgttgcccaggctagagtgtggtggctcaatctcagttcactgcaatgtgtgccttccgagttcaaatgattctcctgcctcagcccccgtagtagctggtattacaggttgcaccaccactcccagctaattttttagtagagacagggtctcaccatgttggccaggctggtctcgaactcctgacctcaagtgctctgcctgtcttggcgtcccaaagtgctgggattacaggcatgagccactgcgcctggccaaactttttagttggacatagtcccactttttagtttgatgtagtcccaccatttgttgcctgggcttttggtgtcatatccaaaaaaatcattgccaagatcaatgtcaaggagctttttttctattttctggggttttacggttttagatcatatatttaaatctttaatctattttgagtttatctttgcatatagtgtgagataagggtccagtttcatattcttttgaatgtgaatatacagttttcccgacaggatttattgatgagactgtcctttcctcattgtatattcttggtgcccttgtcaaaggctagttgtatatgtgcatgtttatttctgggctctcttgtgtttgattgttctctgtgtgtttttatgccagtattatactgttaggattgctgtacctttataatatagtttgaaatcagaaagtatgatgcctctagcatgttctttttcaacactgctttggctctttggagttttttgtggttgtataaaagttttagggttttttctttttttatctgtgaaaaatagcattggagtgttgatagggattgtgctgaatttgcagatcacttttggtagtatggacattttaatcattttaaaatattcttacaatctatgaacatgggatagctttccatttctttgtgtgttcttcaatgttttttttatcctttgttgcagccccaatgcctgtggactgaacaaagggggacggacacaggaataaagacaaagacaaaagagtatatttggaagaaggggtcaggggctccttgcttctagtgagcaagagtcctgagcttttagagcccttcatatttattgagtaaaggagatagggagaagcgggtggttgtcagtcagctgcttgacttggtgcaggcttgcacgactgcattctctgaacagtagcctccagatgtttcagtagataacctcaaggagcatggcgccagggagtaattgcactcagcataccttctggcggcagggcagatgtgagtttgcccacatcctgcattcatgataaacagtttgctgtttaatcatatagccttcagtggaatgcagagttggtcatgaccctttggcttttggctctctacagtcctttcttttttctttctttctttctctttctttctttctttctttctttctttctttctttctttctttctttctttctttccttccttccttccttccttccttctttctttctttctttctttttttaagagaccagcctcacattgttactcaagctggagtgctggcatgcagtggggcgatcatacctcactgcaggtttgaactcctgggctcaggcaaccctcctgcctcaggctcccaggtagctaagactataggtatgcacgaccatacctgggtgaagggctaagactacaggtatgcaccaccatacctggctaatttcttttctttgtagagaaagagtctcactatgttgcccaggctggtctcaaactcctgacctcaagcaatcctcccacctcagcctcccaaagcactgggattacaggcatgagccactttcctggcctcttcaatatcttttatcagtgtcttaagagctttcagtgtacagatcttttacttcactggttaaatctgttcctaagtattttattccttttgatgctattacaaatrggactgttttctttatttcttttttcagatattttgtctttagtgtatagaaagatttagggcccctcttctgagacatcctcactgaacttaatctagccaatgcycagctgcctttaaactagacttaatattgtcagcacttgctggcaagtttyctcagcaggcccaactttgtggtcttcatactgaaggcccagsgtccttcagtttgcagtttgtgtacactcctgctgtgttgcaygtgcccagagatcctgtaccttttagcctagtttgttcatgcatgcatggaggagaggtagaaaaatgggggaaaatggaggggagtccatagaaggctccagaaagcaagggtgggccttcagatgagccatggtatggtgtgtgcacctgtcccaagtgtggttataagagcaaggggtatgtggaactcttggaaaggaatttcttaggtctggcagaagcacttggaagtgggattatgagtggttgtgcatggatcattttggaatgccacagtttctttattttttgctcggttgctcaggctggagtgcagtgatgtgacctcggctcactgtaatgtccgcctcccgggctgaaggcatcctctcacctcagcctcccgagtagctgaaactacaagcgtgtgtcaccatgtccggctgtttttttttgtattttttagtagactcggggttttgccatgttgcccagtctggtctggaacttctgggctctagtgacctgcccaccttggccttccacagtgctgggattacaggggtgagcaatcatgcctggctcattaatgattttcttcatagcatttgggaccccatctactgcctcttggttggagtggctgcttctgttatcttgacattttttaagccaaacttcttaaattatcagtccatattttgctggcatcaaactctccagctttagatcctttaccttcctaaagttgtcataaaataacttccctttttctcaaatcatattagagtctacaggtatgccttcattatagtgattttgcccctgtataaagctgcattttcaatatgagataaaaaaggtatttagcaaaaagtacattgttttcgtgcctactggtgtagctgcagtgacggcttcatgaattttctcttttaacagtggtccttacaccagattaatttatcttgaaatggcgggcaactgaatcgcacacctcaatctatggtacgtattaagcaagtcaacatgttcttataatgtcatggcttttctctacttcttgggagcacttccagcatcactagtggcacttcagatgggtcctgtgttgttattcagagtttatcgtattgcaccaaacaatgaaaaatgtgccagaaccacagagatcaatttttactgcggtctgcaatttactagagagattaacagttcacatggagatgattaacatcacggggcacattaagcaggtacctgagctcaccacaatagcaatgggaggtggctatgaaattattatagaagttcagtatgtagtacagttcattaatgcagttatgattgaatactgcgtctttacatttttttacatttattttgactgtagatggaaccatatacagtctagaggtgtttatataaatttggtacattttaacttagaatagatttgtgtgtgttttatggtactaagtgataaaatagactaatagttacatatattttatgcatttctggcatacctttttcttaattagggtacatggttcatctgtgagttttttcaaattgttgcaagtcttcaaaatatttttcagatgtttattgaagtaaattcttttataaatggacccatacaatccaaactcatattgttctatcgtcaactgaagtgagaagcaaggcctaagtggagtccacagggaggttgggcagctggagggttggttcgttggtcttgagagcgtggaacccagaactgtactgccataagcacttttcatggtgacttctgcggggtcttttgggagtgcaggaatcatgcaacttaccgaagtattatctggaaaatcacagagatcatttaggggggctacctttgtttttttttttttttttggagtattttgggctgcacgttaagatggttatagatgcattttggatgcattatctaaatgtcaatatggagagtttccttggaagatgttggggtctcattggggcatgtgtgcatcattgaagatatctgttttagtagatagtggtgccagtattcgggggtggggtcattacaggcatggaccaccgtgcccagctaatttttgtatttttagtagagacggggtttcaccacgttggccaggctggtctcaatctcctgacctcaggtgatttgcccacctcagcctcccaaagtgctgggattacaagtgtgagccaccgcgccgggcctctctgtttattttttggagttttttttcccctaaacctggcccatttcaaggttcagtttgataatgtggcactcagcacaagagacttcattctggcttggtctggtagttcgggaggctagtccaaaacaacagccttcccataaaaaacaatgagatcatgtcctttcccaggacatggatggagctggaggccattatccttagcaaactaacacgggaacagaaaaccaaatactgcatgttctcacttacaagtgggaggtaaatgatgagaatacttggacacatagagggaaacaacacacactgggatctacctgagagtggaaggtgggaggagggagatgatcaggaaaaataacttatgaatactaggcttaatacccggatgatgaaataatgtgtacaacacatccccatgacccatttacctatgtaaccagcctgcacgtcctgcacatgtacccctgaacttaaaatataagttaaaaagaaaacaacgaaaatactttgggcttccataaaatttgtttaactgtgtcattcatttttacttctacagaattactttaaacagtgtttactgatggtggtgtattgcccattaaatgcatgcacacacacagaccctaaagcctctagtttccttccactgtgccctaattaaaacaaaacataccattaactgtgtttctgcctgtagtgagtacccctcttctgtgcttcatttaagaccataatacaatacaatcttgttcagagtctctgtcttcacttgttgcctccaattgtgtcttgaatgcattggatgaaactttcatatccaccattccactgataactttatttttcagagtcaccagtgacctccccatttctaaatccaatgtatttcatttcctgctttactctttctttgcctgtcaggagctatttgattttcttgtcacctccctgaccatttcacactttcctctgctgctgtgtcctgactctgaatgtttcccaatgtgggaatgactcatggcttagtccttgaacctcttcttgtttctgtccacacccactgtctttcctcatcatctcatyttatgaatttaaaccccactgtattagtccattcttgaattgctataatgaaatactggagactgggtaatttataaagaaaacaggtttaattggctcacagttctgcaggctgcacaggaagcatggcgacatctgcttctggggaggctgcaagaagattccagtcatggcaggtgaaggaggaacaggcgtctcacatggcgggagcaggagcaagagagagtgaggggggaggcgctacacacttctaaacaaccagatgtcgtgagaactcactatgataagaacagcaccaaggggtggtgtgaaaccattcatcacaaatccacccccatgatccatccacctcccaccaggccccaccagtaacagtggggattacaattcagtgtgagatttgggccagggacacagagctgatccatatcacccacctacccacctacacgtctccatgtcccctgcagacctgtcccctgaactctagaattctgtgtccttttgtcctctcctctctctgcttagccrtctaacaggtatctccaccaaaagtgattgcctgaactcaccaagtacattcccctgcactcctgcacatctcagatgatggtgaccctgtacttcctggctttagctttacatgtcagcatatatttgaaacagagaaaacatgacattaaaaagaagtgctttaattcatgtgataaagaaaagtyatgtttacttaaaaagggtgaggaaatgcatagtttctgaaattactgtgagctgtgggagaaagatgtttgaatacctcatctctacctaatctgctccccagaacctctctgacctcatctcctccctgtgtccttcctgctccctctgctccagccacacaggcctctttcctsttccctgggctgaggttgctcctgcctcagggcctctacctgggctgtctggcccctcagctgcaggtgcaaacatccttccttcttgaggtctttgttctgatatyaccttctccattgggacttctgtgcctcaccctcctctcaccatttaacactccagccacaccctcaccccacccctggtgcatattatgtgtctctgtgtttctggtccattgtgttctactgtctacaaactggtaacartgaagccccaaggggacagcagagctgggaggatggggctgtgctagtcttgccccctttaagatgtgttcaaccctggcttcacattagcgtgctgaggcagtttgcaaatacacgttttgtgcccttttaccatagattscacttccagtaggtaggatggactcaacctccatattgtttaargtacccaaattgattctaatttgtatccagcattgagcgtccagcctttgtgtcttctgtttctgagagctgagctcagcctgtgatccacagggaggtgagggggctgtgctctgtatggggtttgatcagggatgggtctgtgtcctgaagggaagcatagtccagcccagctccccactgttgcagggtgtgtgggggcttctctgggaggggaacaagttctgaagaaaagggtgaaaaacttacttggtctttgtgtaggagtttattatgcttgcatccccctggtgcactgggctgtctctccacatgctgaggccttccctgtgggcatggttgtggcacagaaaggaatgtgttgtttccaaggattaaacaacatatttttgactttcagatttgacttttaaagaattaattatattgactgagagagaggcccaggagagaaagaagaaagaaaaggagccagggatggctcttcctcaggtaaagtgataatcttggtggattgttctgtctcctccctttttgaaatgcagggcattggagctgcaaatcttctctgagtctgaagtatcctgcctgacacatttgctcgcactcacccaygccttccttyagtccctctcttctgcacttagattccagatctcacagtgactcagtgacatgagcttgggaagaggctccactgggcatggtcctgggaagggctcacacccagacatggatggagacagggtgtgagttctgtggtgtcagcttttgggcagcagagattgtttaggggcaacatctgaatgcactgtcagctctcagtagaccaggagtagagaagctgtatgtggaagtcacatgttaatatgcaaaaatacctcataaattcttgaaaagatgcctytaaggggagatcttttctgcctgattttataccacatttgaagctataatgaatcagtcactctttctaactccacaatcttaatgaccgggaatggaatggaaaactaggtacagacatcagtgatagaggttgttttattccatcattgattttaaaatatgaaatcaacctgaatgtcagattaatttagccattctcagcatatccatcccacagagaatgtggtgttcctgctgggactcttaccggcagttgttttttgtaaaacggttataattttgctcagatgtaagagccaaacttttttgatgtcagagaagatggagccaaattctgtcattccaccaattattattaaatattacatttattttaaacatcacatgatatatatatttgttttgtggtaaaagtccaagcagagatggaatttagacattaagaaggtgatgcaacataaggatggtagggaataacgtgttattatatgtgaaatttatgctaaatgagattttagctgtttttgccacaaaagcaaaaaaaaaaaaaaggtaactatgagatacggatatactaatttgttaaactgtcgtgagttttttactatctataccttgctatattgtgtaccttaaatatacacaataaaatttgtaagcaaacaagtaaaaaacagggcatcaagaacacccttcataacctmaaaaaagaacatcaaggcatatatatttaaaaacttttaactacagaacatgaaatagctcctagaatgcagtaaaagaaaattgagcataaaatgaaaattattttattttgatttccacaaaataatgaaatgtcctcacagtccaaggaattggaaaatggaaatacaaagaatttttattttttttagatcctcaaagagaaaaaagaacatagtagtatttttttttttttttttaaagagtgggacatgtcatgtgtcattggtgggagggggcacccttgaacttggggtagtggggaatcttgccagattcaccaaaataggaaatgcaccatcctagaagaggcaatcactctttcaattacccacccagaggaacccaggttccttttccctgtcacattctccaccatgcctcatgtttcattgaggagctactattgtaagttctgtggcaagagtcagtgagaggtgtcaagatgcatttacacgtcattatgagattttagaaaacaattcttaagtgaatgttctgctgtattttgcaagtttttgaaatgtacattttttttttttttttgagacggagtcttgctctgtcgcccaggctggagtgcagtgacgcaatctcagctcactgcaaactccgcctcccgggttcacaccattctcctgcctcagcctcctgagtagctgggactacaggcacctaccactgtgcccagttaattttttgtatttttagttgagatggggtttcaccgtgttaaccaggatggtctcgatctcctgacctagtgatccgcctgcctcagcctcccaaagtgctgggattacaggtgtcagccaccgtgcccagcctgaaatgtacatgtttttatgttaataaacactaatagcgtattttgcatcctctttggagcaatttctaaatgaagacatatggatcttttacaatttttcatttttgcaaagaatgtcactgtggcttcctctgtgcatgctgtcttcaccacaagtgtctgagggttacttcaatggcagttcaaagaatgattgcttcttttaggatggtataccacaaaagcaaaaataagtaaatgtttgttttatcttctggaaggcctggctcacggtgtgattataaaatatgaagtttctttaaaatctcatgtttcttgcttacattttctttgcatgaatttttttgattgaatctttaatttgaatttttgtgtatatctttttgtagattatatttgattgcttttaaagtttcagattataaatgtcataataggttcatatgaagattggcaaaccyctccattttctttccaaaattttgttggttctttttttatacaacagtcacattttattaaattcccacatattttgtttgtgtttgaatggccatgaatttttacagtcgcaggtcttgtcaccatcacatcttcctataagaattgagtttgtcagtcagtgatcatatctttattatgtctttcagtaaagcttgtttgtttgcttacagtttagtaatgttaggtatattcacattatttattgggctttcaggatacatacgttcttgatgcttgatggtttccccatgagccctttagactctctttatttttctttattttttatagtttttgttttcctccgtgtcaaaatcccctttgagttcactgattccttcttctgcctcattaagtcagctgttgaattcatctagcgaatttttcaactcagttattgtatttttaactcgactttttttctttcttttgttttgttttcaggcagggtttcactctttcccaggctggagtgcagtggcacgatcttggatcactgtatcctctgcctcccgggttcaaatgaacctcccacttcagcctcctgagtagctgggactacaggcatgcaccatcacacctgcctaatttttgtactctttgtagagatgggattttgccatgttgccctggctggtctcagaactcctgggcttaagcaattaccccatcttgggctcccagagtgttggaattacaggcgtgagccacggtgcccagccttagaatttctttttgatttttctttatagcttctatttctgttgatattcttctttgcatgcatagttcatatagttttcctgatttcgtgagcttgtctgtgtgtgctatcttttaactcattgagcattcttgtggctgctatttcaaattctttggtaattcacatatagtcagccctctgtattcatggctcgtgcagccatagatggagccaactatgaactacaaatagccagaaaaaaatggatggtttcatctgtgttgaacacgtatggtcctttttttcttgtcattatttcctaaacaatgcagtataacaactacttatgtagcatttacattgtattagctattataagtaatgtagagatgatttaaatcatatgggaagatataggtaggttatatgcaaatactatgcctttttatataagggacttcagtatccatagattttggtccccttagggaatcttggaaccaatcctctgcatatactgagggtgatccccatttccttttagttcttcaaagccaagatttaaatcaccatttctttagtgtaggtttgtagagacttaattggtttctttttatggactgtattttcctatttctttgtaagttttattatcttcttttggcacttccctattttaaaaatcatctacctccccagttttgggtggttgctttgttcagggaggacactctggagtcaactcagctagattgtggagaccttccacaccttttctggctggggattttgtcctctctgggcctttgcttgtcatctcttcattgaaaatgtttgctagtttctacccagaagctcccctgttgtctgtctttgatattgcagactttggtgctacagtaagctgtagtactagatatgcacttagcgtttgtctgtgttactgcacacactggtttatgtaaatcatcctttttctcagtggcccctaacctttcaccttgttcttgtcagtgcttatattcaggaagagagaaaccagcccatcagttggtcatctgaaaagtcaggaagttggacagatattctgctcctttccatcccctagatgatcttgggagttgtgggtttcttttctgttaccccagtgcatggcaggggctggatctctgtcaagtggatgcttcaaattttccttcagagcttctatactgtttgctttatgtcagcctgaggtgtagaaacctcctaactgttttctggatttatccccgaggcaattagtccatgaattgttgttaaaatcatttcactgtggtgactggagagtttggggattcctgttcctttatcttgccgacatcactcagtgtagttttataatttgttcacataattctgaaaatgtattgtacttaagtgccatggtatatatgctaatgaaaatttagaagtgtgtgtgttgtttttaaattagtgttactaaagtaggaagattatttcagtacattgttagcattgttagcttgtatacttaaacattctttttctgggttgcaatcatgttatctctttttttttttttttttttccctgagatggagtttcgctcttgttgcccaggctggagtacaatagtgcgatctcagctcaccgcaacctccgcctcccaggttcaagcgatcctcctggctcagcctccctagtagctgggattacaggcatgtgccaccatgctcggctaattttgtatttttagtagagacgggatttctccatgttggtcaggctggtcttgaactcccaacctcaggtgatcctcccgccttggcctcccaaagtgctggaattacaggtatgagccaccgtgcccggccacaatcatgttatctcttaattttagtagatctaactctttggctctaccccctccttgcctttttccctcccaccttttctctttgctgctgctcagacatccagtgcagtggtgaatgacaggaggtctggccaacccccttttctcttaatttagaggaaatgaaaaacccccttttctcttacttaatttagaggaaatgaatccagtgtttcacttgttgggtgaaatatttttccttaacagtttttgggttttttttttttttttttttttacagatttcctttgcaacatgatttttaaattttctaataatttatgcaagcatatactgctgcaatacatattgtttctatcttaatctgttaaattttaatgtattacacttataaaccacctaatcttgaatcactgttttatttattggtggaataaacgaataaactccatttggcttttgttaatgcataagtagctaaatttaactggataaaattgcacttagatatttaaatataggcatttaatagtaattgtaataaaagtttatatacttttaaaattttgtaccattttctccagcctagtattgaataagtacaaaataaataagtaaatgaagtactaagtaaataagtaaatgaagtactaagtacaaagtaaatgaaatacaatttatacattttcattgtcccaagcatgctaaaacatacatgtctaagaataatgatttaaaaagtcatccaaaaaatatgtcattgagagatagcgtcttatttcagttaatttaaatgtttgtatgctttggtttttatttacaacatcatcatttcataaatcagcctattatcttttcacagttgaaattatttacttggttttattttaatttttttcttttctctacataagatacaggcttgggaacactattgaaaattatatcttaaatgtttctatggccttaaaatgttttttctttaaaaactttttttttttttttttccgagatggagtcttgctctgtcacccaggctggagtgcagtggtgcgatctcggctcactgcaagccctgcttcccgggttcatgccattctcctgcctcagcctcccgagtagctgggattacaggcgccggccaccacacccggctaattttttgtatttttagtagagacagggtttcaccgtgttagccaggatggtctcgatctcctgaccttgtgatccgcccacctcggcctcccaaagtgctgggattataaaaactttttwacatatttctttgtcccagtgatttgcttaatttttaaaattgccttctatattatcatgtgaatggattagttttatgaatagtaatgtattatgtgtgtgcttctgtgtgcttatatgatgatcttttttttctttgtttttgagatggggtctcactctgtctccaggctggagtgcagtggcatgatctcggcccactgcaacctccacctcccaggttcaagtaattctgtgtcagcctccccagtagctgggactacaggtgcacaccaccacgcccagctaatttttgtatttttagtagagatggggtttcaccatattggccaggatgatctcgatctcttgacctcatgatccacccatcttggcctcccaaggtgctaagatggaggtgtgagccaccacgcctagcctatataatgatcctttatgcggttccaagttaatcttgaacttgcttcaagttttctcaggcaaccctctgtcagtatactgtagcattcgtcccctatgcagcaacaagaccatcttcgaagcagggattagccctcagcgacatcagtcctgctgacaccttgatcttggattccccagccagcagaatcatgagaaatacatttctgttgttcataagttagttagtctctcttatttygttatagccacacagaaagactaggacatactctgtaatataactgtcggattctgttgattcaactctaatttttagacatctgggttcaggtgcttgctctgctgtttgcaggttgttgacctaggtgactttcttagcctgtctgtgacacagttgtcttctagtaagatgggaaraaatatttctgtcataggtgattatgtcatcatttgagttagaacaygtaaatcctttgaagtaatgcccggtacatggggagtgttccaaaactttagttcttgctgttgctcttgtcatcgctgtttttagtttctgacctttctttaaagccactaagaacattgtcatctctgaagacaccacttgtattctagctcatctggacacctcacttggtgtaacaaatgtaatatctaaaactttcatagggataaccatgtgtttatttcttattttgtccacaaaagtgagaaatgtgcaccgatttagataatatcctaatctcctattgaattttataaaacccaaaatcagggagacgtaattatctcacagatacttttaatggatatgtcaaaacacacttcaatcaaattgatgtgacagttctctcctcttctcattttatgtaaagataagagctcacccactgctcatattgaaatgtgtttttcatttcagggatctttgacattcagggatgtggctgtagaattctctcaggaggagtggaaatgcctggaccctgttcagaaagctttgtacagggacgtgatgttggagaactacaggaacctcggcttcctgggtgaggatagttttcctccagaagttaggatcttcccttgtgcatttttgtactttccttattgtgtttcttgtgaggccctacattatttgacagagactgaagccttgttgattcacaaataaaaagcttcataatgctgcatctggcctttaactgtcccatttctatggatattctgcttccttctttgtacattagtggtgaytccagagctgaggtacgtgtaaaaccttatggcggagttaatatatccaattccctgttcttcctgttttctatccttgtgctttttttttttttttttgacacagtctcagtctgtcacccaggctggagtgcagtggtgtgatcttgtgatcttggcacactgcaaccttagcttcttgggataaagccatcctcccaccttagccttccaagtagctgggactgtgggtgtgcaacaccatgcccaggtagagacagggtttcactctgttgcctaggctgatcttgaactcctgtgctcaagtcatcttcccgtcttggcctcccaaagtgctgagattacaggcttgagccagtatgcttggcctatccctgtgtttttgattcagtatttcttgggagagagctagatatcttcatcttacagtgttcactaagcattcagaaggaggcaatcaatggatgagtttgtgaaatattttgtagattcaactgcagtgttttctcttctacctagacattaggctgggttctggaaaaaccgtgggacatcttctttctttttttataagcaggactctgtcttcctgacctgaatattatctccatgttggagcaagggaaagagccctggactgtggtgagccaagtgaaaatagcgaggaacccaaactgtggggaatgcatgaaaggcgtgatcaccggtaagagctcagatgggcacaatggaagcggtaccatgaaattgtgtgcgtaagactctgcaagtgggagagttctgtggggaaacaaatttgattttctgtgagctccagaagttttcttctttcctgcttatcactttgctttccagacacgtataactttacctttcactctccaggggttgctgcagctcaaacagagcaaagtacaagactgttatgatggaccacagtgtcatctgtattgtgtgaactctgatgctttgactctgtggcatgggaagggccttttcaaagaagtctctttcccgtgtggtctctcctcctgttcttgattccatctgatcctcagttctctgatccatatagattggagctgagggctccatagtcctggtgcctggaacttttctggttccaccccatttcctatacttgaaagtgctggtcaggagatgaggaaacattggttgcccttcctttgaagctggggtcctagaactggactatcttcagccctctctgcctgttcaggtccctcagccattttcttagttcttctttggacactcttcttgggtttgtgacacgggaatgagttgggtctcctgagattgttacatataagaattgtaaagacagttgacacaaaggtcctctctttattcttagtcctacacagggagcgtatctctgtcttcacactcttagtttgggatctgtggacagagcactgtctcatttcaagatccctcacaatccaattcctgtgtttttctctgtcttgtttatgccttggctctttctgatcttgcattctcttttatgtttgtgtgattttttgcctctgagacttgctttggataaatgcatttctagggtcggacattttatgcttttttcctgctgtgataacccatcttggggttatgaatatcttgtggactatygtatggagtgagtttactgggtaagagaaaatttttgaaggagagcactttgagtaatgagttttaacatcatcttgctacatacagaggtaactattaaagccagagtagaatgatcagcatttgtcatgatattcagatagagaccatcacaagagcctggtttctgagaaatgtcacaaaagtatctttcaagggtactgtggcaatgttgatctcatatactaatggtcctcttttttgagctagcagtgaatggtgtaggaatttctcccatgccgggcacggtggctcaacgcctgtaatcccagcactttgggaggctgaggcgggtggatcacctgaggttaggagttctagaccagcctggccaacttggtgaaaccccgtctctactaaaaatacaaaagttagccgggcgtggtggcaggcacctgtaatcccagctactcggggggctgaggcaggagaatctctcaaatctgggaggcggaggttgtagtgagctgagattgcgccatgcactctagcctggggaacaagagcgagactttgtctcaaaaaaaaaaatttctcccgggaagaacattgtccaggttcacagcttcatctctgcagggctgttgcctgaaccactgctcatgccacacttttcttccccagtatttttgtttatagtgagtacgactttgatcttgaggaagctaatgaagttgaatgaggcttatcttttttaagtccacaaaattcgttttaagcaaccattgctttcatctgatgcattttcatgtattataaatgaactttgtttttatttatttaatcagttccatatttttgaggatactcagttttctttgttttatgtttctattgtggtagtgttgtgttggggaatgcatattgttttatgtattttacaagatttccttctttagtacagatggtatagctcagcagcagtttccctaaaacttacagaaactccataatgttgtrttgatagtatcagttattccttttacttctgtttcacctgacttaattcctactatgaaagtatatatttgtcggttaaattgattacagtttttaagttggaaatttttaatatcttgagcataattttttaagttactatcttaattgtggaaataccatttaatagattgatcgttctttgttatataacatacrttgcttttctgtagtaagtttcagtttcctaaatatagcttgctgggttttgttcaaattgcactgtttttttctttcttggaacaaatgctgtattataataactattctcctatctacattcatgtccatcatgttatactgaatcattatttaaaaatctaactttattttaaacttagcccatttcttacacttcagggacttctctactatttataaaacctatatatttttttcgtgatgctcaagcaatgaagaataaattctcttaaaaaactggtattgggccaggagcaatggctcatgcctgtaatcccagcactttgggaggctgaggcaggcggatcattttgaggtctgaggtcaggagttcgagaccagcctgaccaacatggtgaatccctgtttctactaaaaatacaaaaaaattagccgggtgtggtggcacatgcatgtaatctcagctacttgggaggctgagacaagagaattgcttgaagccagtaggcagaggttgcattgagctgagatcacactgctgtacttcagcctgggcgacagagcaagaccctgtctctaaaaaaaaaaaagaaaaaaaaacaacaacttgtattttgtccagaaaagtttttcctagattttcttctagaatttttgtagcttgaagacttaatgtaagtcgttattcatcttgaattaatttttgtatatgacaagagataggagtccagtttcattcttctatatatggctagccagtttttctagcaccctttattgaatagaatgtcttttcccaatttttttttgactatcaaggatcagttggttgtaggtgtgtggctgtatttctgggtttcctattctgttccattggatatcttctgttttaatgttagcatttatatctgcagattttctatcttagcactgtttttcctgcattcacaagttttggtatgttctattttcattttcctttgttttgagatttttaaaatttcccttgtgatttctaatttgacatattggctgtttaagagtatggtccttgtttgtttgtttttgttttttgagacggagttacgctcttgttgtccaggctggagtgcagtggtgcaatctcggctcactgcaacctccacttcctgggttcaagcgattctcctgcctcagcctcccgagtagctgggattacaggcatctgccaccatgcttggctgagggtttcactatgttggccaggctggtctcraactcctgacctcaggtgatccacctgcctcagccacccaaattgctgggattacaggcrtgagccaccacaccggcctaagagtatgttgtttccacatatttgttgataatctaattttcttctgctgttgatctctagttttattttattatgatgggataagttatgctttacgattttagtctttaaaaagtttaaaattttttttcttttccgatatttcttttgaaaaatgtttcatgtgcagttctgaaaaatttgtattgcactgtttttgggtgatgtgttatgcatatataggttaggttcaayttgatatatagtttaggttctctagttccttgtttttcttctgtctgattgtcctatttataagtaaaaataggccattgaagtctcttattattactgtggaactacttctccctttagttacgttaattttgcttcacatattgaggatctctatataggcacatattgttatatcctcctagtgaattaaccttttaatcattatataatgcccttctttgtctcttgtaccagttttgacataaagtctattttggctgacatcagtttagccacctctgatgtctttcggttaacattttgagggcatatcttttttcatcccttcagttcagcctatgtgtgtcctttgaattaaaatgagtattttctggatagtgtgcagctgaagccagttttaaaaatttattcagccagtctctgtcttttgactgtggagtataaacacttacatttaatgtaattactgatagaaaaggacttatattgccattgtgttaagtgctttctatatctcttttagatttttttgttctgtttgtcttactgccttcgtttttatatagttgatttttttttcctgaaatagttttatttccattgtgtgtgtcttctatacattctctgtggttacygttgcaattacagaaaacactttagatttataacatcctattttaaactaataacagcttaacttcaattacatacagaaatgactttttacagatctgcttccatgttgtgtttttgatatcccaggatactttcatcgtatatactgtgtctccattaacatatatttaaaccttgacaagagtctcctgctttctttgttttctcaaatcttygcctgttgtgctacgggtcctcattctgcaccccgtctccttaacgttcttgtactatcagtaaagttttgtggtgtctttgtgtgtgtacaaaatgaattcatccatctcctcttcgtggccattttcaggttttttcttaaggattgaattgtaagaacagtctttcacatatctcttgatatgtagggttgttgagcatatacctggaaatagaacttatgggacattcagtttgataaatttcatagcaaatattatagagacataaatctgttttcttcccatatcatcacaccgcctcctttttaattgtcttcccttgttgtcctgcacccatagtataattctcatgtttaagtattagtcagtacaatactacctctacattagtttctcttttcttccaaagccaggattttagctgtttcttgtgcaattctattcccacagctcttcaagcacaaaccctgctgctccatgctcattactccttgatctcccctcttgccctttgtcctcctgggcctttcctaacatattactttgtccagatggactacccagttactgactagcatattaattttatactcccattattgcagaactccctcacctcccatgctactctcactctgtaaggggtgacccctactcattcacttgaccactgtctgataacactgcgtaaatcaatatgtgcaggggatgatgactcagataccgttcgttattcatgacggatggctgaataatgcttttggcaacacagcattgcagggagccaaagcctgtgggacgtgaccaactcagcattccactggaggctatatgatcaaacagcaaactgtttatcatgaatgcaggatgtgggcaaactcatgactgctcctgctgacagaaggtttgctggaggcaatcacttcctggtgccagggttatctactgccatatctagagcctgttgtttgaggaatgcagtcttgcaagcctactctggactgcgcagctgaccccttcttccaccatccttctcactatctctcttgcctaataaatacggacggctgtgtaaagctcagggcccttgtccactacaggcaaggtgcccctgaccccttcttccaaatatactcttttgtctcttgtcttttattcccgcattcgccccctttgttcagtcctcctaggtccatgtgggttacatagtggcaccctgaacagcgacagaatcaggtgctctacacaaaatggctcttgaagtatttctacactcttgatatttgggttgacctgttatctgcactgcttgtttgggaagttgtttttaaaaaacatgtttgatcttgcaaacccaggttcttgtgtcttactttctttgtaaattgggtatagatacataaatcctgtgggcatatttagtgtgcttgtttgttaaatagtgataatttacctaaagactttttaaacaagttaatgctgttagctagcttagaatattgcatgttttatagtacagactcacaaatttgtttaataacgtgtatcaacattgtttcatgtttataatgagatagcatattggctttaccttagtcagcatgactagctatatcagataccatagatagggtggtttaaacagcagaaatkgacttttcacagatctgggtggtgcaaagttcaacatgtcagagccagccactttggttcttggtgtggacttttttctggtgtgccatggctgactctgtgttctcatgtggcagagagattgtcatgcaaaaagcagaggctttttcacgtttctgctaattgcattcctgaagttctatgcaccatcctgacctaattgccttccaaagaccacacttccaaatactatcacattgaggatggggccttaacataggaattttggcagacataagtctttatatcagagcagtctacattgtatctgtaagttttcattttgcagtttggtccaaacggtgttgtcttttatctcagttcatgcattttccaagtacaatctctgtatcatatatattttgtggccaaggaactggataataaagacagtgaataggactgggcacggtggctcatgcctataatcccagcactttgggaggcagaggtgggcagattgtttgagcttaggagttccagaccagcctgggcaacatggcaaaacctcatctctaccaaaactacaaaaaaattaaccgggcatgatggcatgcatctgtggtcccagctctcaggaggctgaggtgggaggatcgcttgagcctgtgagttggaggttgcagtgaggtgggatcatgccactgtactccagcctgggtgacagagtgagactccatctcagccaaaagcaaaaaaagacaatgaatacatagggacttgctctgttgtttgttacatagttgtaggcatgaaatcataactgagatttctgatttcctttcccaagttttattctttttttgaggcagtctcgctctgttgcccaggctgaagtgcagtgtcgtgatcttggctgactgcaacctcccccttacaggtttatgtgattctcgtgcttcagcctcctgagtagttgggattacaggcatgcatcaccacgcttggctaatgttttatatttttagtagagatgaggtttcaccatgttggcctggctagtctcaaactcttggcctcaagtgatctgcccaccttggcctctcaaaatgctgggattataggtctgagccacsatacctgtctccatttttttttttttttttgagactgctctgtcgcccaggctggagtgcrgtggcgaaatcttggctcactgcaacctccgcctcctgggttccaatgattctcctgtctcaggctccggagtagctgggattacaggcacgtgccaccacacccggctgattttttttacttttagtacagacgagatttcaccatgttggccaagctagtcttgaactcctgacctcgtgatccacccacctcggcctcccaaagtgctgggattacaggcttgagccaccgtgcccggctgacctgtccccaatttttattctttattattttatatatttacctttctctcatccaagtactaaccagttctgacactgcttagtttctgagatcagacaagatcagatgcattcacggtggtatggccatagacatatttacctttcttttatctttaaaagccagtgatctcaacatattttctagttatatactgcctctagaatataaattcttgcttattattgatggagaattgtttagaatttcatactatagatttgtattttgtggttgttcattatttacctgctggttttatcacaggctattagaatgttttattaattaatttatattatgattatttattagttaatatttaccattacagtatatcttgctgttgcttggcattcatttgtatgaaataaatatatgtaactttttttctctcctattatgagggagccatatgtttactgccaattggtgtgtcatttggggtcagcgattgcaaaatacttgttttggtgctcatatatgtttgcataacatgagtcttttggtcgaaggatgtttgaaactaggctttcctaaaattgatttaaattacatgtaatcactttttctttactatagaattctattcattttgcatttctacaaatagaagatcatggtagaaaagtttcacaacttgctagtataaacattatgtttagcgtagtgtgttttcagtataaaataatatttaccaataatagttattttaaaaccccatgttcattatattttgcaggtatctctcctaaatgtgtgatcaaggaattaccaccaatacagaacagtaacacaggagaaaaattccaagcagtgatgytggaaggacatgaaagctatgacactgaaaatttttacttcagggaaatccggaaaaatctacaggaasttgactttcaatggaaagatggtgaaataaattataaagaagggccgatgacccataaaaacaatcttactggtcaaagagttcgacatagtcaaggggacgtagaaaacaagcatatggaaaatcarcttatattaaggtttcagtccggtctgggtgaattgcagaaatttcaaactgcagagaaaatttatggatgtaatcaaattgagaggacagttaataattgttttttagcttcaccacttcaaagaatttttcctggtgtccaaaccaacatttctaggaaatatgggaatgattttttgcaactttcgttacctacacaagacgagaaaacacatattagggaaaaaccttacataggtaatgagtgtggcaaagccttcagagtgtcttcaagtcttattaatcatcagatgatacatactacagagaaaccttacagatgcaatgagtctggtaaagcctttcatcggggctcactactaacagtacatcagatagtccatacaagagggaaaccataccaatgtgatgtatgtggcaggatcttcagacaaaattcagatcttgtaaatcaccggagaagtcacactggagacaaaccctacatatgtaatgmatgtggcaagtcctttagtaaaagttcccaccttgcagttcatcagagaattcatactggagagaaaccttacaaatgtaatcgatgtgggaagtgctttagtcaaagttcctctcttgcaactcatcagacagttcatactggagacaaaccctacaaatgtaatgaatgtggcaaaacctttaaacggaactcaagcctcactgcacatcatataatccatgcaggaaagaaaccatatacatgtgatgtatgtggcaaggtcttttatcagaattcacaacttgtaaggcaccagataattcatactggagagacaccttacaaatgtaatgaatgtggcaaggtcttctttcaacgttcacgtcttgcagggcaccggagaattcatactggagagaaaccctacaaatgtaatgaatgtggcaaggtcttcagtcaacattcacatcttgcagtgcatcagagagttcatactggagagaaaccttacaaatgtaatgaatgtggcaaagcctttaattggggctcattactaactgtacatcagagaattcataccggagagaaaccttacaaatgtaatgtgtgtggcaaggtctttaattayggtggatacctttcggttcatatgagatgtcatactggagagaaacctctccattgtaataaatgtggcatggtcttcacttactattcatgcctagcacgtcatcaaagaatgcataccggagagaamccttacaaatgtaatgtgtgtggcaaggkcttcattgacagtggaaacctttcaattcataggcgaagtcataccggagagaaacctttccagtgtaacgaatgcggcaaggtcttcagttactactcatgcctagcacgtcatcggaaaattcataccggagagaaaccttataaatgtaatgattgtggcaaagcctatactcagcgttcaagcctcactaaacatctggtaattcatactggagagaacccttaccactgtaatgaatttggtgaggcttttatccaaagttcaaaacttgcaagatatcacagaaatcctactggggagaaaccacacaaatgtagtgaatgtggtagaacttttagtcataaaacaagtctggtgtaccatcagagaagacatactggagagatgccatacaaatgtattgaatgtgggaaagtctttaactccactacaaccctggcaaggcatcggagaattcatactggagagaaaccttacaaatgtaatgaatgtggcaaggtcttccgttatcgctcaggcctcgcacgtcattggagtattcatactggagagaaaccttacaaatgtaatgagtgtggcaaagcctttagagtacgttcaattctgcttaatcatcagatgatgcatactggagagaaaccttataaatgtaatgaatgtggtaaagcttttatygaaaggtcaaacttggtttaccatcagagaaaccatactggagagaagccatacaaatgtatggaatgtggcaaggcgtttgggcggcggtcttgcctcactaaacaccaacgaattcattctagtgaaaaaccttataaatgtaatgagtgtggcaaatcttacattagtcgctcaggcctcactaaacatcagataaaacatgctggagagaaccttmcaactaaactcaatgtggaaaggccgttagatgttgtcctaacctctgggatccccaaataatttatacttactcatatagcttgtatatttgtcctttccctttgaagtctcatgtggaattgtagtaatctccagtattggaggtggagcctagtgggaggtgattggatgatgggggtggctttctcaagaaagttttagtaccatccccttgttgctgtccttgtgatagttctcatgaggtctggctcatgcctgtaatcccagcactttgggaggctgaggtgggcggatcacttgaggtcaggagttcaagagcagcctggccaacatggtgaaaccctgtttctgccaaaaatacaaaaattagctgggcttcgtggcgggtactggtagtaccagctactcgagaggctgagtcaggagaattgcttgaaccctggaggcggaggttgcagtgagccgagatcgcgccactgcactctagcctgggtgacagagtgagactccatcacgcacacgcacgcacgaaagtgaatggcacctccctcttgtttgttcttctggccatgtgacatgcccttcacctcccaccatcattttaaccttcctcaggtttcccgagagggtgaacagacgtcagcgccatgtttcctataaagcctgcaaaattgtgagtcaattaaacctctttatacattacctagcctcaggtatttctgtctagccatgcaattatggcctaatatatttacacatggagtgaatatagctaagttttttttttttttttttttttttttttttttttttggagacggagtctcgctctgtcgcccaggcgggactgcggactgcagtggcgcaatctcggctcactgcaagctctgcttcctgggttcacgccattctcctgcctcagcctcccgagtagctgggactacaggcgctcgccaccgcgcccggctaattttttttgtatttttagtagagacggggtttcaccttgttagccaggatggtctcgatctcctgacctcatgatccacccgcctcggcctcccaaagtgctgggattacaggcgtgagccactgcgcccggccagaatatagctaagttttaagcaagtgttcactaggcataagaatatacatcctggagagaaatcacagaagtgtagtatatgtggcaagaatactacttaaaggtcaaaacttgtggatctataactcaaagtgcagatatgctttacaaatgaaatgagggtggcagaagcttcaccagagttcagtcactacttgagagtttatattggaaagaaatcgtataaatgtatgtgctagaggcttccccgaggtgtctgaactcactagacctcagaatatacatctttgacaaatgtaatgtgtgtgctaagactttttacccgaacatccaaatggaaacatcagagtattcatactggagaacagtcttacaaatgtaacgaatgtggtaagcctttttaaaaatcaaatgggctgggtatggtggctcacacctgtaatcccagcactttgggaggccgaggtgggtggatcatctgatgtcaggagtttgagaccggcctggccagcatggtgaaaccccatctctactaaaaaatacaaaaattagctgggcagtggtgggcacctgtaatcccgctacttgggaggctgaggcagaagaatcacttgaatccaggatgtggaggttgctgtaagccgagattgcgccattgtactccagcctgggtgacaagagtgagactctgtctcaaaaaaataaaaaaatcaaatgttcatgtttttggagtttgagagaatttatacaggaaaaaagtcatatcagtgtgcttaacatggaaggacctttaatcagtagtgtgtcttcaggctttaccaaattattcatactggatagaaaccttgcaaatgtaattaacgtggtaaaattttaaaccatttctcagccagatgcggtggctcacgcctgtaatcccagcactttgggaggccgaggcaggcagatcacgaggtcaggaaatcgagaccatcctggctaacacggtgaaaccccgtctctactaaaaatacaaataattagccaggcgtggtggcacgtgcctgcagtcccagctacttaggaggctgaggcatgagaattgtttgaacccgggaggctgagcttgcagtgagccgagattgcaccactgcactccagcctgggcgacagagcaagactccgtctcaaaaaaaaaaaaaaaaaaaaaatttctcaacagattccatgttaggtaaatcatactatggataactaagtctgcttctccatccaggattgacctggaatgatacatacggtaaaataaccacaagacaaaatttgttaaaaccccaggtaatatgtacatcaaaggatcaagagcgtgtgtggaaatggccaattcagtatataaaataattgtattcactttgacatttcttaaaaaggctagttgactatttgtgaccttcatcctaaagtatgaagtcttgcctttcctacacatctttcattgtggtctctgggaataaatcagtaaggtgagagggcctgcttcattaggtgtggttccttcatatccatgttttctggargattaaggtcactgtactgtgtgagttaagcagcatggaatatggtggagaatgatgtaaatttacaatgtaagtcactgagcttgttgtgttcagagtgtcctttgacaaatacagtgttgctttgggatatgggaaacatacggagtatgtttcactaacctaaaaatctgtgctccacctagatttgtacattcttttcacttctgtcacttgttgcttcacatgttttgcagctggttttaagtgcatacagacaagattctcaaatcatctttgtaaattgacattattatcatgtcaccaccctgttgcccaggctggagtgcaatagtaataaggtcaacttttggaacccttctgcaaatttcctaggatttttagagtagcttcctagcttttccttacattgctgtatatcagttatagagaaggggacctgcaataggactggccattcggctcctgctgcttccctacggggtagcaaggctggagggagagtagaatatggtgttccccactgagtgtttgggggacttagtagggtccccagtgtttgctcctggttttagcctcaggagcacttggtaagggggctatagggatggtcrctcttcacccttagagacaagtggctcttgtaaaagggggtcatctggtttggcacggtggctcacgcctgtaatcccagcactttgggaggccgagstgggcagatcacctgaggtcgggagttcgagaccagcctgaccaacatggagaaaccccgtctctactaaaaatacaaaattagatgggcatggtggtgtgtgcctgtaatcccagccacctgggaggctgaggcaggagaattgcttgaacctgggaggtggaggttgcagtgagcggagatcaagccattgcactccagcctgggcgatgagagcaaaactctgtctcaaaaaagaaaaagtaagagtgggggggatcatctataatatctaattctaccttagaactttcctttggtggtgggggtgggttctgggagtttgacagattgytaggttttggtataaggtcataaaatcctgtgcatatgggatttctgaccatttgccctgcctcttgcaaaataggtctaatggcaggatggtgtcataattaaggctaccaagactgcccattgttccaggctgggcagttcataatgggggcagacaatagtgcaaaaaaaattttacattttatctttagagtgtcagggtcaaattgatttccatggttgaggatgtagccaagtgtggaatcaggtggaataggtggagagttgcccatagtggtttggaaaagagaagaggactttgaaaagtggagggctcattaggtgacccaaattttacctggggcatcccccctttagggccccaacttagtctgtcagacatctctgaccttagatgggtgctggcaccactttggaatggttccctccatcactgaggacctgacttaaagtttttctatctcacttaaaacaaccctttaacgctctcaacttaggcaataataaattccttttcatgaattccctccaccaccatgcaccacacagaccacatgcccggaccctctgacttgtgtaaccttttgtgcatagctaggtgggttttctgtcctttgccagttgggtgggagaagggaagaatttagcataaataaaagcagcataagtcacctgaaacctgtgagtttgccctggacgagctgctgctgctaactgcatcacacatagggatcagggattataactgaaaaggacagaaatgagtcttttccctttctgggcagggcagccatccctgttcactccttggccttcagaggataccagagagtggccccagtcagttcccctcaattaccaacgagctactaggaaacggccgctgaaagactgaaaaaggagaaaaggaaaataactcagaaaaaaaaaaaaaggaataggactcagaaaaacaaaaacgaggaaaaggactcaggttcctcaccttaaccaagcggtggcagttaggcacttccacacggaaaccttccagtttcaccagagaatggccctggccagaaacttgcaagtgtctttgtgcttaggtgctgtccactgagggtcctcagttggaaaggaaaagatggagagaggaagatttccctgtatgtaaaaggggaaaggagaaaaagaaatcccaaactttgggcctaccttctctcctggctagctcaccagaatatgttaccagtagagggtcttgactgcaagttgtttaggttcttggcattttgaacaaagacttggaagaaacacccagcaaagcaatgaaagaatgcagcatcaaaagaatgaaaacaggaatttattgaaaatgaaagtacactccacagtgtgggaacaggcccaagcagtggcccagatacagaatcttcttgggtccaaatgactactagaggtttcccgttggctgcttggtgctgacctaatgtaaatgaaatggtggcctgcagtcagtcaaccaatcagaggctgaagtaaagttacaaaagtcacactcctacgcaaatatctgattggttgcaaaaagcaaccaatcagaggtacttttaatttcccatctgccaggcagaaaaggtagaggtttgcaaagggagtagtctctggtccttttgttacttaggtgtggaaagttagggttttcccatcaatttagcttaaggacgttagcgtgaaacagccttaggtttcctgcctccagaccatgttctcctgcctcaggatcacaggctcacgccaccatgcctggctaatttttgtattttttgtagagatgaggtttcgtcatgttgcccagactgggagaaatatattttaaggtataattagcatgttgtgttttaaaaatcctgttgatatacttgcacattagtaacagagcttttgcttccacattgtacaatttcagttcagtatcttgtatcattctaattatttcactgaacttaaaatgtaagggaccttctacatattgatagaacacatgctttgcatctgtcatttctctgtgtgtgtgtgtgtgtgtgkatatatatatatatatatatatttttttttttttttttttttagacagagtctcgctctgtcgcccaggctggagtgcagcggcgcgatctcagctcacttcaagctccacctctcgggttcttgccattctcctgcctcagcctcccaagtcgctgggactataggcgcccaccaccacgcctggctaattttttttgtatttttagtagagacagggtttcaccatgttagccaggatggtctcgatctcttcgtgctctgcccacctcggcctcccaaagtgctgggattacaggtgtgagccaccgctcccagcctctctgtacaaattttttgccacacaaatctgaaaataccaccttgatttatggatcctccaagtttttcactgaagtacaagggaacaaatgtaaatctataaattgggttaaatgatttctaggaaagtgtataataataataacaattatttttttgagacagagtctctgtcacccaggctggagtgaaactgtgtctcaaaataaataaataaataataaataaataaataatagaaatgaagttttgctatagttgagaaattatagaatgccatgcttattatgataacctcatacagaaatttttacagctttttgaaaaatggcttttttgttattcaatttttatagtcttataaacattaattttcacaagactagtgtaaaaatattgtagacaatttgtctaagcagtatttcggaagcactttcaacagttatgtaaagggtcctatttatgcttgaagaaaggacatgtataaggtttttagcatgaggaaattaagtctttctcaacctagaagtcaggagtttcaagagtaaacattcagtgttgaattaaagaatctgaatctattttttgattgattactgacatcttttaagccacactatttgggcaagttgataataaagcctgagtgctcccttctttggtatatgctggaagttcaagacatgcctgggtacctttacccttgccctactccttaaccatagtcacaacacattttcctgctctcacaagccacttttgaaccagcttgggaagtctcctgctctttccagagtctcattatgtaacaaatattctcatgatacttcactatgtgacgtcatcagtcccagcatccaaatcaaagtgtgggtggggttccactctgttctagtggagtggccacagtgctaattaacaaaatatgctttgggttgaatatataaagtttctactttactcaccctgcagaataccccactatgtatgtttattcttcagagggaacattaatcttgttttcttttttttttttttgagacgaagtcttgctgtgtggcccagggctggagtgcagtggcatgatctcggttcactgtaacctctgcctaccgggttcaagcgattcttatgcctcagcctcttgagtagttgagattacaagtgtgtacaggtgtgcaccaccacatctggctaaattttgtatttttagtagagaccacgttttgccatgttggccatgatggtcttgaactactgaccccagttgatccacctgcctcagcctcccaaagtgctgggattacagacatgagccacaaccctggcccattaatcttttattttttaattttttttattatactttaagttctagggtacatgtgcacaaygtacaggtttgttacatatgtatacatttgccatgttggtgtgctgcacccactaactcrtcatttacattaggtatctttcctaatgctatccctccccactcccctcaccccacgacaggccctggtatgtgatgttctccaccctgtgtccaagtgttctcattgttcagttctcacttacgagtgagaacctgtggtgtttggctttctgtccttgtgatagtttgttcagaatgatggtttccagcttcatccatgtccctacaaaggatatgaactcatcctttcttatggctgcatagtattccatggtgtatatgtgccacattttcttaatccagtctaycattgatggacrtttgggttggttccaagtctttgctattgtgaatagtgccgcgataaacatacatggacatgtgtctttatagcagcatgatttataatcctttgggtatatacccagtaatgggatggctgggtcaagtggtatttctagttctagatccttgaggaatcgccacactgtcttccacaatggttgaactagtttacagtcccacaaacagtgtaaaagtgttcatatttctccacatcctctccagcacctgttgtttcctgactttttaatgatcaccattttaactggtgtgagatggtatctcgttgttattgggggaacctgcccccaatatttcaatgtagtttctttctattttccataagtgtcagccggctgagaaataaagacaatacaaagagaggaattttacagctgggcctccaggggtgacatcacatatcggtaggactgtgatgcccgcctgagtctcagaccagtaagttttttttttaagggtttcaaaaggggagggggtgtaagaacagagagtaggtacaaagatcacatgcttcaaagagcaaaaagcagaaccactgataagggtctaacaaagattacatctttctgagggaaaagggcaaagggcaaaagtagaaccactgatatgggtccaacaaagatcacagggcaaagggcaaaagcagaaccactgttaacacaattatcacagtggtcctgaggtgacgtacatcctcagcttatgaagataacaggattaagatattacagtaaagacaggcataagaaattataaaagtattatttgagaactgataaatgtccatattaaagtgaaatcttcacaatttatgttcctttgccgcagctccatctggtctctctgtttggggtccctgccttcctgtaacacattgtggttttgatttgcatttctctgatggccagtgatgatgagcattttttcatgtgtctgttggctgcataaatgtcttcttttgagaagggtctgttcatatccttcacccactttttgatagggttgtttgattttttcttgtaaatttgtttaagttctttgtagattctagatattagccctttgtcagatgggtaggttgtaaaaattttctcccattctgtaggttgcctgttcactctgatggtagtctcttttactgtgcagaagctctttagtttaattagatcccatttgtcaattttggcttttgttgccattgcttttggtgttttagtcatgaagtccatgcccatgcctgtggcctgaatggtattgcctaggtttttttctagggtttttatggttttaggtctaacatttaagtctttaatccatcttgaattaatttttgtataaggtgtaaggaagggatccagtttcagctttctatatatggctagccagttttcccagcaccatttattaaataggaaatcctttccccatttcttgtttttgtcatgtttgtcaaagatcagatggttgtacatgtgtggtactatttctgggggctctgttctgttccattggtctatatctctgttttggtaccagtatcgtgctcttttggttactgtagccttgtagtatagtttgaagtcaggtagcgtgatgcctccagctttgttcttttggcttaggattgtcttggcaatatgggctcttttttggttccatatgaactttaaagtagttttttccaattctgtgaagaaagtcattggtagcttgatggggatggtattgaatctataaattactttgggcagtatggccattttcacgatcttgattcttcctatccatgagcatggaatgttcttccatttgtttgtgtcctcttttatttcgttgagcagtggtttgtagttctccttgaagaggtccttcacatcccttataagttggattcctaggtattttattctctttgtaacaattatgaatgagagttcactcatgatttggctgtttgtctgttgttggtgtataggaatgcttgtgatttttcacattgattttgtatcctgagacattgctgaagttgcttatcagcttaaggagattttgggctgagacgatgggatttctaaatatacaatcttgtcatctgcaaacagggacaatttgacttcctcttttcctaattgaataccctttatttctttctcctgcttgattgtcctggccagaacttccaacactatgttgaataggagtggtgagagagggcatccctgtcttgtgccagttttcaaagggaatgcttccagtttttgcccattcagtatgatattggctgtgggtttgtcataagtagctcttattattttgagatacatcccatcaatacctagtttattgagagtttttagcatgaagtgctgttgaattttgtcgaatgccttttttgcatctattgagataatcatgtggtttttgccttttgttctgtttatgtgatggattatgtttattgatttgtgtatgttgaaccagccttgcatcccagggatgacaccaacttgatcttggtggataagctttttgatgtattgctggatttgatttgccagtattttattgaggatttttgcatcgatgttcatcagggatattggtttaaaattctatttttatgttgtgtctctgccagcctttggtatcaggatgatgctggcctcataaaatgagttagggaggattccctctttttctatttattggaatagtttcagaaggaatggtaccagctcttctttgtacctctggtagaattcagctgtaaatctgtctggtcctggactttttttggttggtaggctattaattattgcctcaatttcagagcctgttattggtctattcagggattcaacttcttcctggtttagtcttgggagggtgtatgtgtccaggaatttatccatttcttctaggttttctagtttatttgcgtagaggtgtttatagtattctctgatggtagtttgtatttctggrgatcggtggtgatatcccctttatcattttttattgtgtctatttgattcttctctcttttcttctttattagttttgctagcagtctatcaattttgttgatcttttcaaaaaccagctcctggattcattgattttttgaagtgttttttatgtctgtatctccgtcagttctgctctgatcttagttatttcttgccttctgctagcttttgaatgtgtttgctcttgcttctcyagttcttttaattgtgatgttagggtgtcaattttagatcttttctgctttctcttgtgggcatttagtgctataaatttccctctatacactgctttaactgtgtcaagagattctggtatgttgtgtctttgttctcattggtttcaaagaacatctttatttctgccttcatttcgttatgtacccagtagtcattcaggagcaggttgttcagtttccatgtagttgagcggttttgagtgagtttcttaatcctgagctctagtttgattgcactgtggtctgagagacagtttgttataagttctgttcttttacatttgctgaggagtgcttaacttccaactatgtggtcaattttggaataagtgcaatgtggtgctaggaaaaatgtatattctgttgatttgaggtggagagttcggtagatgtctattaggtccacttggtgcagagctgagttcaattcctggatatccttgttatctttctgtctcgttgatctgtctaatgtttacagtggcaagttaaagtctcccattattattgtgtgggagtctaagtctctttataggtctctaaggacttgctttatgaatctgggtgctccagtattgggtgcatatatatttaggatagttagctcttcttgttgaattgatccctttaccattatgtaatggccttctttgtctcttttgatctttgttggtttaaagtctgttttctcagagactaggattgcaacccctgcttttttttgttttccatttgcttggtagatcttcctccatccctttttttttttttgagcatatgtgtgtgtctgcaygtgagatgggtctcctgaatacagcacactgatgggtcctgactctatccaatttgccagtctgtgtcttttaattggagcatttagcccatttacatttaaggttaatattgttatgtgtgaatttgatcctgtcattatgatgttagctggttattttgctcgttagttgatgtggtttcttcctagcatctatggtctttataatttggcatgtttttgtggtggctggtaccggtcgttcctttccatgtttagtgcttccttcaggagctcttgtaaggcaggcctggtggtgacaaaatctctcagcatttgcttgtctgtaaagaattttatttttccttcatataggaagcttagtttggctggatatgaaattctaggatgaaagttcttttctttaagaatgttgaatattggcccccactctcttctggcttgtagggtttctgctgagagatctgctgttagtcacatgggcttccctttgtgggtaagccgacctttctctctggctgcctgaagggggccaccccctccacagcctgtgggtgtttctcgtcaggtgggacgagagaccaggaaaagaaataagagacagagacaaagtatagagaaagaaaagggggccccagggactggcgctctgcatatggaggacctgcgcagctggccctggtctctgagttccctcagtatttattgatcattatctctaccatctcggagagggggatgtggcaggacaatagggtaatagtggggagagggtcagcaggagaacatgtgaacaaaggtctctgtgtcataaataagtttaaggaaagctgctgtgccttgatgtgcacgagcacaaacatttcggtgcaataaagagcagtattgctgccagcatgtctcacctgcagccctaaggtggttttctcctatctcagtaaacagaacatacartcaggttttacaccgagacattctattcccagggatgagcaggagacagatgccttcctcttatctcaactgcaaagaggcyttcctcttttactgatcctcctcagcacagaccctttatgggtgttgggctgggggacagtcaggtctttcccttcccatgaggccatatctcaggctatcacatggggagaaacctggggcaatacctggctttcctaggcagaggtccctgtgggcttgtgcagtgtattgtgtctctgggtacttgagattggagaatggtgatgacttttaccaagcatactgccttcaagcactttttaaacaaagcacatcctgcgcagccctaaaaccattaaaccttctgtcaacacaacacatgtctctgcaagcactgggttggagctagggttacagattaacagcatctcaaggcagaagaatttctcttagtatagaacaaaatggagtctcttttgtctacttctttctacatagacaagttaacagtctgatctctctttcttttccccacagctgcccttattattttttccttcatttcaactttgatgaattcaaacaggatacaatttggggaatatatgcttataatttgcacttgagctattctgtccgagtatgccccaggacattttatggaaataccatgcagtgcaatttcagactctgagcatctaaaaacctgcctcagtatgcatgaatattcactatatgattatagttctacatgcctttgtatgtataagatccatggcttgcatttgccttgatttttatgtgtggtaaaaataaaaatatagcaagtgtatacaaatattaggaaatgggccaggtgttggagctcattcctgtaatcccagcactttcggaggccaaggcaggtggatcacatgagttcagaagtttgagaccagcatgaacaacatggtgaaaccatgtctgtactaaaaatacaaaaattagctgggtgtggtggtacacctgtaatcccagctatttgggaggctgaggcagaagaattgcttgaacccgggagacagagtttgcagygagctgagattgcaccactgcgcaccaacctgggtgacagagtgagatgcagtctaaaaaaaaacttattaaaaaaatatattatatatatggaaataaacaataattaggaaataagaatttcttatttgtgcttagaatacacagtgaagtaaacagaaaaaaagaacaacaacaaaaaagaatacatagtgaagtaatttgaaaagattaaatgttaagacaggcatggtggcttatgcctgtaatcctggcaytttggaaggtcgaggtgggaggattgcttgagcycaaaagttcaagaccagcctgggcaacatgatgaaacatcatctccacaaaacatacaaatatcagctctgttatatatgaaataaacagagttttccaaagatcttttataagatgggagaaaggagatgaaatagaagagagattgacttggtccttcaggattggaatctgatagatgggacactagaggaagtttaatgtaatctttttggctatctagatctagtttttaggccctggctagaagccagttagttcctcttctagaatggccaattaagtctacaatgccggccacagtgagcttgtggtatttagcttgccctaatcctatccccatatcctcagcttcaaggtagccttgaaaagcaaccaccttttaacaacagtaacagtgaatatctgcaccctagcagaatatctgcacttgaggaggtagaaatggctctgaaaatggcagaaatggctctgaaacacccaaaagcctccatccccacagaatgttcactactaagcctgctttgcagcctgctgaataggtctattctcatagtatttctctatttggcttgactttatttatgtgaacactcctacccatagggcacttgtcaaaaaacaatcagcagcaattgtttaacactagagtgtttaggggagtgacagtgtgtgtctgcgtgatagatggaagtaataagagggcacaggggaaaggggccatacgcataagatgatggaacagagagcctggagggtggggtatagagagtgtaggggaagggagaaggcagacaggtaaaaggaaaaagaatgttaagtgttgttcagcctcaagactgacatgatgaaagtacctttattgtggtttttgtaaattagaatgcatgctttattattaaaaaaaacacaattgaaaatgttaaggaccttttcctccttgcttcttataagaaaccatcataagacataacttgtaataattctgtagaaatatacatatataaagatatatgtatatatatattttaaaatagtatgtttttattgcaaaatattcattagtgtcatcatatcatagccagatctacaaccccagagtaattcccatggttatgttacatggcaaaaaggactctgcattgtrattaagtttattaatcagctgactttagcattgggagattattctggattgcccaagcacttaagaataggagaaaccggagagatgcagcagcaatagtcagtggtttcaaatatgaaagggatttcacatactattgttggctttaaagataggaagtcgtgggggcaaggaaactctctaaaggaaattaatctggcaacaacctaaataattmtagaaaaggattcttttccagartcaagaacagagccaggtggttcttctcttctaaagacatttccatgggccagttccaccgcaagcttctcagagagaatatgttctgcsgtacggacaccgaacgtcccctaagatggccgcccccatgatgctctcccctaagggctctggctccgttacctgcaacgcaccgctcgcttattttttgttctagtctctcttgcttcagtttttatacggcttctaaaacgcttcgcatttacaatagtgactgaggtgcccagaggtgactttaattttccattgagctgagacgtcacagccatcataaccgctaagaagggatgccgcgcctttgtggtaataatgggttctggcctttgagaagtttgcgccgttcactgtcccctgcgaggagaagactaacttatttctgttccgtgtctgttcagaggactttacccccacgccgtgtctgcctgtgtgaactcaagcctctgataagctctccattttctgccagggctgaggtgtctggaaatcggacagtttaagaggcctccgtccaccgcgtctcccggccgctgtgccttctgtacgtcacgtactcaaagatggccgcccccagagcggcgaggcgacgccggcgcggacgcgtctcctcctgaggaaaagccggaaggccgcattccgctctccatggaaacgcggctgaccgtctctggaggtttagagggggagggagttgggcgaggrgcccagaagtggaagaagtttagggaagtaagttcagcttttaagaggtcgcggcgattccmaggagagtcaggtcagtgtgtgggtcagggcgtggaaacgtggtgggagggagctttctgagggcgtctgcgttgttggtggcgctatatggtggaggtagcgcgggggttgggggaggcgggggcgggtgtttccttttggaggggagctggtaggagtccctggtgggtgtctgtgataggatatctttggggtccctcatggaggctctggtggtcagtgattaaaggcctgaatagatcaacgaccaagagtactgaggtcagggattgtggtcctcgcgggtcactccccagtggggctcagtgattgagaatcgatggggtggcttttgtcaacgaatgtgacttctgtttcacattctggattaatctgaggcttagtgattgatgaatcattaagggaatccagtgtacgtgtgtgtctattccaggttttcctattttatctggcggggtgrtggtcttttgtstagagacaagtgaaagccgaagtcttttcacaagagccctggctggttttgtgtgtgtgtgtgtgtgtgtgtgtgtgtgtgtgtgtgtgtgtgtgtgtgtgtgttgagctcaaactttggctggaacagacttgatgaacgttaacatttcctaaaagtttcaggtccgagtacctcctccacaatgagttttctaatcctctggctttccacaacaacccatgctcttgaacctgcagaaaatgaaagttttttgggggtgaaggggggcggatgaataggctttctatttaacattatgtttttaaattactgcgcacaaattaacaagagcctatttttatccttcctcttgcaaatgtactgcatatttttatgggtgtttcaggttttgtatgttagtatataaaggcggctattttcccagtatttatatttttgaattgttttctaaatttgtatttataactcgtattccttttctctgtctccctctttttttctatgtgtttcttgttcttcatattgaagtgtgtatataaacaytttttttttttttttgagatggagtcttgcttttgtcgcccaggcttgagtgcaatggctgggctcactgcaaacttcgcctcctgcgttcaagccattctcctgcctcagtctccgagtagctgggattacaggtgcctgccaccatgcctggctaattttttctatttttagtagagacagtgtttcaccatgttgacaaggctggtctcgaactcctgacctcaggtgatctgcccatctcggcctcccaaagtgctgggattacaggtgtaagccatcatgcctggccgtatataaacacttttaaatatatataaagacttttaaagaggtgtgagagtaacattgtataaaggaaaaaatgtagtttctcaccatccatatggcctgatttaaaaaactgatatgagaattacctactgcttaggcatgatgctatgtggattctcctttgtgacctcccctttcatcttcatgttacttccacacttcaccgaagaaaggcatttggcctacattgagggtcttgtgtttccttggtttgagagaaccaaataaagagacaaatattcagggccacgtgttaaggtgaatgtacccctgaaagttgttttgctcttcagtccacaggtcctggctaccctgggaagagacaagaagtaaatgaagaaagaggaagattccaggacctagatatgatttctgtggacacccttcactggtgactgaagtttstaaatagaaatttaaggcagatccagaggagacaaagacagagtatcccaggtgctggccatttcccacaacagaagaaaatgatcaatgcccaggtgactttttctctattttattctctcctttattccatagtggatttgtagagacccrtaagaaatcatttcagaatctagagagaaataaactttaaatctaactccaacatcatggcaaagtaagatcaggaatatagtgtttatgtgattcctacaaaatgactgatgttggaaaataatgcctgactagaagatcctttccattaccttagctctcagtttgcatctgatgtctctgacagccagtacaagaaagtcacactaagttatacagtgactgtggggagaaagcagacaggttcctcaggagattattatttcatggcacttagatctcaagaaaaatttgctattcttcccagagktgatatggtgaacagtgttttgaactagctttctaataaaggcagaagatttcttactgctgtttattacacggttcctcagagactcctatggaaatagaccaggcaaactcagtggaaacagtttttttaggggacgaaagcaaggccacacactcaagtcttgcgtgtctgtgtgagcttatttaggaataaaatctaagtgacctaggaaaatggaaggtgtgcatagcttccattttcctgaacatgtggctgaactggcattaactgcagatttggcattagggagttgtctgataaggtcttgagtcgttgggtgccatgtttgataacttcacctcatctcagaatatacaatatccttctgcattttcacctccaattcttgcatacttatattgcttttattttttgtaattacataaattactcatggaatccaaagggaaaaaattctttttttttttttttttttggtttttgttttttgagatggaatctcactctgttgcccaagccggagtgcagtgcgtgatcttggcttactgcaacctccacgtcctgggttcaagggattcttctgcctcagcttcctgagtagctgggattacaggtgtgcacttgcatgcctggctagtttttgtatttttagtagagatggggttttgccatcttggccaggctggtctcgaactcctgacctcaggtgatccacccgcctcggcctcccaaagtgctgggattacaggcgtgagccactgcacctggcctcacagggaaataaattctgatgatgaagtacacactggttaaaaaagtaaatttccgggccgggcacagtggctcacgcctgtaatcccagcacttttggaggccaaccaggcgggtcacctgaggtcgggagttcaagaccagcctgaccaacatggagaaaccgtatctctactaaaaacacaaaattaactgggtgtggtggcgcatgcctgtaatcccagctactcaggagactgagacaggagaatcgcttgaatccgggaggtggaggttgtggtgagccgagatcatgccattgcactccagcctgggcaacaagagcgaaactccgtctcgaaaaaaaaaaaaaaaaaaaaggtaaaaaaagtaaaagtagattccctcttcataactttcttcctaatcctcttatactgcttcaacaaatgtttggtagcacatacttgctgtcactgaaatgtgtgcatctctgtatatatgtgtatttataaatccatgtgttttatgtatgtgtctgcatatataaacacatttattatgacttcttttgcttcagtggaatcacattccacctgttggtcaccttagatcaagcttgtayaacctgtggcctgtgggctgcatgcagctcaggatggctttgaatgtggcccaacacaaatttgtaaattttcttataatgagaattttttgcatttttttccagctatcgttagtgttagtgtattttatgcatggcccaacgcatttcttcttccagtgtggcccagggaagccaaaagattggacacccctaccttaggtggtgtagttttagaatataaaggaataatcactgcaattaattgaagaatattgactgtataaaattccatttgtctaaagtcatacatgaaaacattgttaaactatgtaaagtatttagatgagtgcctgccacatagaaactgatacatggagtcctttgtgccttaaatctttgccaatacttaaaaatatgacattatcaaattatacaattttcaatgatccaatattcttttgtcttattttgcattttcctcatcacaggtgaggttgaaagccttcttgtgtatttcttggccaactggatttttttctcttgtgaaatgcctgactttatgatttttacattaaaaaaacttttttcttactggctaatgagttgcttatatctactatatattgatcttttgtttattgcaaagttttttttagcctgtcatttttctttcagctttgtttatgatctgtttttcaatgtagaaattaaattttttttctcataaaatttgtcccttttttttcctttatggcttttaacatgaatatatttcgtatttgcttctgcttccacaggtkcttttgctttctggtaaggactttaaamaggaaaaacttatttttgagtatgaaattaggtagaaacctacattttttttcaaacagatttatttctcgtgtgaaataattcccgaatgtgatgagatcagcagcattaagaatttgcagactycagcaagtctgttcttttctctgtgtattaatctctgtgattatatggggatagattatcccatcaatttgtgaaggggtgggttgcccctccacrcttgtgggtgtttctcgtaaggtggaacgagagacttggaaaagaaaaagacacagagacaaagtatagagaaagaaataaggggacccggggaaccagcgttcagcatatggaggatcccgccagcctctgagttcccttagtatttattgatcattcatgggtgtttctccgagagggggatgtggcagggtcacaagacaatagtggggagagggtcagcagacaaacacgtgaacaaaggtctttgcatcatagacaaggtaaaggattaagtgctgtgcttttagatacgcatacacataaacatctcartgctttacaaagcagtattgctgcccgmatgtcccacctccagccctaaggcggttttcccctatctcagtagatggagcatacaatcgggttttataccgagacattccattgcccagggacgggcaggagacagatgccttcctcttgtctcaactgcaagaggcatgccttcctcttatactaatcctcctcagcacagaccctttacgggtgtcgggctgggggacggtcaggtctttcccttcccacgaggccatatttcagactatcacatggggagaaaccttggacaatacctggctttcctaggcagaggtccctgcggccttccgcagtgtttgtgtccctgggtacttgagattagggagtggtgatgactcttaaggagcatgctgcctttaagcatctgtttaacaaagcacatcttgcacygcccttaatccatttaaccctgagtttgacacagcacatgtttccgagagcacggggttgggggtaaggtcatagattaacagaatctcaaggcagaagaatttttcttagtacagaacaaaatggagtctcctatgtctacttctttctgtacagacacagtaacaatctgatctctcttgcttttccccacaaatttgcacctagctctttcctgcctcaagttcctactaccatgtgattataagtcatgttgagacaggagagtggcagtttagttgacaagagggtctcaatttattttccagtggcattcagggctaggccataccatacaatttgccaattgccacagaatcaggacattgaagacattattctgcacttttcttgcttcttttgtttctgtggaagtcagttgttaggacattttatttttcttttgatggtaatgcatcttttccttctattaacagttgtttgcataatgttatatgtgcatctgatgttcaatagtttcagtctgatgtgtctagatgcagattttctgcttggctttgttgatttattaaatttgagttataggatatttaatcagttctgaaaatttctcagtcagatatttggaaattgcttctcttatttgaatataatatttcaaaaactatgtataggcatatgttaggcctcactctgtcttccatatttagtaaagtctccttcatactttctgtcactttgtgtctctgcttcatttttcagttattttaattttttgagatagggtctcactctgtcacccaggctggagtacagtggcatgatcacagctcactgcagcctcaacttcctgggctccagcaatcctcccacctcaccctcccaagtagctgggatcacaggtgtgtgccaccgcacctggttaatttttgtctttttggtagagataggatttcaccatgtttcccaggctggtcttgaactcctgagctcaagctatccgcctgcctcagcctcccaaagtgctgggattacaggtgtgagccaccacacctggccctgttattttttttactgtgaattccaactcactaattatctcttcagtgtatttaatataacctttctgttaatagacacatatacctgtgactgtatacgtatatatacataaacatatatttatatgtatgtgtgcatacatatatatttaatgtatgtttccaagaataagttttcccaatttggttactctttaatagtttctcatgttttctgtacatttctattttttaatccatttaacaattaaacatgaatgtagtatcctgtggttctagcatctgaagtctctctatgtcttatgctagtattagctgggaaggcttaacagtgaatgaaacaatttatatcagatatctagatgtcagtagcatatactttcttgactggtcaatagataccaaaattaaaatttatacataaaacccgcttttactgagaggatttgatataaaaccttaatttttgttgagcaaatggggcactgtgcaattatagaatacttggagattctctggcaatattaaaaaatacaatagacttatagatggatgcagtctatatgtttaatgtgagcgggacaacttcccttcactttcttttcatgtcagtaaaagagaaacacttcctattaagcaaggctctgttttcttacaggaattgctgacactggaggatgttactgtggagttcacctgggaggagtggcagctcctgggcccttttcagaaggatttgtaccgggatgtgatgttggagatctacagcaacctgctatcaatgggtgaggacagctgctctgtgtcacctggagggtgcccagtctgtggcctttgctttctcagttgcttacccttggaagttactgcagtgctctgaatattagatttttggcacatcctctggyttctgataaaaggatataccgtcacccctcagtgtccaagagggattggtttcacaactttccatggatatgaaatccacagatgctcaagtctcatataaaatggcattgtatttgcatataacctacacacacctcctcctgaatactttaaatcatctccaaattatgcctgatacttaatacaatgtaaatgctatgtacatagttgttatactatatgttttaattwatttatttatttattttttctttagagacagtgtctcggtctttcactcaggctggaatgtagtggtgccttcatggctcgctgcagccttgaactgggttcaagtgttcctcctgcctcagcctcctgaggaactatgcctacaggtgcaaaccaccatgcttggctaatttttttttttttttgtagagatggagtctatgttgcccaggctggtctcccactcctggcttyaaatgttggtttcatgtcagcctcccatagtgctcggattataggcaagagccactgcactttgtatttttttttattattgkattttttattgttttttaaaaaatattttcaatccatggttggttgaatccctggatgtgaaattttcagatattaaggtctgactgtaatctgccctttcctgagagagaagcctctactttcagatgtgaaaactgtctagttacttaaatgtaacattctctcacattacataccccagcccaatccagtgtgtctgtcttctattatttcccgtaaacaggttatcaagtcagcaaaccagatgcactctccaagttggaacgaggagaagaaccatggacaatggaagatgaaaggcacagtcgaatctgtccaggtatgtgagaagcagcaagatgcgtaagtaatattatagtcagtgaaagaaggctctgtgggtgtctgaggacacagaagcagtgcctacattaggaatgggaatcgttttccctccacaagaaacccttcccatcttattttaaggttgcattctcctttagtaccatacatctgtcctgtctgtgctggtgttgtattgaatgtcctctacctatggagttctcttcttaaaagtctctactatttttgtttactgtttacctagaaaggactgttttatgtcctacatcagttctagaccaaaccaggtcataacttatgtctgtctcagagtacttcctttgtacatttgatttctacttttcctttagttcatcttagacggtagcattgtattcatttccctaatgtgtttttcccattatagatttgttttttcaacagcttagataatttacataccatacaattttccaatttaaagtttatttttcagtgctttgtagtgtatgaacagttatgtaaccatcaccatagtcaattttggaagattttcaaagtatcacttaaaaaaaaaaattgtttccaagcccccagccctaggcaatcactaatctactttctttttcttttcttttcttttttttttttttttttgagatggagtctcactctgtcacccaggctggagtgcaatggtgtgatctcggctcactgcaacctccacctcccgggttcaagcgattctcctgcctcaggctcccaagtagctgggattacaggcgcgcaccatcatgcccagctaatttgtgtttttgtagagacagggtttcaccatgttggccagtttggtctcgtactcctgacctcgtgacccacctgcctcggcctcccaaagtgctgggattacaggtgtgagccaccgtgcctggcctctactttttatccctatagatttgcctgttctggacattttatataaatagaatcatgaaatatatggtcttttgtgtccggcttctttcatttagcataatgtttttgaaattcttccattctttagcatgtatcagtgcttaatttctttttattgttgaataatattccattgtatggatataccacattttatttatcaattcatctattgcattgacatttgggttatttctactttttggcttttatgaatcatgctgctatgaacgttcatgtacaacttttttaggaacgtatgttttcatttttcttgagccttcacctaggagtagaattgccaggtcatttgtagtccaggagggggtccaagtacagtacttctctggtcctcctctcactgtggatgttacatctcttcccagccacacagtgtgtgacagtacagagtattgacaactagggaagttcacttgagcctttggtggccagagttttgattaggtttcagtcacatacagcccacatggctgacttttagtcttcagcctctcctggaagtcaggctaatacctagagtgtccagtttttccaaaggctggaagtgatatggcatgggccaaagcccctatcacaaatcatattgttaaactgtccagtggctaaagccaccaggcaaacaaagacactcctatgggccaggacattccaggggcctagagatcatttcctaatagctaagaacaaatgctagatctctgtttggatgaggttagagctagatcctcactacacagaagattaccataaaaattaacaataaaggggttaattaaggaatacagagaacatagagcatatggcaggatagtcagaattgcagcaagagtatgatgtgcacaaggcatatctagattttgaattaggaagatggtgacatgaattaagaatgaaggcatgggtcaggtgcggtggctcatgcctgtaatcccagcactttgggaggcctaggtggggggaacacctgaggtcgggagtttgagaccagcctcaccaacatggagaatccccttctctactaaaaatacaaaattagccgggcatggtggcacatgcctgtaatcccagctactcaggaaggctgaggcaggagaattgcttgaacccaggaggcagaggttgtggtgagccaagattgtgccattgcactccagcctgggcaacaagagcacaactccatctcaaaaaaaagaatgaaggcatgaaatagraattgtgcaaggccatgggcctgactatcaaaagattggcttcaagttggccaaatacaggtcagtgatagaagctgcttgttggagaaatcgtggagcagaaacatggtaatattcatggtaatgtaaacttttttttatcaagatgacttttgattgtatatatgagtaattgaggtagcatggttgagggttggttaattttatatttttgtcttttcataaaatatgttgctagtcttgacctttcacttggatgacagcagtgtagcaataataagaaacagctaaatatcttaagaaaaactgaaggtgaagatgccacaacctttgtctagaagaagtttatcctttagtacaacttaactgatgctgagacataaatgtagcttactgaagtagatgttattggtggcagatgaggaaacagtgtatcagggacattgaaatgggaaaaattggatatgacctttttttttttttttttttaaggtagagtctcactttgttgctcaggctggagtgcagtggcacgattttggctcactgcagcctcaacctcctgggctcaagcgatcctcccacctcaacatcccaagtagctgaaactacaggcgcatatcaccatgcatgcctggctaatttttgtattttgtgtttcaccatgttgcccaggctggtctggaactccagagctcaagtgatctgcccaccttgacctcctaaagtgctgggattacaggtgtgagccaccgtgcctggccttgatacgacttttctactgcatgcagaatgtgattgaagaaaatgacagttttcatatcccatgcagcarcamattttcttctgaaggcaactacatggtacactggccagttgcaaaattccctatcattgttttcctgtttcataattaatgaaacatatgataacgcaacacagctaaaccaaagggtggagtgttgactataggagttgttcattaaacgtgatggatgtttttggaaagttagatggtagtctacagattgaagaggggcaaatttagtaacaattaccacacaagagtctatctcagttgacttaatttcaacagatggagatttccaattcttacttgccaggcaacatgtacgtgaatgtatttattctatatatctcagtaagcatattaccctgatctttgtattcacagtttggttcctctaacagggcttaaataatcccaaaaccacatgttggaatgtctacaaccttggttctgtaccttcatctttcattctacatgtcttctcaacatggtatcctggctcagtgccttggctcacacctatagtcccagcactttgggaagcagaggtgggcagatcacttgagcccaagagttcaagaccagcttgggcaatatggcaagactccatctctacaaacaatacaaaaatcaatcaggcatggttgcatgtgcctgtagtcccggctactcaggaggctgaggtgggagaattgcttgagcctgggaggtggaggttgcagtgatgcaagattgtgccactgcatgccagcctgggtgacagtgagaccctgtctcaaaaaaaaaaaagtcattcagtccttttttctcaaataatatgtatgtactgattatttccatgctgccttctccatttatacctccaaccagattcttgatgtctgtgttacatatttgataaccatttcaaagtgtgtttcacagtatatactttacatgtgctggactgcagtaatatttgccatctcattatcagatgctgtcatctacccagtggctcaagccatatagttagtaatctttgagccctcactttcctcactctccccattgaattcatcatttaaccttgtcttttctttatacaaaaatatcctgcttttctccaactctcatcatctacactgctccatcaaaccacacttaacatcaccaactcccttctttttttgttccttcgtattgtttttcctaattagaattcagcatgagtgaaaagaaggcatattttgtrtatcccaaatgccagcagagtgccttgtccataggagtcatttgacaaataactagtggagtgaataaatacaaccctcagaattgtgaatcagttgccttttccacctttgtggtctggtgtctcccaaaattttgtggaatggtgttcctccaagccctgttgtttgcttgtaataatgacttgcttgtattttactgtgtccgcatgttttgcaaggtcctgtttagaaagctgtcaaatygatatagattgtcaactgcctcaccttatttgcacacagactgcttttactttttggtttgtttatattattatgtttttaccaaagtgtatacatgaagttgcttttatactattattgtagtattgtcattaaatagcgatatttaaaaacacctggccaggtgtggtagctcatgcctgtaatcccagcattttgagaggccgacgtaggggtatcactggaggtcaggagttcaagaccagcctggccaacatattgaaaccctgtctctactaaaaatacaaaaattagctaggcatgatggcacatgcctgtaatcccagctacttgggaggctgaggcaggagaattggttgaacccaggaggcggaggttgcagtgagctgagatcataccactgcactccagcctgggtaacagagcgagactctgtctcaaaaaataataataataaacaaaataaaacaccaaggatttttttttctaagaagacagttttatccccaacaagattataaaaggattcattgttctcttctttcctagaaaacaacgaagttgatgatcatctgcaggatcacttggaaaatcaaaggatgctgaagagtgtggaacaataccatgaacataatgcatttggaaatactgcctctcaaaccaaaagcctttgtcttttcagggaaaatcatgatacatttgagttatatataaaaactttgaaatcaaatttaagtttagtcaaccagaacaaaagctgtgaaattaacaactctactaaatttagtggagatgggaaatcatttcttcatggyaactatgaagaactttattctgcagctaaattctctgtaagtacaaaagccaatagcactaaatcccaagtcagtaagcatcagagaactcatgaaatagaaaaaaaccacgtatgcagtgaatgtgggaaagcgtttgtcaagaagtckcagctcactgatcatgagagagttcatacaggagaraaaccttatggatgtactttgtgtgcaaaagtgttctccagaaagtccaggctaaatgaacatcaaagaattcataaaagagagaaatcttttatatgcagtgaatgtggaaaagtcttcactatgaagagccgtctgattgaacatcagcgaactcatactggagagaaaccctacatatgcaatgaatgtggaaaaggcttcccaggcaagcgtaatctcattgtacatcagcgaaatcatactggagagaaatcctatatatgtagtgaatgtggaaaaggcttcactgggaagagcatgcttattatacatcagcgaactcatacaggagagaagccctacatctgtagtgaatgtgggaaaggcttcmccacaaaacactatgtcatcatacatcaacgaaatcatacaggagagaaaccatatatatgcaatgaatgtgggaaaggcttcaccatgaagagccgtatgatcgaacatcaacgaactcatacaggagagaaaccctacatatgcagtgaatgtggaaaaggctttcccaggaagagtaatcttattgtacatcagagaaatcatacagtagagaagtcatatctatgtagtgaatgtggaaaaggttttactgtgaaaagcatgctcatcatacatcagcgaactcatacmggagagaagccctacacatgcagtgaatgtgggaaaggcttccccttgaagagtcggctgattgtacatcagcgaactcatactggagagaaaccttacaggtgcagtgaatgtgggaaaggtttcattgtgaatagcggactgatgttacatcagcgaactcatactggagagaaaccgtacatatgcaatgaatgtggaaaaggttttgcctttaagagcaatcttgttgtacaccagcgaactcatactggagagaaaccctttatgtgcagtgaatgtggaaaaggcttcaccatgaaacgctatctcattgtacatcagcaaattcatacagaagagaaatcttgtatatgtagtgaatgtggaagaggctttgccaaggaaacagagcttgctttacataagcaagttcatactggagaaaaaccttatggatgtaatgaatgtggtaaaggcttcactatgaagagccgtctaattgttcatcaacgaactcatacaggagagaaaccctttgtatgcagtgaatgtagaaaagccttctcctcaaagagaaatctcattgtacatcagcgaactcataatggaaacaaaccctgacaatgcagtggacatgttcatgcctttgggaagaaaatctgccttgtacaacatcagagatttcacagtatagattttctacatgtgtactgagtatgaaaaatcatatttcaaaatccagtgttattcactaggatgaatgctatcaatgtcagaaaggcttcaacatgaattcaggctctgaattctttgatgtaccaatgtatagaaaattactcatctgagagagagtctgtggattgggggtaacctttcatttgtcaaccttcattaaaactatgacaacgtccacatgacaaatgtgtaaggtacatagtccttttgcagagaatctgaactgattacatacaaacaaattcatgcagagagaaaaccacgttagtaatgtgaactgattaaacagcagtgtgctcctagcatacatgcatataggcagtgtagagcagcctgttgctagattttcacccttggaagacaatgcaatttccaggagcgaattttaatgaatgcagagaatgcactagtgccttcggtgattaattacctcatattttatgtcacaataaacatgtaggaaataaacttgatacatccaatgcagaaaagtcttgaaaattttctaagtaactatgtcttgaaaagtatttactgagataaatcttacaaaggagtaggctaggaaagccttctatgggaagaaagaccctatctcttcagtgatcataatagatcatcaatgaacttacacatactagcagcattatcatgggaaagcctttgcccagaaataaaaccttaacagttggcagatatatttcatactggagaacaagtttcagatggcagtgaatacacgaggatttcagtgatacatgctgcctcatcatcattacttcatacagaaataaaacttatatgaagagtaactttaaaaaggatcaggaaattcatgaagtaaaaaagtctcatgaaaatgatacataatgccgggcatggtggcttgcacctgtaatcccagcactttgggaggccaaggtgggtggatcacttgaggtcgggagttcgagaccagcctgaccaacatggtgaagcccccctctctactaaaaatacaaaattagccgagcatggtggctcaygcttgtaatcccagctactctggaggctaarctggagaatcacttgaacctgggaggcagaggtttcagtgagccaagattgcgccattgcattccagcctgggcaacaagagcgaaactctgcctcaaaaaaaaaaaaaaaaaaccatatttgaggactgtcacaaatctaaactcatgatacacttgatatctattctgtgacagcataccttgcatcatattatcaatgattccataattgtaaagcgggctgttcttatcactgattaaattttaatcctatatataacacaggtgttttctgtgccaatctggtgttatttattagttcttacatattataggccccaaatttatttttttcaatttactgataaatgtaattcagtatatttggatgtgtttatccmagttactaggtaccattatgtagtttacaaaaatgccttaaatgttatttttctaaaatttgttttgaaataattctagattcacaagagattacaaaatatacaaaagtttcctgagtattctttgcttagcatcatcaatgttatcttacataaccataataataaaaaccacggagttctgctcttgttgcccaggttggagtgtaatagcacgatcttggctcactgcaaccccgcctcccaggttcaagagattttcctgcctcagcctcctaagtagctgggattacaggcacccacgaccacgctcgactaatttttgtatttttagtagagacggggtttcactgtgttggccaggctggccttgaactctcgaccccgggcggtccacccgcctcagcctcccaaagtgctgggattacaggcatgagccaccacgcctggcctcctcttgctacctctttatactcacactgtcctcccaatatgacccatggtagccactgatcccattaccctaattttgttatttcaagaatgctattaaaatggaatcgtaaggtacgcaagctttgagatagggctttgttcactcagcaaattacccttaagatctatccaagttgttaggtgtctaaatagttttaatttttgttactgagttagtattcttttaaatggatgcaccagggtttgtgtatccattcactgttgatggacatttgggttgtttccagtgttttgctgttataaataaagatgctgtgactatttgtgtacccgatattgtgcgaacgttaagtttttatatatttgggatagacactgggggcatgactgctggcgaatatggtaaatgtgtttaactttataagaaatggccaaactctttcccagagtggctgtactagtttacattcccaccaccaatgtgtaagcattccatgccctttctagctcttggcattgccagtgtgctttagctttcctattaggtgtgtggtggtatatgatcatggcctcaacttacacacccctaacacaaaatgatattaagcatctctacatccactgagaaccatatcaagtaaaattgtaacttttgcttccaaccagcaaacccaatgtttaaaactcaaaagaatattatattttataatatatttaccctttctgttcctttttcttcattcctgatgtaatatttcctttagttatttcctttttgtgcgaacttccttaatcatttctctttgagcaggcctggtggcaaaaaattattagtttccctagaaacagggttcctgttttctctatccagagttatttcccttgatctaatgagatttaatccagtttataaatggtgagttctctttataaaagtaatagacatttgccatatagtattgtggcagaattcaatccctgactccatattgagtaatttacttctttgaaaatattttttgagcttctacaccatggcaggcatgttgtaggcaatggagacacatcaatgaacaaaacaggcaaagtgctggctttgatatgacatacagtctggtgaaggagactgagtaagataaatacaaaatcgaattcagttaagtgctaggaagaaatataaagcctggtaagttcatagattgtaacctgagttattttaggaagagttttcaggataggcttttctgtgcagatataatttgaaccaaagcctaaatatactgtggggacacagccatcatatttttaagtccagaacactatagaactttctaagtgttttctttggggttcctgcctcagcattctctgagaagcttgtaaaagaaggcaaattcttgagtcactccccagacattccaagctagaatttctggggatggggttcggactctgcatttataaaaagagccttcttaaatttgaacatctctgccctaaattgtggattggtgctcccatcaccattcccacactgtaacaggatggattcagggcagattgtctccagcaatgaatcagacaaaagtgctccaccaaccaggcccttgaatcaccttccttgtcccgtgaatcagcacagcctgccacggcaaagttktatcagcccactcctggaaatgatcagtgaaggtcccatcatgggctgctcatagtcctgtggaccaggtgctaaacttacctaccagagattaacattccagatgaacggggctgaaatttaatcctggatggaatatgttataacactcaagaaatacgaacatgaaattcttattctctagaaattacaaaacgtaagtaaaatgaagaaattttaagtcaccataattgtacggaacagtcaaatattrttagtatattctccagaatttttcaaatgcatgagcatatttattttctgaaagaaaacagcctattttgcatttatcatgccatgaacttattatacatcatcatacctattttctaagatcaacatgttttataatatattcatgattatggtacaaagatagtaaaattaagtataaattgggaatatttttcaagtaaaaacatggcattctctacctatgaacacaaacaatattaattcaaactaaatgtcttgtttaaccaatcacaattttccaaaagatgtttatgatttcttccaataacaagaccataaaatatatactatcctgcagatcatttttttgtcctctgacaaagttttcttttttataaaacaattgtagcatattcttttaaattgatatatactcttacagttcagcagatgttccataatttaccaaagtattcatctctcattgtaattccytttttttgtaaattacaaaagttgtggttaatattaagacagatttgcctagatagcttttagaattgctgtgtcaaagaaaacgaaaaaattaaattggctctaggttgccttccaaaaatacaatatttacttaaatcttctacagttacaacgccaacatctgcaaaaatagaactaatattttttaagtgtgactttttaaaaaatctggaaacattgcaaagtaggatgatcgcattctaataatttcatattcttaagtgccccactgtcatcttcctttacttctggaaggaaacatrtagatattaacacagttgcaccttcacctcctcatccccttccccactggcagtggttttaatagcaagccccatgtgggtattagcatttaatggagcatcactcctgttctcggcttcgtccattcagtcagagtctaatctaacccacaaaagccttacccagcccagaacccccgccctatccccaaatctaacactttcagtgaccactggttttggcaactctgtgaccgcttcctggccagcaccgtgacttcttcaaaccttgtttatttttccaaattgtcctggatatgagcatcttctctgccgtacggctgctgccttcctctaagatggccgtgcccatggtgctccagctaaggctccactctcagctataatgggcacaaagggcgccgccatcttttttccacagcaggctgaatagaatgccactgcgccgtgttggccttggctgggcacccgactcttgagtgtcccttgcaacgaagagagaaaggcactgaggtgactaagagtgattcccacagccattatggccgctcctgtcagaaacgctgcgatgggcgcarccctgtgacctcatagagcggcgcccgcagtctgaactcgcgatyccgggcaggctccgtggtcctcgcctcgcttcacggtctttaccgctcagcttcccggagtccgcgcaggagcgcgtctgaataggaagcgttttcggacgtggatgcggcgttttgtcgctgccagtggtgtctggagaggttcgggctcgggtgagtcgagttctgggcatggactcgcggcctgtgggtctgtgtaccgatggtgcgtggagcgtcctgattggggctgtatttgaacgcagtcgctgaggaagcggggcgttaatgacgggtcctttggctgtagggatgaagagtctgaggaaatcagcgacgagtccgactctgtctgggtctggggcccttgtgagtcaccctttacgggtgttgggctgggggacggtcaggtctttcccttcccatgaggccctatctcaggctatcacatgggatattatctttcctgaagaatataacatgtgctcttgaaaaaaatgtttattttactgctgttgagtgcagtgttaaatgttcgttaagtctagttggttgataatgttgttcaagttttcggtatccttgctgagtttctatttgttttctttattattgcaagtagggtaatgtagtcttcaattattattgttgaattgtctaatcctctctcattctgttttgcttcatacgtttttaaattatcatattcttatatatacacccttatattattattgccagccattgtaaccattgttgccactcacctaggccttggtgtccagagttttattggatatcagttaacacacacacacacaattgactgcctatgaggctgacttcaatctccagctcctccagatatcaaactaataccacgtggtccaaggtctcccacagtaaatcacattattaggatagacaatttggcatggcttaaattgccctgataaccaaagacagttttatcaagcagcgtattccaaaggcttagagtttgcctcataggaactgtgggcaaaggacaaagctctcttgggtaaagttactcctttagcgcataatgtgaaatgagacagttcttgtgatttgcttagtacattggtcttgacacgaggtatgtatacccaaagagcttacagagactttcgaaccagtacatgggcacacgtggtttttaaagacattcttggagccttccatgtgttctctttcctaaaattgatctgtctgagaattcaccttgaagggggccacccctccacaacctgtgggtgtttcttgtcaggtgggatgagagactgagaaaagaaataagagacaaagtatagagaaagaaaagtgggcccaggagaccagcactcagcatacggaggacccacgctggcactggtctctgagttccctcagtatttattgatcactatctctaccacctcggagagggggatgtggcaggacaataaggtaatagtggggagagggtcagcaggaaaacatgtgaacaaaggtctctgtgtcataaataagtttaaggaaacgtgctgtgccttgatgtgcacgcacacaaacatttcggtacaataaagagcagtattgccaccagcatgtctcacctccagccctaaggcggttttctcctatctcagtaaatagaacagacaatggggttttacacggagacattccattcccagggacgaggaggagacagatgcctttctcttatctcaaccgcaaagaggccttcctcttttactgatcctcctcagcagagaccctttacaggtgtcggggtaggggacggtcaggtctttcccttcccacgaggccatatctcaggctatcatatggggagaaaccttggacaatacctggttttcctaggcagaggtccccgcggccttccgcagtgtattgtgtctctgggtagttgagattagagaatggtgatgacttttaccaagcatactgccttcaagcacgtttttaacaaagcacatcctgcacagccctaaatccattaaaccttgagtcaacacagcacatgtctctgctagcatagggttggagctagggttacagattaacagcatctcaaggcagaagaatttctcttagtacagaacaaaatggagcctcttatgtctacttctttctgcatagacacagtaacagtctgatctctctttcttttccccagacacctgcctctgaggcattgtgctgtgctggttctgctttcccaccttctctataatagtcatgccacttctacttcacaaaagaaaggcatagatttcacacatttagaaccatgaaaacctctgaggcagcaaataaaggaactgttagaaatattagggtcttttatttaaggtaagtgcagagcagcagtgacaatgtctggacccagggttaatgtacactgaaagccattttgtttatcagtcctcaggtcctggctcccagaagcaaaataactcaagtgaagcaatgaaggaagaagaaggaggttgctggccttggatatcataatttctggggacaactttaagtggacactaatatttctgactaggaaaacttcaraaacttcatggcaartgcagaagagacaaagacgtatagtccatgttatccactattttctgakcacagaagaaaatgatcaagacccaggtgatattttccctttgattttttgatagatttatggtgrcctgaagaagtcagttgaacttaaggaagtatatactgggataattgtgttctagggagaaattaacttacattgcttttgggagtagaggtgggggttcattctgccttaagaagtagattctggatcgcttgagctcaggagttcaagaccagcctgggcaacatggtgaaaccccgtctctacaaaaaatacaaaaattagctgggtgtggtggtgcacacctgtaatcccagctactcgggaggctaaggtgggagaagaattgctagagctcaggaggacgaggctacagtgagccatgtttgcaccaccgcactccaacctgggtgacaaagtaagaccctgtctcaaaaagaaggaaaaaaaagtagactcaatatgaaagaatccatgctttgttggtagttcaacttttgaccattacaatgatacatgaatcacccaccactcaagaaggaactatggttgtcattttratgtacatactccagaccatttttggaatattggcattctttgcatgctggtgcctgccaaccaacttttttaaaattactaatttatttatttatttattttgagacagagtcttgctctgttgcccaggctggagtgcagtggcgcagtcttggctcactgcaagctctgcctcccaggttcacgccattctcttgcctcagcctcccaagtagttggcaggagacagatgccttcctcttatctcaactgcaaaaaggccttcctctttttctaatcctcctcagcacagaccctttacgggtatcccccggtgtcaygctgggggacggtcaggtctttcccttcccacgaggccatatctcaggctatcacttgggaagaaaccttggacaatacctggctttcctaggcagaggcccctgtggccttctgcagtgtgttgtgtccctgggtacttgagattagagaatggtgatgacttttaacaagcatactgccttcaagtgcttttttaacaaaggacattctgcatagccctaaatccattaaaccttgagtcaacacagcacatatttctgcgagcacagggttagggctacggttacagattaacagcatctcaaggcagaagaatttctcttagtacagaacaaaatgaagtctcttacgtctacttctttctacatagacacagtaacagtckgatctctctttcttttccccacatctgacaccagatatgtggggtttttcccacacatcaattcaattctccatacctattaggtattctaaaatttactcaattctgacactaattgtctagacttaggacagactccacaggttgagggctcagtcccacaatactgcccccctgaaaagtgctgggtccccaggttactcacaagttcttttggacttggctaccaattggatgtccccacaacccccttctcagatctattcatctgctagaaggctcaaaaaatgcaggaagacagtttacttactagattactggcttattatgaaagggtacaactcaggaatggccagttggaaaagatgcataggtcaggtaatggggaagggcctcagggcttccatgccctttctgggtattctaccctcccaggactaccctatgttcagcagcctggaagctctcaacctcatccttttattgttttggtgggttcattacataggcataatttattaattcattaactattggtggtaagctcaatttccatcacctctcccttccacagaggtcaggggttggttggagaggtgagactgaaagttccaactgtctgtcacaaggttggttcccctggcaaccagctcccttcctgaggccatggaagagccccaggcaccagtcatctcaatagcatataaaagacacttcagcaattccaaagatttggagggcagagaccaaatgtatatttatttttcacagtctggtatatagaaagtgacacggataagtatatttggtcattgttcccagttcatggcacagtatgcttaaaacccttggaatttcttcctgagaaataggtgtgtcttttgttattcataaggaaaccctgtgatacacctgaatttctgctcatgaggtgactactcatgagacctctagatagtgtcaggatgagactggtccccagaaagaccaagcaattagaggattggaactgaaaggaggaatggactggagagtaagttctataaaaactyttgaacaggctgggcatgggggctcgcgcctgtaatcccgagcggatcatgaggtcaagagatcgagaccatcctggcctacatggtgaaagcccgtctctactaaaaatacaaaaattagctgggcgtggtggcacgtgcctatagtcccagctactcaggaggctgaggcaggagaatcccttgaacccgggaggtggaggttgcagtgaactgagatcgtgccactgcactccagcctgggtgacagagcgatactccatctcaaaaaaaaaaaaattttatttattattattattgttttgagacagagtctcgctctgtcgcccaggctgtgagtttttttctttttttttttttctttttttttttttgagatggcgtctcactctgatgcccaggctggcgggcactggcatgatcttggctcactgcaagctccgcctccggattcatgccattctcctgcctcagcctcctgagtagctgggactacaggcacccaccaccacacccggctaattttttgtactcttgaacaagcttcaggtttgtgaacataccagggtgctgggaggatgccacacgcagagaggaatggaagcttggcacaccctcttccatatcttgccctatgcatttcttcagtctggctgttcctcagttatatcctctattattaactaggtaccataggtaaagtgtttcctgagttctatgagctgttctagtaaattatcaaacctgaggaggggtttgtgggagcctctaatttatagccagttagtcagaaatactggtagcccaggacttgtgactggcatcttaagaggaggcagtcttttttttttttttttaaattatatattctccaatttaaaaattttaattgaaaagtaaactttaatgtcgaaaatgcaaacttggggagggcagaaagatcacacacaaggctgtcacttcacacttggagggtcgcacagcagccgcgcaaaggcgctcctcacttcccagacgttgcgggggccaggcagaggcactcctcacttcccagatggcggcggtggtgtggggcggccgggcagaggtgctcctcacttcccagatggtgggcggctaggcagaggcgcttctcacttcccagacagtggggcggccgggcagaggaactcaagaggaggcagtcttgtaggattgaacccttaaatctgtggattctgacaaagatagtgtcagaattgaattgaattgttggacatctagtttatgtttagataattggagaattggttgttagtgttggaaaacactgcacaaaaacattcagtgctgcaaatcttgccaacacttactatgttatcaaattgtgtattttccatgatctagatgatccagtattattttgccttattttgcattttcccattcaccagtgaggttcagatccttctcatctctttgttgtttctttggattatttattctgtcataaagtgtctttagtctttgttcatttaatttttttgtggtcttactgatttataattgtttatcttgactggatattgattcttttatatgttgcaaatatttttctagagtcttacttctcttttagcttgttcaaaatattttttcccatgcagaagtcattttttttaaagctttttacttatatcatgaacatgttttcatttattccttttttttttttctttatttgagacagggactcgccctcttccccaggatggagtgcagtagcacaattayggctcactgcagcctcaaccaccatctgcctgccttagcctcctgaatagctgagaccacaggcatccactaccacacccagctaattttttgttctttgtagagaatagagacagagtctcactatgttgctcaggttggtctcaaactcctgggctcaaactctcctctggaagtactgtaattacagatgtgtgccccactcctggcctcataagttcttcttaagtttacatcttatattcattgtctattaatacctaagaaattactccaaaaggtagtgacttgaaacaacacttaaaaaaaaaaatctcacactttctgtggctcaggaataagggcatggcttacctggctactttgattcacagtctctcatgggggttgtcgtcaaggtgttagctgggttggaatctgatctgaaggctgaaatggggaaagatgcagttctaagctcacttatgtggttgttgggaggattcatttccagaatgagaaatgaggtagtttagttgaggtcctcagtttctacctgtctgtttgtcaaagcccacttttagttttttgtcacatgcacctcccctatgtgccaaattgtttaatcaaagctagaaaatgacagattctgctagcaagatggaagtcatatagagtgtaatcttaaagtggcatcttgtcacttttgctgtattcttttctttagaaacaagcttttaggccacttcatactcaggaggatggtactgcacaggggcaggaacacctagagtgtaataaagaatttggctagcctttgttttcgttcctgggaggtaacctctaaacccttgtaattacccaagttatgagtgtctctgtcattcatggtgggccactcatatttgatagtttatatctatatgtatagtggtgactcatagtagatccctagataatttatggcaatgacatgactctggataggggctgcccatgccaaaaagcgcactaagtgattagagagttgtggctttgagccatgtaataccagtcaggaaggggagggaactggagactgaactcagctacatgggcartgcttcaataaactgtgcctacatcatgaagtctcaataaaatctctggacatcaaagtttaggtgcgcctcgctggctggcaagtactcttgaatattgttacacaatgtagtcaggaagatgtaatgccaccaaggattccatgaggagaggacagtcagcagctttgtgtttggaaccttcccagacctcaccctgtgcatattttcctttagctgattctgatttgtgtcattttgcaatagtaaagtgctaattgtaaacacagcactttcttgggttctctgagttgttctatcaagttattaaacctgagggagtcatggtagctccacacatttgtagccagctcgctggagttgagggtggtctgtgtagccttaagcttgcagcttgtgtctgaagtgagggcagtcttgtggaggattgtgcttttaacctgggaagtttggcctaacccaggtagttgatgtcagaagtcactgcagctagagaatgagattatcagaggacaccttagagttggcctgcaagatttccatccagtaataaattcttttggactgtggagtgaggtagaaatttaactttacacttacccagtcgatagacatctcacataaagattttggaatgagataaactgaccaggcttgagcacttgcgcactctcatgagtctactttcttgactatgcagcatcccacacagtaatatagcatagattctcttatcagtatttccttggatcttagttacctctacttcacactctgcagttctctgaaaagttattgtgaagcaggagaatgacagtttagttgacaaacaggtccttgatatcatggttgtaagacagcaagtcatctgctagccatgtgttttaatcccaaatggccttccaaaattggccttttttgttgcaagaattaggactttgaagattgtattccatacgtttctggattctattattgaaatgtcagccatcagtatattttgttatttctttgtaggtaatctgtcttttgtctcttgatgattctatagttttccctttgcatttgatgtatggtagtttcagtctgatgtgtcacaccagttgtgacttcctgctctgaacttgttgggatttctgaatttgagatttgaggtatttagttctgaaatattttaggttttggatatttattaatagatattgcttctctattacactattttcccttttagaaaccataagtgggcatacactaggtcttgcaactctgtatttcatatttattaacttctttgttatgatttatcttttttctctgtactgcattttctgccatttccacttatatattccaattcaccaataatcttcaatgtatctaatatgctgttaatctgtccattaatacacatatgtatatatgtttttctgttagaagtttttttttgctgggcgcagtggcacacacctgtaatcccagcactttggaaggccgaggcaggaggatctcttgaggccaggacttcaagaccagcctggtcaacataacaagaccctgtcactacaaaaattggtagtagcatccacctgtagtcctagttacttgagaggctgaggtgggaaggtcgcttgagcttaggagttcaaggttgcattgagctattactgtgacactgcactccatttggggctacagagcaagaccatctctctttaaaaattaaaaaataaataaaaatctaatcaactttaggggccttttgtgctttatacagatatagtttcatcttttctcttacatttatttaaaagcactattttatgaattcaagatgtgaagtctattcatgacagatccttatattggttgtgaagtcattggtaatgtagggatgttttatttgtcctgatgtcatttgcctaygtttaatatttagaaataggcgytaaaatgtatagatagaggattttgctcctaccaaagtatatttgagaaaggaatatagatgcaggctgtattgtgaaaatttttaaaaaattatcttatacttctatattaacaataggagtttatatcatattgaataggactttgtaattacaggaatcactgaccctggaggatgtggctgtggaattcagctgggaggagtggcagctcctggacactgctcagaagaacctgtaccgggatgtgatggtggagaactataaccacctagtatcactgggtaagaatagtttccctgtgtcacctagaggtgcctacaatgcccagacaccgtcctatgctcacctaatcaaagctttacagtcactgtggtgtttggaagagttacattttcagtcccctctctgaccccaaagtggtataatctcttctaagacagaatgcttactttgaaattgttttcttcatcgaatgtattatttttccatcttgacatactggactccaattcaggatgtttgtgtttgtctttcctcatgaacagggtatcaaactagcaaaccagatgtactctccaagttggcacatggacaagaaccatggayaacagatgctaaaattcagaataaaaattgtccaggtaagtgagaaccagcaaggacagtggctataggagtcttattgtagtcattaaggaaaggtgtcacakatatgaagtatctgagggtacctaagcagctccactatatattcatctccccatctgataacttttttaatgctgttatagctttaaagactttttgtcttttcttggatctgatttcttggatatatttcagcttatatcttcataatttccttttatactgggatcgtagagttgacaataaagagccagcccccagcaaatcatctcataagctaagattttttttttttttttttagactgagtctcgctctatcacccaggctggagtgcaatggcccaatctcggcttgctgcaacctcgtcctcctgggatcaagtgattctcctgcctcagcctcctgaatagctgggattacaggcatgtgccaccacgcccggctaattttgtaattttagtagagacggggtttcaccacattggtcaggctggtcttgaactcctgacctcgtgatctgcccgcctcagcctccccaagtgctgggattgcaggcatgagccaccgtgcccggcctcataagcatttttatctcatacaattctcatggaagaatttgttactctgttctttcttaggaatcgggaaagttgacagtcatctgcaagagcactctccaaaccaaagacttctgaagagcgtgcagcaatgcaatggacagaatacacttagaaatattgtacatctcagcaagacacattttcctatagtgcaaaatcatgatacatttgacttgtacagaaaaaatttgaaatcaagtttaagtttaatcaaccagaagagaagacatggaataaataaccctgttgagtttattgraggtgagaaaacacttctacatggtaagcatgaacgtacgcatactaaaactagattttctgaaaatgcaaaatgtatccatactaaattccaagtcttcaagcatcagaggactcagaaaattgagaaaccccatgcatgcattgaatgtgagcaaaccttccttaggaagtctcagctcatttaccrtgagaacatttgtatacaagagaatcctggaagtggtcaatgtgagaaattatccagaagtgtcctgttcactaagcatctgaaaactaatacaacagacaaaatctgtatacccaatgaatatagaaaaggctctactgtgaagagtagtctcattacacatcaacaaacccatacagaagagaaatcctatatgtgcagtgagtgtggaaagggctttacaatgaagcgctatctaattgctcatcagcgaactcatagtggagagaaaccttatgtgtgcaaagaatgtggaaaaggtttcactgtgaagagcaatctcattgtacatcagcgaactcatacaggggagaaaccctatatatgcagtgaatgtggaaaaggcttcaccatgaagcgctatcttgttgtacatcagcgaactcatactggagagaaaccctatatgtgcagtgaatgtggaaaaggctttaccgtgaagagcaatctcattgtacatcagcgctcccacacaggagaaaaatcttacatatgcagcgaatgtggaaaaggcttcactgtcaaacgcactctcrttatacatcagcgaactcatacaggagagaaatcttacatatgcaatgaatgtggtaaaggcttcaccacaaagcgcactcttattatacatcagcgaactcatacaggagaaaaaccctatgaatgcaatgaatgtggtaaagccttcagccagaaaatatgcctcatacaacatgagagatgtcatacaggaaagactccctttgtatgtaccgagtgcggaaaatcctattcacacaaatatggcctcattacccatcagagaattcacacaggagagaaaccttatgagtgcaatgaatgtggaaaagccttcaccacaaagtcagtactcaatgtacatcaaagaacgcatacaggagagaggccgtatggatgcagtgattgtgagaaagccttctcccacttatcaaaccttgtcaaacataagaaaatgcacacaagagaaatgggtagaatcagtcaagttgaaaactcctgtaatggagagtcacagctccttccttataagtgaactcatgcagaagaaaaccctactagtgccgtgactatggaaatgccttttgtggcaactcagacttcattaaacatcagtgtgtttctagccaattggaacataaacatggtgctgcctgttgacagatgtgtgtctgtcctcaggaggtgaaataatttgccctagagatcaatttgatgaatacagtaaataaggtagtgcctttagtggtcttttacctcatattttctgtcaatgaaaatacgttgaataaactatattaatgtggagatgttttgagcaataatttctgctcatatgtctgaaaagtatacagagataaattctgtgaatacaaagactaagaaaagtcttctgtggaaagatagactttattatcaggtttcatcatagatttcaacgtaagtgagcttattgttgatagaaacatgatgaccatgacaaagtctttactcagaaatatgacctcagtgagtgtcaaagtttacactggaaaataactttaaggtgacagtattgatggcaggatttcagcgacgcactctgcttcatcatttgtcaggagatcacatagaaagtaaaattgttccgaacatgctatcaaataaatgtggaacacctttagcaaactatcaacagctcatgaaggcatgaaatgtggtgaaaatgatgaatatttgagtgctttttcttaataagtataaccttaaacatcagctaatacacctggtgtgcattttcagtcaggataccttaatcctcatttctagttgccttgccaatgattccataatatactgtctcattactgtttatttttactgttgtgtaaaattgtggtataatgagaaatacatttggtctttgttcctggttcctggcatagagctcctaaaacgcttagaatttcatgagtgataagagttttttggttttgttttgtttttgctgttgttgttattcatagcactgcccttttaattacacctgattatactactgaagtgacttatggttgctcccctagacagcctcagaatggggctgttctctaggaagatcaagtaactagaggatggagactttgtgccccatttctcccacctcctggaaggggaggggtgctggagattagattagacaatgagattaagagaactccaaatagcccaagagggtggtgcacccccaacttyataggggtagaggctcctgagattaggagaaccctttttaggctttactctatgtacctcttcatttgagtgttcatttgcgtcctttataaccagtaaaacaaagtacgctgttttcttgagttttgtgagccctgtagcaaattatcaaacctgagtagggcagtgggaactcggaatttatcaccattcagaactgcaggttgtccttgtgagtggcatctgatgtgggggaagtcttggactgagccccttaacttgtggagtctgcactaatttagactgcactaactaacttgcactgcactaacttggactgcactaacttgtggagtctgcactaacttggagaagttagtgtcagaattgaattrtagaacacccagttgttcagaattgaattgtagaacacccaattggtgtgggagaattagagaatttatttgtgtcagaaaatactccagaacaaccaccccatattatgattagctcttttcctttctttggctctgagcttaattgtacattaagcaaacttaagtagaaaagaaactgaatatgttaaatatattaahaacatatttggacttgcttaactaagattatagagatgatcagtttataaaaccaccttcaacttaaataaatttgaactygaaattgcaaaagcagtctagaggctttgctagtatccttcaaccaatttctagtaaaaatatcctatataaccataattatcaaaaccagaaaaacaacattggtaggatactataaagtactaatcttattttggatttgacgaatttttacatgtttttttcttttttagtttgtactctaagaagttgtattacatgtacagattcgtgtaaccactgcaaccacataaaactaatgaacacaaagtccctcatgctacctttttatgcttacactccatccaaacctaactctgccaaccacttttctcctatcagtataatttcatcatttcatgaatatgataaaaataaaattgtttttgtaaatggtttttataaattttatataaataagttatatgaatttttattgatagagagtatgtaagcttttggcatttttgtcactcagcaaattactcctaaggtttatatgagttgatgaatagttgttttattatttttttttaccaccatgtatctaaccagatgaaagttgtttatatttgagagtagtatacatatttgatgtagtagtttatccattcacctatgagatatatttgcactgttttcctggttttaagtgctataaataaagatgctgtgaaatctacatacagcttttgcttttgcttttttttttttaggatttacaatcttaacctcttttttttcttttttaagagacagggtctcttgagaggccgaggcaggcggatcacttgaggtcagaagttcaagaccagcctggccaacgtggcgaaaccctgtgtctactaaaaatacacacaaaaaattagctgggtatggtgctgggctgttgggagccraaggcccatgggatgtgaccaactcagcattccactggaggctatatgatcaaacagcaaactttatcatgaatgcacgatgtgggcaaactcatgactgcttccgctgccagaaggtttgctgagggcaatcgcttcctggtgctgagctccttgaggttatctactgggacatctagagaatgccatcttgcaaaccctactctggactgagtagctgaccccttcttccaccygccttctcactrtctcttttgcctaataaatatggagggctgtgtaaagctcagggcccttgtccactagaggcaaggtgtcccctgatcccttcttccaaatatactcttttgtctcttttattcccgtttcccccacttttttcagtccccctaggtccttgtgggttacgtagtggcgccccaaacagtgacaggatcgggcgctctacagttggcgcctgtaatcccaattacttgtgaggctgargcaggaatcacttgaacctgggaggcagaggttgcagtgagctgagatcctgccactgcactccaggcctgggcaacggaataggctctgtctgaaaaacaaacaaaaacaacaaaaaaaagagtctctgttgcctaggctggagtgcagtggtgcgattatagctcactgcagcctcaaactcctgggttcaagtgttcctcctgcgtcagcctcccatgtaggtgggactatgtgtgtgcaccctcatgcctggctttttttttttttttttttttttttgtagagacagcatgttttaggccattcttgcattgctataaataaatacttgaggctggataatttataagaaaagaggtttaattggcttatgattctacaggctgtacaggaagcatagcactggcatctggtcctggggaggcctcaggaagcttacaatcatggtggaaggtgaagagggagcaggagtaagacagagtggagggggtaggtgctgcacactcaaatagctagatcttgctagtactcactcactattgcaagggcagcatcaagccatgagggatctgcccccatgactgagacacctcccaccaggccccaccttcaacattggggattacatttcctttttttttttttttttttgagatggagtctcgctctgtctcccaggctggagtgcagtgggacgatctcggctcactgcaagctctgcctcctgggttcacaccattctcctgcctcagcctcccgagtggctgggactacaggcgcccgccaccatgcccagctaattttttttttgtatttttagtagagacagggtttcaccatgttagccaggatggtctctatctcctggtcttgtgatccacctgcctcggcctcccaaagtgctgagattacaggtgtgagccaccacgcccggctgacattgggaattacatttcaacatgagatttggacagggacaaatatccaaactatatcattcagcccctggtctccctccccaacaaatctcatgtcctcacattgtaaaataccatcatgccttcctaagagtccccaaagtcttaactcattccagcattaactcaaaagtccaaagtcttatctgagacaaggcaagtctcttctacctatgagcctgtaaaataaaaagttatttgcttccaagatacaatgggggcatagacgttgggtaaacattcccattccaaaagggagaaagccacaagaaagggctataggttccatgcaagttcaaaacccagcagggtartcattaaatctagtgcaaggcgtgggttcccaaggccttgggcatcctctgctcatggggctccctcaggcagacatcatggtttgcagacagctgtatccttcccaggtggccctacagaggaaggcacaccygacttttccaatgtcctgcagacccagctgtctcaactcttatggtgatccaagagtgagggcccctccctacttggacaccacccaagctggcaagtcctgcttggctaggagcagggataagcacttggatggcagattaggtgacccccacccactcatggcattatgtttgtccacagagtttagtaacaattgggactgctgggccggaggctctagtggttggattttgactggggctgcatggtctaaatagcttttttcacatatttgggcttctgctggaatggatgaggcctttatttacacagtcaacaagaggctagtctgggctttcttacaatgtgttggaagatctctaagagacaagcaagscttgatgagcaagcttatttctcacctccatttgtgttacacttgctactgtcctattggacacattagtcagtcactatggagaatactatccaaagatgtgaatatagagatgcaagaataaatttatgcaataaccacaaaagtatttgtttccttataattgtcagatcaataccataaatatccttgcacatatttgttctcacaaagaaaagttctattgaatcaattcttaaaattcatggctcaaggagaaggaaaagtttaaactgggtaataacagactgtactacaaaaacattttacgaatttatatagaaacacaatcctatacctagaaataatgtaatgcttaagaacttcgaattatgaccagtatgataatatctcaattcatttaaagcagtatgtaattgacaacattattacctaccatgcagaaaaagaagacttaaagaggcttagcataacagaatgcctttgttccatggccttataatctaaatatgatttgtcattcaatctttacaaatcttaataagggttaaaacatttatatttcacgtttactttgcatttgtttgaatattagtaaaactggtattttttaaattgtttaggatcatttacattaaaaaaagtgtcctgtttatttccttcatgtatttatagaaaattttagggagcttttaagttgatcatcttttccttatttttatttatttttttttttgagacaagagtctcactctgtctctcaggctggggtgcagtggcatgatcttggctcactgcaacctctgcctcctgggttcaagcgattctcgtgcctcagccttccragtaaatgggactacaggcctgagacaccatgcccagctaattttttttgtattttagtagctatggggtttcgccatgttggccaggctgatctcaaactcctgaactcaggcaatcctcccgctttggcctcccaaagtgttaggattacaggcatgagccaccgcgcccatcttttttcttatttcttttcagatctctttataggccgggtgaagggtgaagtggctcacacctgtaatcccagcacttttggaggatgaagtgggaggactgcttgaggccagttcaagaccagctgggcatcatagtgagacccttgtctctacagaaaattaaaaaattagccaggtgtggtggtgcccacctgtagtcccagctattcaggagcccaggagttccaagttacagtgagctgtgatctccccaggcactccagactgggcaacagagtggaccttgcctcaaaaagagacaaaaaaaaaacaaaaaaaaagaaaaactctcatataccaagggtgagaakagcaaatggaacacgaacttgactctgaaaaatagtttgacaatttctctgtatatttatatactgatacctatatcacacacatagattcacacaggcatttcctttctctcattcttctaatataggaagtttggttggatttatatttacagttcagcattgccatgactttgcacatactattcgcggttggcacacgtagtataacgtgatctccttcttaacctttctttcttttgttttttttttgagayggagttttgctcctgttgcccaggctggagtgcaatgacgccatcttggcccacagcaacctcygcctcccgggttcaagcgattctcctgcctcagcctcccgagtagctgggattacaggcatgcgccaccatgcctggctaattttrtatttttastagagacagggtttctccatgttggtcaggctggtctcgaactcccgctctcaggtgatccgcccacctcggcctcccaaagtgctgggattacaggcgtgagccaccgcgcccggcctctttcccaaccttttttttctcactgaagtggtcctgttcccttaatttctggccacttctcctgagtccagccctcatatttggctccacctgggtcccaggctctcccctccgccttgggaactatactttctggcttttactggcttttccccatgcctttcacccaacataattttggcacgttccaaccgttttcattacctagtctgtgactgctacccctgttccgtcagcgtagctaacagccctcttctgcgttcaaaaggcgcttcaagctactttgttagaaatctggctttggccgaagtgtcccctctcggccggttctccttttccctcacaaggaactgtttcctaacctttgtacaaagtgtaaacgtcgcggccatcttagccttctattcagctgctgaaagggatttacctccacgccatttttgtcttgtgtaaactggagcctctgtatatggacccstatttatgaagggttgaggtgccaggaaatgggacagtttcagtgctctttcatcttcccggccatccccggtcacccccggtcacccccggtcaccagcgccaaaacgcgccctttgccttgtgtacgtcagatactcaaagatggcggcccccatggagccaaggcgacgagggcgcggccatcttgcatctgcgcaaacgctgggaacgcctccgaccctggatagtcgccgtcaggcactgaggaggccgagagatgaggccggagcccaccaagttctgggaagtaagttcagtcactgggtggtcgctgtggtgacgggggaggaaattctgtccgtggctgggcgtgttcgtggacagtggtgatggactggtatctgtcggcgccagcgtttggcgacgccagtggaattctttcaggagcttagcgtgggtccgattcctatcgcaggggaactacaagaggtccgtgatagggtgtgtgtgtgtgtgatcggggtacctctgggaccagtcacagggtcctcgtgtagtttgtggttaaagatctctagagatccgctactgagtgcccaagtcacattctggtgtctttggtgttgtcctttggcggggctcagtgattgcgaactggagggtttgttttgtcagcgaatcggtttatggttcaggttttgtttgggactaaatgattgaggaactgtcttgggggttaaggtacggaggtttctgatycaggttttggaattaatcccggtgscggtggtggtagcgccacagattccgatgtgggctgcagctctggaggcctgggaaccatggcaggtgatgggttagccccagccctggctgctggaacagaattgatgctcattagcattccccttctgcccaagacccttctccacgactggtttttaaatcccctttggcaccttccatcaccccttggtcttgaatcctcagaaatggaagtttttggcgagatcagtcatctagcatacctaaaagtagtatgttttatatttaagatgcggcttctaccctttgtcctgcaagtttccagcgtatcctcttggatatttcttttcaggttctttctgacacaagtaagataacatctctgccatggtaagctcggttactcaaagataacctttgtcaaattttcagaatatttcaattttagacgtgtatgttatgtgcttaatattcataattcagataaattatgtaaatggtactattatctttttcgctttatattatgtaataaacatttagaagttgtttttactgtttgagccggtggtactataagtgcattcacattaagtttatgcgtacatttggatagaagtgaaatgttttaaaatgtttaggtattatttttaggaacattttatgattatccatttatccatgaattttgtttttcctgcctttaatcttcaatctagactattacttwtattgcagtgtattgctttctgactcccctttccttataatctataacaaaagataaattaattttaaatatttattttatatttggtcatcttaattcttagtattacaatatttttctctctgcctaacatattattttgtgaaaatttttgaacctatggaaatattgaaagaagtttaatgttaataccaatatgcctaccacctagcttttaccattaacattgtattagatcagctctactggttttctaagtattcatccattcctctgtttgtgaatcattccttatttgttgtcgattttggtatatttcaaagtaagttacagacataagtaccattcctctaaataattctgtatatgattaactagaattctactaatagccctttaattgctttatttatttacttaatagggaggcatctgatttacagataattttggttcggtataaagtagagtaaaagtggattttgaagtgaaacaaaagtggattttcagccctgattctgcttcttgctcattgtgtgattggcataacttgtgtcgctttacttgttggccaaaagaggagttaaacatcttttcctcacgattatctctgaggattatttttggttttgtcttttgtaaaatttgtatttatattcatttttttctctcccttcctcccgcctggtttctctcttttttctattaatgaaaacatttaaagccgtaaacttatattactgaactaccatcagcaattttattttaaatgtagaatgctaatatttttctgatgtaaacctgtgttttccctatgaaaaatcaagtgaagaaagtaaaaatgacctgtcagatagcacacttttgccaatattaccttttaagaaagttttaggaatggrgttttgggttaccaggtatacctttattggcaattttcaatagaatgttaaattrttcccaagaaaggttctgctcttaatactgactcgatctgtatatgctttaggaggatataggatttttctatttaaattttgtatccagccacctgactaaaggaatacagacgtattaggcaaatactgataatttgccccttatattcaaaagtcatctttgattatttttttatactgcattctactgagtgacattctagacccaaattctcaactctgccattgtaatgtgataatagcctgagatgaratgtcatggaatgcatgtagctgtgttcytataagactttatttacaaaacaggtggtccaggtcctggatactatattactgactcttgatttaggtgaccatatggcttttctgcacaaattcacagttgggcaactagagcccatggactaaatctcccagcacctgtttctgttaataaagttttgttgggacctggccacaatcatttgtctatttttttgtatgtgggcatttttgagctacaacagtagagttgagtagctgccacggaaaccatagacctctcttttaacatggaaataattttttaaaaattagttttattgctgacactattgattacraacaacatataaacttatttgttaatgttatggtaattagtattttatactcttctgctatgcagatatcttaaaatacgttttcatttgccatcctcctactttatatgttcttttttgttgttgttgttttgagatagaatctcactctgtcacccaggctggagtgcaatggcacaatcttggctcactgcaccctccgcttcctgggttcaagcaattctcctgcctcagcctcctgagtagctgggattataggcacgcgctaccatgcccagctaatttttgtatttttagtagagacggggtttcaccatgttggtcaggctgatctcgaactcctgacctcgtgatctgcccacctcggcctcccaaagtgttgggattacmggcgtgagccaccgcacccggcctatatgttcttatggaatattttaacactatatatattaaaacttcctgatatattattatcagtattatttttccagtcaatactgatttaggctttattaattacttaccrttttgttcctcttcagaccttgctcctctgcttacactggagtcatctttcttttgcttgaagaatatccgttaggatttgctgtaatatgtaattcctcaaggatatttttgctgagtatcctttatacatttatacttagaatactttgcaagtatcaagatgtggatggcggccgggtgcagtggctcatgcctgtagtcccagcactttgggaggctgagatgggtggatcasttgagctcaggagttcaagaccagcctggccaacatggtgaaaccccgtttctactaaaagtacaaaaattagcagcgcatgtggcgttcacctgtaatcccagcttctcaggcggctgaagcaggagaatcgcttgaacccaggagatggaggttgcagtgaacagagatcacgccactggagtcttactcactccagcctgggcaacagagtgagtgaractcagtctcaaaaaaaaaagaaaaaaagtcaaagatgtggatggtaatgaataatttaaataagatagtgcttattatttgcttaggacagtgttctcagattgcagtatcctagaatgtaraaagacctctgaaaaggtagatgggtacacatggttttaaagaaaaaatgtgtgcatcttaactgtctatgtgacctctttcctaaaactggtctgcctgaggattgcccagctgctgggcatcacgttgtgacgattcttttccccacattctctttcacttactagcagtagtcataccacgtcaactttatatagaagggtgctgtacctcccatatattcagaatgttatattttactagcccagatataaaagcttctggagcactaaataaaagaacagagagatatttgggggccttgatttaaggtgagcatataggaacagtgacaacatctgggcctaaaaagaatgtaccactcagagtaatttgctcttcagcccacaggtgctgagaacaagagaaatcaagtgaaggaaggaggcggagtttccaagacttgggtgtcatcatttctggggacatccttgattggagattgaagtttttgaaccgaaatttagagctgattcagaagagacaaatacagaacgtccaagttagcagtcrtttcccaaatttaggagacaatgatgcaggcccaggtgacttttggtttgttttattctttcctttattctccaatgtatttttaaagtcctgtaaaaatcagggtaattaatcagaaaagtataaattggaaatatcaggacctggagaaatctgggcaaagaaggatcagggatatattattcataggattcatactacatgattcatgttggaatttgtgactgtgtgggaccccgtaggttacatttgctgtaaacttgcctctagtatctctgacaagctatacaagagaaacatgataagttatatcaactgtgagaaagcagaccagtttcttgagggatgttaatgtttcatggcttataattctgaggctcaaatacatctttgatagttcttcacggaggtgttatggtaggtggtgttcttaactgtagccttctcataaatgcaaaagtagatttcttttagctgtttcttcattgtatttaatgttattaacgctgtctaataacatacacatatatatgaatttgtctgtgtgcatacatgtgtctgcatatatattctaaggatttttttttccaaatttgcttaatcatggccaggcgctgtggctcacacctgtaatcccagcactttggaaggccaaggcgggtggatcacctgaggtcaggagtgtgagaccagcctggccaacgtggtgaaacctcatctctactaaaaatacaaaaattagccaggtgtggtggcgtgcgcctataatcccagctactagggaggctgaggcaggagaattgcttgaacccgggaggcagaagttgcagtgagccgagattgtgccactgcactccagcctgggcaacagagcaagactccatctcaaaaaaaaaaacaagcaagcaaaaaaacagatttgtttaatcatctaataatctttgtgctttatacatgttttatatagtctcttttatttcattcagaataaaataataatatggttaactatrttaaccatagttatttagaatgcattgtcttgtgatactagcatctgccatgtcttcattacagagtttgatattggcctgaaagctcatagtgaatttaagaatctgaattattcgtctacttgtaactggcatatacttatgactagtttggtattgggaaatagatgctacatgttatagatgttctttcattagcaagaggattggatagctgtgtattacagacatttctttgacttttcaacattgttgaatgaatggatgaccgcacagttacagaatattttactggaattcttattctgycaaaatgtactaagaaaaaaaccccaccagcttcctatgtggtgaaaatgagcggaatgacttccttgacattcttttcctatcaccaaaagaatatgacttcattaaacagaagtgtgttattacaggaatccctaacactggaggatgtggctgtggacttcacctgggaggagtggcagttcctgagccctgctcagaaggacctgtaccgggacgtgatgttggagaactacagcaacctggtggcagtgggtgaggacagctgccctgtgtcactcagagggtgcccagtcagtggccttcctttstcagctgcttacctgcagtactctgaagtggtagattctcacatcattctcttgccccacacaagagagtataatctaccttcttgttacagatctgatacctatgtagtccttaaaaygtaactctcctttttcaatattgccagccccgtttgatttgtctaaatcttctgtcatttcccatgaacagggtatcaagccagcaaaccagatgcactctccaaattggaacgaggagaagaaacttgcacaacagaagatgaaatctactctcgaatctgttctggtgagtgagaggagcagccaggtggacagccacagacaccatgttctgcccacacagagcaggcgtcaaagcagtgagggcatctgaggacacagcaacagcccctccatcactccttcttcccaaggaagagctcttttttgttrtagtatggaaaatatgccccactttcttttcttttyytttttttttttttgagatggagtcttgctctgtcaccaggctggagagcagtagcgcaatcttggctcactgcaacctccgcctcccgggttcaagggattctcctgcctcagcctcctgagtagctgggactacaggtgcgtaccaccacgcccagctaatttttgtatttttagtagaaacggggtttcaccatattggccaggatggtcttgatctcttgaccttgtgatctgcccaccttggcctcccaaagtgctgagattacaggcttgagccactgcgcccggcccccactttttttccttgagatttcatctttgtttattttatgcacatcttgtttttgtctacataattatcttcttaggattttcaaatctgccttttctygtccactgtcacagtgtctctgcttgtgtattacctctcttgctatgaaattccattttccaggcctctccggaaagagagacctttgaactcattacttttttctgactactgcatcttcctgccctagtaggaaaataataattttccttcattattcccactctgggaatcattattttccctcattttctccactctggatgctgtgcccatgataacctggtctctgattggcatttatgtgtttcttaagttctcttattcctcttatactgaatcctgagtttctccatactttttttttttggaaagaaggtctcatctgtcacccaggctcactgtagccttgacctcctyggctcaagcgatcctcccacctcagcctcttaagtggctgggactacaggcacacatcaccatgctcagctgatttttgtatttcttatagaggtggggttttgtcatgttgcctaggctggtcttgaactccttggctcaagtaatctgtcagccttggcctcccaaagtgctgggattacagcgtgagcctccgtgcccagcccatccttcttccattttctttactgttctcataacttttaaaagtttttttcattcccgtgaattaactcttcattctctggaagagactaccaaattaacttctgccttaatattatctaatgtatactttatttccatgtattttacttgtcttcatgacaactagcctgtaacttcccattttgtgtatgaggaacaagaatcatcttccctctaagaataatgcttttggctatccttatataattttatttttttaattttattttatcttttatgtttttattttagattcaggaggtgcatcaggaggtgcatatgcaggtttgtctcatggatatattgcctgatgccgaggattcactagaagctcaatcctgtcacccaagtagtgaacatagtaccaaataggtggttcttcaacccttgccttcctcccttcttcctcttggagtccccagtgtctattgttcctgtcttgatgtccctgtgttcccaatgtttagctcttgcctacaagtgagaatacacagtatttggttttctgtttctgagttatttcacttagggtaatggcttccagctgcatccatgttgctgcaaatgacatgctttagttcttttttatggctttgtagtattccatggtgtatatataccacagttatcctgttcaccattgatgggaacctaggttgattccatgtctttgctgttgtgaatcgtgctgcaggctgtcctgtttaaatccagggtctctttcattactgcacatcttaaattctggcattaccttaagtgttttctacatgctgaactctcttaaagttctctactttaagataatgttttgattaattagaaaagatcttttaatatcgtatattatttctagcccaaaccatcagacatttatgcctgctgcaaattacttccttcatagttttgctaattctgaactttctttaattcatgttagatgttttgactgcattcatttctgtatagcttttgcttttttcatcatatttgtaaactattattgagatacaatgcacatatcacatgatttcacccatttaaggtgtataagccagtggtttttaatctattcacctagttgtgtaaccataccacaatcaattttggaacatatactatgtataaatatatattatcaaatagtcttgatgattatggttctatagtargttttgaaattgggaagtgtgagtcctccatctttgttctttgctttgaaggttgttttgactattctgagtcctttgaatttccatttgaagtttagaatcagttgtaaatttctacaaaaagagtggctaggattttggtaggtactgcactgagtctgtgtaacaattttggggagtattcccattttcatcatattaagtattctgatccatgaacactggacagttttatatcctgttaggtctttgacttctttcgacaatgcattatcactttcagaatataaatttggtacttcctttgctaagtatattcctaagtatagttttctttttgtttctgcagttaatggaattgttttcttgattacattttcagattattcattgctagaatatagaaataacattaattacttttctatcatattttgatgacacctagtcccagttaatcatgtttcttgtcatatgattccttcctttaaaacttgtgttttgggctgggcgcggtggctcatgcctgtaatcccagcattttgggaggccaaggcagatggatcacttgagttcaggagttcgagaccagcctggccaacatggtgaaaccccgtttctactaaaaatacaaaaattagccgggtgtggtggtatgtgcctataatcccagctactcaggaggctgaggtgggagaatcgcctgaaccctggaggcagacattgcaatgagccargttcatgccactgcactccaggctggatgacaaacccccctgcctccaccacacacccaaaacttgtgttttgatagcctactatattccaacgctatcagcagtacaaataagaaagaaaaaacataccatgtccttattcttcacaatgcttttgttctcttagaagtaaycatataaccagtaataagcagatatataaataacatatcttggagtaaaaattgctataaggaaagttaaagcagctggtggaacagtaagtgttaggagttggcactgtgcttgtagggtgggaacagctctttgttaaggtgcctttgagcagatagatgatgaacaygtgtaggctccctggatgaagagtgttccaggtgtgagacaatgagaagttgaaaaatgaccctggagtgtgtttgaggaacttctaggaagcttgaatggatagagtagagtgagcaaaagcaaaactgtctggaaataagaacartgggggcatagttggaagttttggtacagaggtcacatactgcctgtcaagggcattcatgaccttgattttattccaaatgagttgagaacacagtagggagttttgagtagagaagtgacatgatataactaatttatttgatagattactttgcctgctaygtagaaggtagacgttaatggggaggagagggaactgctacactcatgattacagtttgtgacagtgaaataatacaaattaaaatcatcaaagataaaaagtatagaaagaagaatccaggagaaactgggtgcaagctttcagttctcctgttctagtrgagttgcacaaagtgctraattttccctgcaacagtgtttgtcaacacatgtgaagttattgccaactagggaagctcatctaagcccagtgtctgtagccacccagagtcaaaacaatacaaatgtggcccaaagcctgagacatgcaaaaccaggtgtccaccataaatcacattgctagcataaactatctgatatgacccaaggcctcaggcattaaaagatacccttagcaggcagaatattccaggggctcagaggttatcttttagaaggcagttaagacgagttctttctttggaatgtgtagggatggaatagcccaggcctgctgagttaacactttgctgcaaatcattgttccctctttctgtagcaacacgggatagtatgatccagttaggtcattagttggagtcttaagtatagaacctttcatctaaacttgagattgtgctttgggaaaattagtttaatggtggtacatagaatgaagaagaatagcaagtttggggaatgtgataatcactcagcatgtgacactttaaatcaaatgctgaggatctcacattcttctgttttttaaatttatgatttcttttctttatttttctactctgttacccaggctggagtgcagtggcacaatcatggctcactgcagcctcaatctcctgggctcaagtgatcctcccactttagcctagctgggactacatgccaccacacccagctaatttctgtattttttatagagaaaggtctcactatgttgcccaggctggtctcaaatttctgggctcaagtgatcctctttgcctcaccctaccaaagtgctgggattacagacatgaaccaccacaccaggacatgattactttttaattcctaaataaaaaatacatatatttatcatgtaaaacatgttgttttgaaatatgtgtacattgtggaatggctaaattgaacaaattaatgtatatactacctcacgtacttactttttttgtgagaacacttaaaatctattttagcaattttcaagaggctattacattcttaccactcctagatgtttgttttgtacacctgggtctccacttgtgcacctgatcataatagtcagcgtatggttcatttcagtggacttaacgaattcccaaactctacatgttggattgacaagatccctggccctgtgccttcattctttttttctacatgtttccaactaaagtctcatccagtactctttctttgaataatttgtaaatgttggatgtcatctacattgctgtttccagataaggccttttcgagatttatatattcaaccaatttcttcatgtttgtacttggatatgtggtaatggtcttaaactttatgtgtttcacaaggcatgctaaatttttcccttcattccagatagtaatattcctattttcatcatgaggttttttcttcctatccaatggctgaagccatatagttttgcgtttttttttttttttttttttttgagacagagtcttgctgtgtcaccccagctggagtgcagtggtgtgatttcagcccactgcaacctccacctcctgggttcaagcgattcttgtgcctcagcctcccaagtagccgggactacgggcatgtgccaccatgcctaatttttgtatttttagtagagacacagtttcactatgttggccaggctggtcttgaactcctggcctcatgtgatctacccgctttgtcctcccaaagtgctgggactacaggtgtgagccactgtatccagcctgaaaccatataatttttggaataatctttgagtcctcacttccattaaccctctttcactcgtcccattgaacctattagtgaaccttgtcatttctttaactatatcttgattttctccacctcttatatctccattgttccattaaccacatttcacaaaatgcaattaccttctttatttttttgcttccttgtgatttcattttttcctaactaaaattaaaccttcgtgaaaattggctgagtgcagtggctcatgtctgtaatcccagcactttgggaggcggagggaggtggatcttcttgagcttgtgagaccagcctagataacacagcaaaaacccatctctaccaaaaatacaaaaaattagctgggtgtggtggcacatgcctgtggtcccagctaatcaagaggctgaggtgggaggatcacttgagcctgggagggagaggttatagttgcaagtaagctgagattgtgccactgcactccagccttggtgacagagaccctgtctcaaaaaaaaaaaaaaaaaaaaaggaaggtgtttgtatatcccaaacatgagcatagtgacttacacatagatgtcattcagcaaacatttgtagaataaattaatacagcctttgtcatttgggatcaacctgtgtggtctgatatttctctttatttctgtggtctggtatcctgccaaattttggggttccctgcaaaaagtgacctgtttatatttgactatgtgtgtattgtataaagacctatttagaaagcagccaaatctatatacattgtgaattatctagccttgtttgtacagttgcttttacttttmggtgtgtttatattattgtgttttatttgtragaaatgaaggatatttatacatggaatttcctttatgtgtaagagataaaargaatcttacacatctctcccaatgtgtaagagatgagggatatttatacatggagtttcctttatactaaaatagggttttcaaccccctttarctgtaattttccaytacctacccaaatgctataaaactgccctccccttatcacccttttctgactcctttttcggactcagtcygcctgcacccaggtgattaaaaagctttattgctcacaaaaaaataaataaataaaatagggttttcactaaagagtcacctcacaccaaggcagttttaaaaaatagtttaaatagtttatttcaaaacaagatgatggagtgattgactgttctcttctttcctagaaatcaggaaaattgatgatcctctgcagcatcacttgcaaaatcaaagtattcagaagagtgtgaaacagtgccatgaacagaatatgtttggaaatattgttaatcagaacaaaggtcatttcctgctgaagcaagattgtgataygtttgacttacatgaaaaacctttaaaatcaaatttaagttttgaaaaccagaaaaggagctctggcctaaagaactctgctgagtttaatagagatgggaaatccctttttcatgctaaccataaacaattttatactgaaatgaagtttcctgcaattgcaaaacctattaataagtcccagttcattaagcaacagagaactcacaacatagagaatgcccatgtatgcagtgaatgtgggaaagccttcctcaagttgtctcagtttattgatcatcagagagttcacactggagaaaaacctcatgtatgcagtatgtgtgggaaagctttctccagaaaatccagactaatggaccatcagagaactcatacagaactgaaacattatgaatgcactgaatgtgacaaaaccttcctcaagaaatcacagctcaatatacatcagaaaactcatatgggagggaaaccttacacatgtagccaatgtgggaaagccttcatcaagaagtgtcggctcatttatcatcaacgaactcatacaggagagaaaccccatggatgcagtgtatgtgggaaggccttctctacaaagttcagtctcactacacatcagaaaactcatacaggagaaaaaccttatatatgtagtgaatgtggaaaaggcttcattgagaagaggcgtcttaytgcacatcatcgaactcatactggtgagaaaccctttatatgcaataaatgtgggaaaggcttcaccttgaagaacagtcttatcacacatcagcaaactcatacaggagagaaattatatacatgtagtgaatgtggaaaaggcttttcaatgaagcactgtctcatggtacatcaacgaactcatactggagagaaaccttataaatgcaatgagtgtggaaagggcttcgctttgaagagcccactcatcagacatcagcgaacacatactggagagaaaccctatgtatgcaccgaatgtcgaaaaggtttcaccatgaagagtgacctcattgtacatcagcgaactcatactgcagagaagccatatatatgcaatgattgtggaaaaggcttcactgtgaagagccgccttattgtgcatcagcgaactcatactggagaaaaaccctatgtatgtggtgagtgtggaaaaggctttccagcaaagatccggctaatgggacatcaacgaactcatacaggagagaaaccttatatttgcaatgagtgtggaaaaggcttcactgagaagagtcatctcaatgtacatcggcgcactcatacaggagagaaaccctatgtatgcagtgaatgtggcaaaggcttaactgggaaaagcatgctcattgcacatcagcgaactcatactggggagaaaccttatatatgcaatgaatgtggaaagggcttcaccatgaagagtactctcagtatacatcagcaaactcatactggagagaagccatacaaatgcaatgaatgtgataaaaccttcaggaagaagacatgcctcatacaacatcagcgatttcacacaggaaagacttcctttgcatgtactgaatgtggaaaattctctttgcgcaaaaatgatcttattacacatcagagaattcacacaggagagaaaccgtacaaatgcagtgactgcgggaaagccttcactacaaaatcagggctcaatgttcatcaaagaaaacatacaggagagaggccctatggatgtagtgattgtgggaaagcttttgcgcacttgtctatccttgttaaacacaggagaattcacaggtagtcattttgggaaagcctcttgccagatgtaggcccttaagatatctgcaaagaagagtaatttcatgaatgcagactacatggttgtttatttagtgatcagttacttcatgttttgtgtcagagaaaacatgtacaaaacatttgagaaaatattttaggacattatgtctaaaaattgtatactgagaaaaatcctatgaatgtggcagactataaaagcctttggtgggaagataaaccccctcagaagtgatcatagatcatgaataaactactaattcgtggaaatgtaataattataggaacgtctttgcccaaaaataaaacytcaacagattgagagagttcacactggagaaatactttcctctggcaaacccctgtggcagggttttcagtaaaatgttttgcctcatcgtgtgctaggaaataatgcagaaaaaactwatgaaaacattcaatgtagaagacttttaggaaaayatcagagaatttaatgaaggaaagaagccttggcaaaatgatggatgagagctttctgtcacaattctaaccttaacagataatatgcctcatgtgcatttgggaacaggatagcttgagccatattcctagttgccttgtcactgattttatacattttaaattgtgacttcctctaatcacgaactaaaatttaatattgtatataataccggagtattttatgcctgcctcattttattatatgattagctcctgcatttctttggttctaagtttgtgttatttcagaataactaaagtacttcagaatgaaactggatacagtatattcarttcataagtgtaattgaccatacttgaatatgtttaagtttataagtaacatcaggtgttatgaaattaatataaataagatgtttttgtaagtttttattttgaaataagtttagattcacaaaatcttaccaaaatattccagagttcttdcccttaacccagcttcttccaaagataacaacttacataagcatrgttcrttaccaaatacaggaaagtgaaattgttacaatactgttaactacagaatttatttggaaatcaccagttttaacatgcatgcatttttgtttgttttttatatgtagctttaagaaatcttaacacatatattgattcatgtcaccaccaccgtaatcgagattcagaatgttgcatcaatgcaaactccctcatgctccttgtttatagtcacaacctctcctcagccctaacccttggcaatcagaaatcttttcatctttagttttgtcattagtagcatgttataaaaatggaatcatacagcatgtacccttttggtattggctatttcaactaaagcagattaacctgaaatccatccaagttgttctgcatatcattgttctgtttttattggccactaataatctatgatacgaatataccactatttgtttattcacccactgaaggacattagttttgttcccggtttttcttactgttacaaataaaaatcctatgaacatttgtacacacaggctttgtgtgagcacaattttttacttctctaggataattactgcagagtatgattcatgggtcataaggtaagtgtatgtttacctttgtaagatactaaccagagtggtgtttcattgctcaccaacaatatatagaaaggttcagttgctccacattcttccacttgatgctgtcagtattttttttgttttgtattgttttgttttgagatgtagtcttgctctgttgaccaggctagagtgcagtggcacgatcttggcttgctgcaccctctgcctccggggttcaagtgattctcctgcttcagcctcctgagtagctgggattacaggtgcctgccactgcgcctggctaatttttgtatttttagtagtgacggggtttcatcatcttggccaggctggtctcgaactcctgaccttgtgatccacccgcctcagcctcctgaagtgctgggattacaggcgtgagccaccacgcaggactggaatgttttattttacctattctattgtgtgtgtattggtatgaatacaaacataccaattgtatgtggccttccatttgcacctccctaaaggctttttttttttttttttaagagacaaggtctcactatgttgctcaggctggagtgcagtggctattcacaggcaccattatagcacactacagtctcaaactcctggtcttgagaagttttctgtcccagcctccagagtagctgggactgcaggcatttgccactgtgcgctgcttagagcattgtttattaatgctggataaagattttatccagctggataaaggttttatatcacttgcaaatatttttccatagatgtggttctttctttttttttctcagagaaaaagattttaattatgatgaagtccaacttttttttttgagatggaatcttgctgtcttgcccaggctggagtgcaatggcatgatctcggctcactgcaacctctgcctcccaggttcaagtgattcttctgcctcagcctcccgagtagctgggattacaggcacctgccatcatgtcccactaatttttgtacttttgtagagattggggtttcaccgtgttggccaaactgggctcaaactcctgacctcaggtgatctgtccaccatggcctcccaaagtgctgggattacaggtgtgagccattgcacccagcctttttttttttaatggattgtggggttttggcattacatctaagtattccttccttactgtaattgataattctttttccacttcctttgacaaaataatgtagttttgcttctttttttttttttttttttttttttttttgagacagagtctcactctctcacccaggctggagttcaatggcatgatcttggctcactgcaacctccgcctcctgggtttaggtgattctcctgcctcagcctcccaagtagctaggattacaggcacgcaccggcatgctcagctaatttttgtatttttagtagagacggggtttcaccatgttggccaagatggtcttgatctcctgacctcgtgatctggccacctcagcctcccaaagtgctgggattgcaggcgtgagacaccacgcccagccagttttgctttttaatatttagcaatatccatttaaattcatctttgtatatagggtaagggttaatttaaagttcagcctatggttgcccagttgattcaacagtattgaaaacactgtcctctttccattaaattgattttgaacatttgtaaaaatcagttgcctgttcttgtgtccatttcttgactctattctgttgatgtgcgtgtctatcactccactaataatctacggtcactcccatcagaaatgacataatatgctctatgaggtaaaacagctatgttacctcatataaaatgttcaaagccagaacctggactttgggaaatgtcccatatccctctccggaagcccgcctcccagtctctcggtgttcttagagatggcgaaggatggggttgcagcaccagaattccagaatcggaagtaggttctgatacgtgttcagcctttggcagctgctactgtagccttgaaagcctgatgctgcgtgtgaatccggatggggagcttgtggggacgaccatgaagtggaaacgcatgtgaatgtccgtgttcaggggttttatttcagtttagtcaccgaggaatatgggtgtgagaaagagacccttgggatgtcaaaggttaaggcttagttttaagagtttaatgactgagggtcccacggacagagcttgaggtctatatgttcacttttcatgagtctcagtaatagaaaactggggaaagtgtgtctcagtgaatgctgttttttgctcagatttgcaatttaatatggggctcagatacagagaagcccgagctaggaagaggagtggcgtgaatgaaaggtctagggggaggagtgtcaaaggagtgcctctgtggtaagttttaaattgaatttgaaggcaattttatttagaggaagacggggcttgtctgtgtttgagaatgtaatgaggctggaggctttcaggtgtgcagttgaaggttagtggttgctttgagactaactggatgctggaaacacttcctgtcagtctttcaagtccaaatctgtcctgaaggtttctatttaaaaactttttcttcctaggtccactattctcattgtacccataaaaatcagagtaattcagggtgacgaagtggtgtctttaccgaggagtcttgctctgtcgcccaggctggggtgcagtggcgcgatctcggcttactgcaacctccgcctcccggattcaagcgattctcctgcctcaggctcccgagtagctgggattacaggcgcgcgccaccgcgtccgggtaatttttgtatttttagtagagactggtttcgctttgttggccaggctggtctggaactcctgacctcagatgatccgcctgcctcggcctcccaaagtgctgggattacaggtgtgagccaccgtgccccacttcactttcttaaatgttgtgtttagaagcacaaacttaaaaaaaaatcaagtccactttattaattttattttgttttgtgggtcatcctttactctcctctcagaattaactcacgtccatgaggattatctcccttttccttctctaagttttatactttctcttaaacttagatctatgatctattttgagttaacttttgtgtatggtttgagggtcctaactcatttttctggatgtggatatccaattatcccagtgccgcttgttgaaaagactattcttattgaattgtcttggcacttttgtcaaaaactcttaacaatatttttatactctcaattctggctctgctcttcccattggcacctttactaaaagtggcctttctaggaggcccaattcctttagtctgtcgtggccaggctcacatcgtaattcattctcaaaatctcttttctctcctctcctctcctcttttctcttcttttctcctcttttctcttccttctcctcctcctcttcctccttcttcttcttcttttttgtaaataataatcattttttcgaggccaggcgcggtggctcacacctgtaatcccagcactttgggaggccgagacaggcagatcacgaggtcaggaggtcgagatcatcttggccaacatggtgaaagccagtctctactaaaaatacaaaaattagctgggcgtggtggcgcgtgcctgtagtcccagctacttgggaggctaaggcaggagaatcgcttgaaccagggaggcagaggttgcagtgagcccagatctcgccactgcactccagcctggcgacagagcaagactccgtctcaaaaaaaattataatttttttctttcttcaccacccgcccccccgaatacctgctatttttctgttcttaaaaaccgcttcctgcaagctaattttcgccagacgctttcccgtgggtgtctgcctacctgatgtgttgccttttccctttctacctgatctgttaccttttccatttccaattcattctctgggatacctacacctggctgcactgttacttgtctttttcaaaacctttttttttaaatttaacaaagtggatggaaaagcgctaaaggcaatttagcttgccccatatttgcctgataaagcctgagtctctgaaaatctgccccctttcgcaagactttaagtgccaggaaacgaggcgatttcagtgacttctcttcttccctggctcctggctcaaaaacctgccactgccttctgtgcgtccaattttcaaacatggctgccgtcaggagccacggctatgggcgcggccattttacagagtaggaaatgccgtaaatgcgcttgtccttgctcttttaaacattttaggttctcctcggccgccgtaggtggaccataaacccgtgcgaggactccagaagtaggagcagtttacggaagtgtaacgttgaggcccttcttgtgtatctggagaaaatagaggtcagtgtgtggttttgtccctgaaagttttttgtcctagttcaggttttgtctcagtggaaggtttgggagatctgaggacgtggtgtaccctggaccacatagtttttggcaggaagactggggagcgccggggtataggcatttgggaggtacctggtgggagtctgtgatccccctgtctgtggtccgcgtgcctttggtgtgagtacagtgactaagggtctgtagtgatcaacggccgtgtcctaactgtcaaggtatggatcactctgcttgtaaaggatggaggtggcgattaggatcgatgcggcgtctgcttcgggttcaggatttaatttggaactcagtgatgttggagtctgggaggatgtccatcgctgtagagtgtctggtccgtggttcggatgagtaagaggcatggggccagtgtctgtggtacaaaggcttgtgagggctgaagctttcgagactttggagccctgggtcctgggttgaggttcgaacctcggttactggggcaaaaggcgacacagcccccagcattagttcgaaaccatatatctactcttctgatccttggggtggctatttacagatcggggggtcaagttcagtcataccctccgattatatattgtctatggctgcaaaggcagcggttgagttgttgtgacagagacctcgtggccggcaaaatcgaaaatgttgccaacctctgcattcacttcttttattttttatttattttttttattttttgagacggagtttcacttttgtctcccagactggagtgcaatggcgcgatctcggctcactgcaatctccgcctcccgggttcaagcgattctcctgcctcagcctcctgagtagctgggactacaggcccacgccaccacgcccggctagtttttgtatttttagtagagacagggttttaccacgttgggcaggttggtctcgaactcctgacctcaggtgatccgcccaccttggctttccaaagtgctgggattacaggcgtgagccaccgcgcccggccttcacttcttaatatatagtgagtgttgcttgcccgccttatattcacactttcttaacagaatctccatttcgtgaagtattcatccctgtggcaaggcgacccaaatcccagtttcttagtaaggccttgttggtcttagccaatcttgctggttccaattgccattgctagtgataggtttgacatggaaatgagcttaggcgtatggtgcaattctagccaactatgtatgtgaaaatctgcctgggagtttctgagggagcattttcttttttaaatatgtaatttcttgaatctctttttccatgttcgtgatgatatcgcctgaaaataacattaattttctgtcttactttgtaatgcttataattcattcttatcttaatgcattggctcaactttccagtataaagtaggaaaatagggtgttagtggacgttcttgttttattacccacctgtaaaattcacccgttgtgttgtctggagttaacacctttcctggaggtaaactgtttggtatggttgatctcttcctttactttgttaatttttctacatttatatattttaaatgtacaatttaattatcatggaggcaatatatgtataagcagtcattgcccaggtcaagaaatagaatatggtcagcacaccagtggtgttctgtgagtctttttccattctcacaccgaaaagtattttaggcttttctttatataattaatcattatttatcattgtagttaatacagttttgcctattttaaactctgtatatcagtggaattgtacatcactctttttttgtgtcagccttcttttgctcattattggtgagggtctttcctgttgcatctgagtatattttctttgctcaat

SEQ ID NO: 12266 - DNA, 387780 bp, Homo sapiens
  misc_feature (1)...(387780): n = A,T,C or G, or insertion/deletion polymorphism (see Tables 1-2)
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgtggctttaatttatcgagcactggcatgaatattccttccaattttatattttagacatgcctccagtggcattttttgggaacttcgttggtattatactaggagcaggtgattcaaagtaaatattcccagtctagagagtgagatggacactgaagagggacagttcctcaagaggtgaagtgacgtttgattcactgcatgactgtgtgggaaaagggaatccccaaagttctctcagatggtggcccatgagtcaccatgtagacaatggtggggcgggtgctttgtggccaagtgtagagacttggagaaggattggagaagaggttgatgtggtaggatgtggaagggatgggagccaggggcttaagatacaggggcacagtgagcagagactagattgaaattgagaagaaggtaggtcttaatcctgccaccaggaagatgagatttgtgagttgtgctttagaaacatccctctgttggggctcagctgtacctccttcacctccaggttgtgttggcctccctgtgcattgcattgagaggatattcaaactgaaggggagaagcacggattctgaaggatgaaaaaggaacaatgtgagttattccatgtcttagagatagtgtggtatgacagagagagtgtaaactctggtatcacatagtcctgtgttggagtccttcatggaatctggctctgtcccttgcttggtgaccttcggcaccttttttctgagcctcagtttcctctcctttccacttgcgctgccaataccccctgcagagtatggtggagattaaattgggatyttataggccaagtatgtggcatctgagaggccctgaataaaagtcagttgttctacactgaaccctgtccacatgtgggattctcggcaagggcttattggtgcttgtgaaacctaattaatcagaggtgggaagagagagctggcctttggaagggcttgcatttcataggagtaaacacactgtcaatatcaagaggagctgagtccctgggaggaaggggtgagacatggtggctcctgggaggccatgataactcttactggcaggtataaccatgaagtccccattgctctccggttctttaaaatatcaagaaaagcaggtaaaggcttctcagctctggatggcttaaaaatagccactgaacagagtggccaagctgttttccccatgacctggcacctgaagtcccccttcccacccactcctgctctgccgtctctgcccagtaatgactcctcatgtatcctcatcctagacactccagctaggaaccttgatatttattccatgcatatttgtttgcatttacattgcatgccggtggtattctaggggcgggacaacagtagcaaacatgacagagaaaaatccctatcctcatggactttacattccagtggggcaacagatagcaaacaaacatgaaacggatggtgtgtgagacgacaaatagtccttatggaagaaaaatcatctggagaggaggctggggcatgctggggagggtgtgcattgttaaatggggtgttcaaggaggctttccctgagaatgtgacactaagcaaagacccaaaggagctgagggagtgagcacacggcagtttggggagaaacgattcctaggcacagggcctgccccatgcagagaccctgataactgcatgcatggcacattaaaggtacctcaaggaagccagtgtggctggagtggagtaagtgacaagaaagttggtgcaggaaaaggttgatggggtggggatgagggcttaaccttgctgggcattttgtggactttagcttttgctctgaatgacaaaagcagctcttggagggttgtgagtggaagaatgatatgagcttggcttaccctttttttttttttcctaaccagtgtattagtttatgctcacactgctataaagaactacttgagactggataatttataaagaaaagaggtttaatcagcacatggttctgcaggctgtacaggcttctgcttctggggaggcctcaggaaacttacaattatggtagaaggcgaaggggaagcaggtacatcttacatggcggagcaggagaaagagagagagaggaggaagctgtcacacacttttaaacaagcggatctcgggagagtttatcatgagacagcactagggggatggtgctaaaccattagaaacacctttcatgattcaatcacctcccacaaggcccctcctccgacactgggaattacagttctacctgagatttgggtggggacacagatccaaaccatatcaagcagtatttgctgtctgcaaatgcttaatgctggtgagagtggaagcagcggcagtggtggggacggctgaactctgaaagtatggatttcttcttcctccctcaactcatccaaaccatggctaagctgggtcagttctaccttggccattgtagggagattgggaggactttggagatactatacatcaagtttgttagtctgtcagccgctttagaacaggaatgtgtcttctttcttaagtgtccttaaaacctagcccagtgcctgacataacttgtaggcattttaaatgcttatgatgattagcctgtcattctctgatccctaagattgaatttggagccatcttcagtgctcccaggatcccccttatgcttaaccttttcaaaacatctgtcactctgatctttcattgtctgtctgttccctctgctggtccatgagcttcatgagacccatgctgttttttgttctttgtgttttttgagacagagtcttgctctgtcgcccaggctggagtgcagtggtgagatctcggctcactgcaacctctgcctcacgggttcaaaggattctcatacctcagcctcccaaacagttgggactacagctgtgtgacaccatgcatggcttatttttgtatttttatttacatatatatatatattttgagatggagtctcactctgtcacccaggctggagtgcagtggcacaatctcacctcactgtaacctctgcctcccaggttcaagtgattctccttcctcagcctcccaagtagctgggattacaggtgcctgctaccatgcccagctaatttttatatttttagtagagatgggatttggccatgttggccaggctgatcttgaactcctgatttcaagtgatttcgcccacttcggcctctcaaagtgttgggattacagggataagccattgcgcccggcctgacccacactgtttgtccactcttttttttatttatttatttatttatttttattgagacggaatctcgctctgtcacccaggctggagtgcagtggtgagatctcggctcactgcaacctctgcctcccgggttcaagcgattctcctgcctcagcctcccgagtagctggaactacaggcacctgccaccatgcccggctaattttttgtatttttagtagagacagggtttcatcgtgttagccaagatggtcttgatctcctgacctcgtgatccgcccaccttgacctaccaaagtgctgggattacaggcctgagccaccacgcctggcctgttttgtccactcttgtaagtgcagtacctgtctctgggcctgctacctggtagatgctcaggaagtgctcttttaaatgaatgaatgcacctggtcccttttatcacctgctgagaagggcagtgtttccagccagtatctcttccaatcccagcatgtcactgggaagattaaattgtttaaaaaaaacaaaaacaaacgctgagcctacaaggtagcctctgggctttttgaagggaagagcaaagtcagagagctgttactgtttgaatcagcggtgctgaagggctcttgggaagtggagtgctctccgaggcttgtctacatggcagaggcatgtggataattgcatcaggagagtgggggctaggccgtcagaccaataggctgggggtgggccggagtcctcctgggctgggagatctgggacagtgttttccagaaattctggttgactgagtttgcctgtatagaccagagaatgggcagccgcagtctcatgtgaggacattttgcaactctcccattttcaagctcagctcacatttattgatttttttttaacctcaaggccttttatagtttcttttgttatccattttaaattatatttttgtaatagctttattgacatataattcacatgccatgcaaatcaccatttaaattgcagaattcagtggtttttaatatattcagagttgtgcagccatcgcyrcagtcaattttagaacattttcatcaccgcccttcaaaaaaaactccatccatactcattagcagycaccccccattttcccaattctcctcccccagccctagataacctttaaagtactttctgcacaattactttttctcctccaaatgtaaacatagtaaatgctcataacagaaaattcagaaagaacaagaaaagataaagaagcaaataatsatcatccataattatccagccaatgagagataaccacttttgtctctctatgctgatatactcatagacacatagtttttgcgaacagtgacatcttacacattcttttcaacttattccttcatataatatatagggactctccttccatgttgaataaatatagatttacatgatcatttttgctggccatggatagatcataatttatttgactggttcttttttaatggacatttaggttgtttctagtttttgcwtgtacatacttgtccaaatacttacttttgacaaattcccagaggtggaatttcagggacaaagggtrggcacattttcaagtgttgtacatattaccaagccaccctccagaaaggtttaccaatctgtatttctatgagcaattttgcaagtatacatttcttgcccgccccaggcattatcaattatgttaatttttgcatagctgatggactaaagataaatgttctttatttgcatttttaaatttaatgctaaagttgaacatatttcccagctatgcaggtggctgatgcaggagaatcgcttgaacctgggagctggaggttgcagtgagccgagattgacccactgcactccagcctgggtgacagagcgagactctgtctcaaaaaaaaagtataaatatggattgtaatagttgttgtaaactgaccgaaaccaatggcgcaatttagttctattacttggtactgtgcttatacatagacttggattctagacctgactttgccgtcaactgtgacctcaggctgcttaacctctgaggacctcaatttcctattctttaaagtgttggaggtgaagcagatggatatttgaggttgtttccggatccatctttatcattccatgttaagaataatagaaggcagcagtggaggaaactgaggcttcagcctgcttactggcttgctccaagtcccagaattcacaaatgacagtggagatttgaacccagaacttgctatgaacccaggaccaagcctcttgctgttccctggctcctgtcccctttatgggaaatgaaccaagatttgtcaagatgattgttaatctccaggcctacttcaaggagtgtgaatcccctccaagaggctgatccatgggagagagttttgggagcacagagaaggaagggtttagattattagatttctaaggacaatggaatcttgacagagacagcttaggaggaactgcagagaagcccgaggcaagggagaaggcgggaaagtacactgtgtaagagacaagcacagcccagggagcaggagccaggaagcgtgggtgatccgagcctgggaatttacttttctatcaaggaattagaaagtcaggcctcatctggaaagggctagattagattaaatcagtgtttctctgtagtcacagtttatatgctcctggaccctcaccaggtgactgtgatggtctggctccagagtcctcatcggcttcatctccacgcccccttcttccctttcctccccttcctccacctgcagctgttgttgaagatgtgcccatccccctcaggcctccacactgtggctcaggttggtctctgaaggcctgtaaggtttgtctacatgatgagctccttattctgagctggagtattcccctcttccaggaggccgttcctgaccagcctgattctgggtagaattgaccaccttcttgtttgtgcccaccccctctaccttgtacatttcactgtctgttttgttcatacctctgtctcccccactattttgtggctttctgagagcagatattcttatattatgtttatttggaactcacaggatttctcacatagtaggtattcaggtgaagccttttttggatgaattaatgaaaccttctgtaattcaattcagtagacacatattaaggagactgggatggtgtattagttagtaatatagtgataatagctgcaataacaaatagtccccacgatgtttattggctcaaacacaagaaatgtttttccttcttcatgtaaaagcccaaaatgtgtatttctagttcggtgggagtctctcatccatgtggtggctcatagacctaggcctctgctacattctgtggccctgctgccccctggagctttgttgctgtcagcttccactggcagaagagggaaggagcctggagaaagcacacccacttcttaaaaaccttggcctgaagaatggcatgcaacatttctatctcattccttagctagaagtctgacacatggtcacacccagctgcaagggagtctgggaaatgtagtctagccatgcacccaggaggaagagaaaacagagttttggtgaactagcagtgctgccacagatggtgaatggggctcaacatcttgtcctctgaggcttggttgaagggatggggaatgtttggcttggagaagcaaaactcctgataaagtgatatttgtgaccagggctataatttgccaacccctagtctggagagatccaaagtccctcccaactctagacactgtgatttttttgttgttgttgttatgcacccagcgtatgcagaacactaagactgttgctggtaggaggggaggagagaggcagaggacaagcaagcttgaagtaatttgcccaaggtcacacagctagtaagggatggagctgagattcgggtccaacaagctggtaacagagcctgcctgcttagtrgctatactgtatgttcctcattggagcccgatacccattctaccaagtaggtattattattgccagtgagggaagactcataattttgtgttaagaggaatgaatgaagtaacttttttttttttttttgagttggagttttgctctttttgcccaggctggagtgcagtggcgtgatcttggctcactgcaacctctgcctcccgagttcaagtgattctcctgcctcagccttccaagtagtgggattacaggtgtgcaccactacgcctggctaatttttgtatttttagtagagatggggtttctccatgttggccaggctagtctcgaactcctgacctcaggtgatccgtctgcctcggcctcccacagtgctgggattacaggtgtgagccaccgcacctggcctcagtacttcatttatatttatggctgaataattgcattgtatggctgtaccacacttggtttatccattccattccttggctgataggttttgggttgtttccacctcctggccatcgtgaatagtgctgctatgaacattcatttacaagtatttatttgaatgtacattttcacttcttctaggtatatggccaggagtggaggtgctgggtcatctgataacccatgttttgacttttccaaagtagctgaaccattttgcactcccaccagcaatgtatgagggttccagtttctctacatcctcgccaagacttgttattgctattktgtgtgtgtgtgtgtgtgtgtgtgtgtgtgtgtgtatttcattatggccagcctagtgggtgtgaggttttatcttactgtggttttgatttgcatttccctaatgactaatgcctttaagcatcttctcacctgctttttggccacataaaggaatctttaagtaggtgtaagctggttggctgggcgtggtggctcacacctgtaatctcagcactttgcggagcagagatgggaggattgcttgagaccaggagttcgagaccagcctggtaaacatagcaagacccccatctctattaaaaaaaaaaaaaagaagaagaaggtggtgcaggcagatgtagggaagctccagggatagcaaagccccaaggctcctgtgtgtgcctagttttgaggagcaaggaggaagagttattggaaaccggagacagcgagggctgtgcgaaggagccctggccagagctgaaacttggattgaggccagcagccgtttcacagtgacccctagagagggagccccagggaagagatcggatgcctcagcctccctctycctccctcctgtcttctgctggggctccctgttgctraaaccaccctgtagcagaggaggagcaagcccttgcactagtccctgaggtcaatttggggtgcagagtcagacggaaaagggaggaccagtggagggggactggcacagtggctgcgcagcttccttttcccgtagttctttgggttcgaccttcctatgttggcatctccccaagactggtagtgagatcggctgcagccgtttttagcttcacatctttcttataacatccaaaagaagggagaaaaccccatttcagaaacttctggacaaaagagaaagggctttctcagaaacctccagcctcatatcttattgaccccaattgggttacatattccttctaaagtaattagtggcagaygatggggatggttttaagccagtgaggcccacacctgggactgtgggcacatgtacttcatgggaagggagatcccagttgaaatcagcaatgaggagcgatgctgggcagaaaacccatagcgccgtgtccttggggagtccttggaccatctgtttgackgaagcctcggtttttttctgctccaccacacactggctggggtgagacaatgcgtgcgggaccctggcctccaggaagggtccctgccctggctgcagggcctgatgtgccatgttcggctcaggcctgctgaacagcaccatttccagcttctgccttttaccaggcctcttagggagggtctcctaagcctctcattcctgtggcccatgtcgctgaagggatgaactgaagccccttccacagcagtgattccagggattgagacttcactccatcagagccacaaggtcagagttcaactaggagtttagggaaggagatctttttgtagattttgccacaaaagaaagaataattaaaaaaaaaaaactcctattttttttggcacctattgtatgattctatccaaataggcaaagctatataaacagaggttatattgttatttttgccgggggtgtgtagagggtggaacggggagtgactgcttatgggttcggggtttcattttgaggtgatggttgcacacttctgtgaattatgctaaaaaccattgaattgtacactttattttatttatttatttatttatttatttatttattttgagacagaggtcacccaggctggagtgcagtggcgctgtctcagctcactgcaacctccgcctcctgagttcaagtgatcctcctgcctcagcctcctgagtagctgggattacaggctcatgccaccatgaccgactaatttttgtatttttagtagagacgaggtttcaccatgttggtcaggctggtctcaaactcctgacctcatgatccgcccgcctggccctcccaaagtgctgggattacaggcgtgtgcgaccgtgccgggcctgaattgtatactttaaattgtgattaattgtatgtgaattataagtcaagaaacctgttggaaaaaaacattaaagaaagacttatgctcctattctctttgttttatttaaggctgaagttgattgctaccttattctctgataaaaattatggtttacaccatctcctttcctctcctctctcttctgtccttgtggccttggggcaagttctcctcccctcccttggtctgtgggtcttgtggagctgacccgctccccgtgtccatctgggcacataagcaatacctggctagtccagtgagtgttccagcccctggccacagaaattagttcaaggatggatgaacagtcagagtcaatcctgagacttttattagaaccaccagtacagcgaggctttcctgcagggattgctgaattgtgtctggatgtaagcctgaaagccagtggcccctttggtgagatcctgcctgaaaatgccatccttcccctgaacagaaatacagagccaacagatgaagactaacctctccctgaccacatcctctgagcccttgaatctagccaggcctgaatttccatccttcctggacttgtcagttttgtcagcccatgcatttgcctctcctttttttttttttttcccctgaagccaggacttgtggggttttctgtctcatgaagcatgtctaggtatgggttctgcaaattcggaccctccagcctgaccccttttcacaacaatctctgaaccgtgagaagggactgctctttccgcccgtatcwcttgtgtcagagcgagccaagaaaactgcttccacagaggaaacgggctgacaatggaatgtcccgacccagcacatgaagtcctttggaagggcccctggaagggcatctgggaaccgcccagcatcctttccatgggcccacagggaacagccctgctgctgcggcacatagtccattgcatttgtgtatgtgtgtatgtgtgcatgcagttggacttgggttgtatatctgtctgtctgtatgtgtgcagttgtacgtgggttgttttctgtgtgtgtgcagttgtacgtgggttgttttctgtgtgtgtgcagttgtacatgggttgtatttctgtgtgcagttgtacatgggtttcacttctgtgtgtatgtgtgcagttgtacatgggttgcactttgcatgtgtgtatgtgtgtatgcagttgtacatgggttgcacttctgtgtgtccatatgcgtgtatgcaaatgtacacagatgtgtgtactgggagctatggcctttatttcttccatttggctatgtattatcccacttgggtcatagtcattcaagatttgatgtgtttataacagaagagagaaggttgccccatcagctcaggctgccgtgataccagaatgggaagtctgatgctctttcccacagtggttgtggcatgtggtcattatgatttctgttttaccactgtggcatcagagtctccgaggagccagtggactttccattaggtggcagcctaagcaggtagctgagccaaatctcctgccccttttggggcactaatgcattctgcctcagactaattccttgtagttctctgtcattcaggggaaatagggttcggaaaggtgggaagccttgattgatttctaagagaaatctagtttacagcagcccccagaagatgacagtcaggaatacctattttggagatagttgcaaagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtcttgtggaaattggttgatccttctaagtttacaggcagtaaaatttctaagaaatggagatggattttcagaaagatgtttgaggactggaacagtggtgttccctggtcacaggactttgtcagggttggctgaaatgtaatttgttgtaggacttccagtggaagggccagtgttaggtctcatgaatattttcctgtagtttttttttttttttttgagatggagtttcactcttgttgcccaggctggagtgtgatcttggctcactgcaacctctgcctcctgggttcaagcaattctcctgcctaagcctcccgagtaggtgggattacaggcacctgccaccatgcccggctaatttttgtatttttcgtagaaatggggtttcaccatgttggccaggctggtcttgaactcctgacctcaggtgatccaccagcctcggcctcccaaagtgctgggattacaggcttgagccaccacacctggctgttttgttttgttttgttttgtttttttaagagacagggtcttgctgtcttgctgtgttgcccagactggagtgcagtggcacagtcataggtcattgcagcctcaatctccagggctcaagtgatcctcctgcttcagcctccagagtagctgggactataggtgtataccaccacaccccactagtttttaaatttttttagagatgaagtctcactatattgcctaggctggtcttgaactcctagcctcaagctatccttctgcctcagcctgaattaccctgtagtttaaaargcatccccagtttcccattttgacaatgcatatagaagtcttcctgatgcttcccttatttgtttttatctaattctgttaatgtattcatcaacagataatttattgagcacctgctgtgcactaggcattttaagagttatggaagtgtgccgggcacagtggcttacgcctgtaatcccagcactttgggaggccaaggtggggggatcacctgaggtcaggagttcgtgactagcctgaccaatatgrtgaaatcctgtctctactaaaagtacaaaaattagctgggctgtggtggcgtatgcccataatcctggctacttaggacgctgaggcaggaaaattgcttgaacccgggaggtgaagttgcagtggaccaagatcttgccactgcactcctatctgggcaacagaggaagaccctgtctcaaaaaaaaaaaaaaaagagttatagaagtgaacaaacaatattcccaccctcataaataagacacgtatatcaagaaaaaagaatttcattgttaaatagatcatgtactttggctgatacatttgcaatattttgaggctagagggccaaataattggccaagagaagcatcagttatgtgtgtatttctggatggaaatcacaaggcctgattcacagcaggcacctgagtttaatattattaatgccagttttacagatgagaaaactgaggttcagagaggtaaggtggcttgtccaaggctggtagagggaagagccaggactctcaaactcttgccccttaattctgaaaccctggnnnnnnnnnnnnnnnnnnnncctggctttttccttctgcttctctgcacctttcaggtcaagaaccttgtaaatgcaaatctgcctgtttgtataggtggtaacaaggttttagatggaagcacagacttaatggcttgaaacaacacacatttattatcttaaaattctggaagtatcgtcattgtgccttggacatggcagatgggtcagcaaacattygtccartgaaaggtctttctaagactgtgcctttgaacctactgttctgtccattcagaattccctcttcctacctttctgtctggtgtactcctgttcatcctcaaaaccagaagctgctactatgtcccccatgaagccactcactatccagtcctctgtattattttctctactttatagcaacttctgttcttgcaggtaccagcaatcatcgattcacctgtctgccttacagcagaggaaaatgcctcacttgggtgggctcctcataggcaactgttggagtgttacataaatgaatgaatgaatgaatgaatgaatgaatgaatctggcaaaatagaagatgcagtcaaatatatatttcatattttaacaacataatcggcactcattagatgttatctgtggactgacaagtgaggaactgatctcctttttttaaattaaaaatgcagatatatagggattccatgagatttcagagccacagatagatggtagtgggctgctgtgtggggtgaaactttatgcaggcacagatatgctttgatggatttttggggaagtctgaaggagatgattcaggctcctcatttttcaaacttacagtcttctaaggcctgatctgggctttatcttgatgagatttgaacatttcttagatatactttatttcctttgattctgagatgtctttgatttcaagatgcattattgatatcatagcagtgttgggagagaaaatagttctgccacattatattttattgataggagacacgtcctgtttcagaaatgctaaaatgtgaaaatgtggtcatcataaaatggaggaaatacggtaattacaaagagtgtggtcaagtgggctgatgttaattggacctactcctaagtgttaggaatgagctcgagcgaggctggtcttgttagtgtgttaaagatctttttttagttctaaaactagaagggaaatacatgcagcagagacctctcctgaggctggccctgctctgaaaggctggtgagatttaaaggaaagataagtctttgtaatcagacagacctaggttccatttattagctgtaaaaactctggcaagatactcatcctgtatttgcctcagtttccttctctgtaaaatcaaacagcaatacctgttgcctaggtttgttatgaaggttaaagaagttattgcttgtgtagttagtgtcagatacacataataactatgcaatatatgctagctttgttatttttaaaaattgtggctgggcacagtggctcactcctgtaatcctcacactttgggaggccgaggtgggtggatcacctaaggtcaggagttcgaggccagcctggccaacatgtgaaacctcatctctattaaaaaattagccaggtgtagtggcatgtgcctgtaatcccagctactcaggaggctgaggcaggagaatcacttgaacccaggacgtggaggttgcagtgagccaggatcgcaccactgcactctagtctgggtgacaaagcaagactccatttcaaaaaaaaaaaagaagaaaagaaaagaaattgttatttattctgctagactcgtattaggtcattcttgcattgttataaagaaatatcggagactgggtaatttataaagaaaagaggtttaattggctcatggctctgcaggctgtacaggaagcatgatgctggcatctgctcggcttctggggggcctcaaaaaacttaaaatcatggtagaaggtgaagggggaacaggcacgtcacatggcccaagcaggagcaagagagagagcaaggcgcaacacagttttaaacgacacatctcacggaaagtcactcactcactatggcaaggacagcaacaaggggatggtggctaatcattaatgagaaatctacctccatgatccagttacctcccaccaggccccacctccaatactggggattataattcagtatgaaatttgcactgggacacagatccaaactctatcagacctgttgttatttattctattaaaattgttatttatcctgtaagggctgttgtttcctctgtaaagtgggatgacattcctagctgtacctctcactgctctgggctgggtgaagactcagcgtgattgaaaggggctatgtggccgatacccatacagggcctgcgtggtacctggtgagcactgggtaatgggggcttcctgcgagggagtaaactcctttccatgcagacccctttccatcctggttcccttttctttggacagggtggaggctgggacactggggtgctgctcctggaaggtgacttccaggccttggttgtattctctctgtcactgggacagtggtcagtggacaccaacaggatttccagccacataaaacatgcctatggtgctggccttgctgggaagccgctgagtcaggcccctgggctgcagatgtcatttctagttttgggctgtcataatactggcagttgttcattgtacacctgctttatgctggcatttctacacttatacaacttcctttttttcctcctaacaacactctgttaaaagtatcatcatccctgtcttagggtggtttccccaagaagccagcactgagaaaatattggagcatgcatagtttctttgggaggtgatccaaggaaacacaggtggaggaatgaggaagggagacagagaagagaaggagccaacgaatagcatgttatcaggcaggaaactagggtttcattcctctggggacctctcaggttgtcagaaccaaggggcaaggagctgggatattgtttcctgatttccactcatccttgtctgaaggccacagctagaagcattcatttcctggcactccgagcctgtgccttggtggctgagagcaagctcttggggcagagtggcaggtgttgcttgcagtaagatgcacctggcctgtaatgacctgtgagagtcaaggcattgtgtgtgggcatcatcatagtctgcagaaatctccatttttcagaagaagacacagggctgggcccagtggctcatgcctgtaatcccagcaatttgggggcccaaggtgggtggatcacctgaggtcaggagttcgagaccagcctgggccaacatggcaaaaccccgtctctactcaaaatacgaaaattagctggacatggtggtgggtgcctgtaatcccagctacttgggaggctgaggcaggagaattgcttgaacccgggagacggaggttgcagtgagcggagattacgtcactgcactccagcctgggcgacagagcaagactctgtctcaaaaaacagaaaaagaagatgacacaggttcccagaagtgatttttyatcactcaagatcagccagaaattaggtgggagagccygtgttggaatgtgtctttctgtcccaagggctctcctctttgctgtgcttgggaaattcccccagccctgggctgcagcatgagggrgcagctgcccagatggctctgcgctcagcatactcgctgagagtgaattcaagattgtttgaaatgaccttgaagatatgatcacacaatgggcagcmcarcagaccctaggctcccttggatttcacattccacacttgcacttcttcccaggggaaccctgaagaaaatgtataatttgtggtggcccagactgggttgagcctgctcctgctggcatgaggaktggattgcgtggctagttagtgagcctagcctccctccgartatagaataaacttgagaactctcaagtttatttcgttgttctcttcttgggggtcccgaggctgtttctctggcattcacttattctaagagtcacaaaattcttaggatgtaactttttaaaatgctgaggatttattaatcgcttatagtaggtaggtcctatggtaccagtacgtgccctttttcttgttgtcggtgaggttttttgaygaaggtcttattccttaagcagagaccacgtctattttgctaaccaatacttccttgatatttagcttaatattttttcttcagtatattagtggatgaatagatgcattttcccagaagataattctcactatgggaagctgtagccaatggaaaatagcatgcagtaggcacttaagagatgtttggaaggcaggtcctatgacattrtgttcacacccagatgatatcactgacaaccattcatcctgtctgtttctatacctgtccctgccccaccagactgtgagctctctatgggcaatgaccttgtgttactcaactcaccctcctcactgtcaggcccagtgcctgcartatactcagagtaggctataagacatgcagtcacagttgtcatgagtgtataatccagcaagacagtggttctggtcttttgggttgtgggtccttcacagtgacctcttctttggagaggaaagacccaaaccatctttgattgttatcatttgaatcaacaaatgaggcgggcggttgggggcagagccaaagctaaggtccagcagcctcggcattgtcagggagaatacctcagcccttcttggctttcttcttggggtgggcttctgcaaggtctcctctgtatctctctgaactgtagcctattggattatcctgggaagatagagttatcagaagggcccatctcaaacacatgcatgctggccagggagaagagggattaggaaaaatagcaggagtccaaagttacctggcctgaggttacagatgcctaaatcagggctgatcagggttggtagggaggcaggacttgttgcttgccagcagatayggaaactgaaagacctagcgattagtacaaaatccccaygaccaattcaaatggtctcagcatttacattcaagaatcaccacaggagaggaggttttttgtktttttttttgagacaccgtctcactctgtcacccaggctggagtgcagtggcgcaatctcggctcactacaacctctgcctactgggttcaagctattttcctgccccagcctcccaagtagctgggactacaggcgcctgccaccatgcctggctaatttttgtatttttagtagagatggggtttcaccatgttggccaggctggtctcgaactcctgacctcaggtaatccacccgccttggcctcccaaagtgctgggattacaagcatgagccaccacatccagccaggagaggagatttgacttacctctatgaacaatcaggaaatgataccaaatggggtgtgtttggtcatgatccatagtgccttgcttagcacagcagataaagttctgagctttgaaatcgagctctttcaagtttgagttctgagtctgccaccactaaccagctgtatgacttgggaaatgttatgtaactttggtgagcctcagtttccttatctaaaattcagacaatcacarttccttgcaaagttccttgtaggatttaatgaatgtgcctaggatggggtctgatatgtaaaagggttcttcagagaaacagaatttataggatatatgtaaggggatatttattatagggaattggctcacccttataataagtggaattgattatggaggctgatctgccatctggaagctggacaaccaggaaagccagtggtgtaattcagtcctagcccgaaggtctaaaaaccaggggaamtgatggtgtaaatcccagtctatgtttgaagttctgagaaccaggagcgccagtgtccaaaaaagaagatgcatgtcccagcycaagcagagagcaaactcacccttcctgctactttctgttctattaatattatgccttcaatggattggatgatgcccactcacgttgggaagggtactcttccttactcagtctcctgattcaaaggctaatctcttgcagaaacaccctcacagacacaaccagaaatgctgttttaccagctatctgggcatcctttagcccagtcaagttgacacataaaacaamaataaggggttgctatggttattagcagtgctgttagagttcacaagtggatagattactgggctgggaaagtttgagagagcttcctggaagaggtggaatttcaactgggactagacaagttgggcttctgatcgcttaagaggaatcgtatcacaaaaatatatttggtctattttctttaggtccctgattttctaagtacagcttccacagaacaggaaagaattacatcagtaaataggaaaagtgcttggtttgatattatggggaaaaaattgtccaagctgtaaccagctgcagatgactcaagagtttataacatcctctataaaaggatacaaatcccaacattcgtggagtcacttctgttgaataaaaaacacctatttgaggaatggcaataaagaagggtttatgtaccaaatgatttatgtccccgattcctgcatggcatcaggaattcctgtcctgactgacaaactgtaagtcgtagaacagaatttcagtggaaaagcagaaacgtgggtggtaacaaatctgatgcttgrtggtaatgaattctggttcactttagcaggcaggtgctttaaatctttctgtcgctggtggcagcgggaaatgagaggttgtacagaagaccgtgggggttgacagacattgttcactcactccttcgacagatatttattgagmgtctatgtacagatgctgccgctcccctgctcatgtctttgagtgctccccggaaggcactgcagacagtgcycattcacacagagggcttcctgcatctcagcctgagactatgccctggttgtgtctgggcagttagggatggaaggtggcaggtaaatgccccagattcctttcccttcggtggggcaattctgagatgtgctctccacagtctctcagaaggtcccttagtgggattgagcctgaggtgcccaagcaataaccttggacacgttcctcaatgtctgagtttcagcttcttctaggataggtatggggattaaacgaggcagtaatatcactaccaccacaactagatcccatgcattcatcagttacggggagccaaccattttttgcttagtgctttaatcatgttctcttattaattcttgctatgactgcatgaggtaggtactttccttatggttactagctgtgctgtaagagttcagaaatggacagattgttgcgctgggaaaattggagaaagcttcctagaagaggtggaatttcagctcggactggacaagttgggcttcagatagcttaagaggaatagcatcataaaaataagtttggtctattttcttttaagtccctaattttctaagtacagcttccacagaacaggaaatccaattttaaagatgagagaactagggcaggcacagtggctcattcctgtaaccccagcactttgagaggccaaggcaggtggatcacctgaggtcaggagttcgagatcatcctggtcaacatgatgaaaccccatcactactaaaaatacaaaaaattagctgggcatggtggcacatgcctgtaatcccagctacttgggaggctgaggcaggagaatcrcttgaacctgggwgacggaggttgcagtgagcagagatcgcgccactgcactccagcactccagcctgggtgacacagcgagactctgtctcaaaaaaaaaaaaaaaagaactaaagtatgaaaggataaataactcatcaaagattcataatctggattctaacccagatgtgtttgttctaggggccaacttttaataagtcatactgttagagtacaggatctggcaaggaagctgtcatcatcattatcatcatcatcatccagtgcccagtactggatgtgggtgacccatgtttatggaatttaagaataatgaatgaatgaatgaatattagtcctttaagatcatgaactttcttttcttttgttctttgctctgtctttaggcagcaggagcagtccctggcacagggtagttccctgcttctaagaaaattatggtaattgaaatgtattctttgttttacccttaacaacaacaacaacaaaaaaccaacagaaagaaaagagtcccagaaatgaaatcgccttagtataggaacagtatttatcttcaggtattgggataataattgattttaattttatgccttaatattttttctgatgaacctagattactttcttgactagtataggaacagtatttatcttcaggtattgggataataattgattttaattttatgccttaatattttttctgatgaacctagattactttcttgactagaaagaaataatctctgtttgaataaaaaatcattctcagagcatcagatgggtctccaagtgccgtgggtgaggtacggacatagacgtagctgctaacctacttcgaattagttcagagtcaaggcagcagaatgtgaactgactatggtgtcacacctcacacagctctttcacacttcatctctctgaaggttcacgatggtctagtgacgtaggccaggctgggattagtggcctcatttcataaacctgagggctaaagaggctcgctgacaagggtgaagctctccataggggtggaattgggactggaacttttgatgttaggcccagtggccttccccccgaccccagcagcctctcatgaagacccactgaaggaatgggacaagagtggaggtaggttggtacatcacagactcatggggcagcatctgcaagacccttytatgatttatgcagaggaagcctggcttggagttttttagaccacccrggtcaggatcttagttctgccrcacactgtcttggacacgttatttcatatcttgtgagttatgatttttttcatctataaatctggcccagtgtctcccttgcaggattgttgtgtgagtccarctggcaccaaggaggtgggaattctgcaagaacagctgtcagtggtcatcatacttgtgctgtctatgtgcatggctttattgatactcggtgttcataaattaatattcccatgtgaattaggcagttttttctgagtagcaaaaacctcaggatttcagaggcttgtttgacagcagatatgtatcttcatgctcaaggatctatgggttggttgtggtttggctgatctagttgcatggctggttcatgccggacttgtggttgattgggatctgctccacatgtctttgatctgagttcagactaaaaggcagcaacagacagcggctatggagacatattccttttgtggtgcatcataagagggcaagaggaatagacttgggaacagcacactgtcacttctagccacattccattggctacagcaagtcagtgatccagtccagaatccagtgggacagggaagtaaacaccattcactctagtgggaagtactacaaagtcccatgacaaagggcagaaatgtgtagttcacagtcatgttggaagtgaactgggaagactcatgcagtctaccatactaactcagctgctccacttgggtgaagcaaggaaagcaaaagaataataaactgaggagcaggctgggagaggcattgactatgtatgcaagtaacagatacttatttttcataagcgtgtgcttagtaaagttgggttctggaggtcaatattataggaagatcatgatctttgattctgaaggatagcatatgtttatccttatgccagtaccacactgtcctgatttctttcaaagtcaggaaatagaagtccaacattgttcttcattttcaagattgttttggctatcctgagtccattgcatttccatatgcattttaagataagcttgtcagttccccatctaatttaaatttgtgattcagtgctcaggaagattcaattgctgttggcatctaagtttgaaggaaatggtttgatcgtttatccaacaaatatttattaatattgttgtgccgggcattgtagagttggtgctgcaacatacaccaataaacaaatccaaacacaatctttgtatccacatggcttacaattgaagaaaattagcagatattaatcagtcttcacgttgaaacataattaaaaactgagataaattccatgatctaatctgaagatgcagagtttctctgagaatataatatttaaggaagtacaggagttacctaggcactgaagatgagagaggaagccttccagacagagagaacaacatgggcaaaggacctgtggtggaacaactgcagcatgttccaggatctaagaaaatgtccaatgggccgggcacagaggctcacacctgtaatcccagcactttgggaggccaaggtgggcagatcacctgaggtcaggagttcgagaccagcctgctygacatggcgaaaccctgtctctactaaaaatgcaaaaaagtagctgggcgtggtggcggacacctgtaatcccagctacttgggargctgagggaggagaatcaattgaacccaggaggtggaggttgcaatgagccaagatcgcgccactgcactccagtctgggcaacgagtgaaactgtctcacaaaaaaaaaaaaaaaaagaaaaagaaaaagaaaatgtcttatggctacagcattgtgcctggtagacaggataaggtcagagaggtgaacaagastcagaacatgttcagtgatttggatttttattctaaagcactgagaagctgttgagggatgttaagctagtggtggagagttgagggatgacacaatcaaatttgtgttttcaaaattgtattcttcatatcactcaattgttaagtgtcagtcttatttggatctgggttttttaaaaaaaaacacttgttaaagacaccatttttgacatttatgagactattaggaatttgaacactgtgtgaatatttgatgatatcaaggaattattgctatctttttaaggtatggtagtggttttacagtgttatttttttccaaagaccttatcttagaaatccatgcggtaatatttatgactgaaatgataagatgactggaaatttcctcaaaataataatgcacgggcaggaaggttgagggtttggatgtggtgggtatgattatgggttaatgtgattagactggctggtgggttcagggggtatatgatacacttctctgtttttatgtctgtacacaattccctgtaataaaagattwaaaaaaaaaaaaacccacaaaagattattctgctttcagcatggaagactagatttcagagggagaaatggtgatgaggggagatcagttaggaggcagctgcagtggcccaggtaagaatgatggaggcttggtccagagctggaccagtggaggtggggagagataartggagagatctttaggaagtaaagtagacatgaattggggatggattggatatgggggtgagggagatggtggaactgagatgtctctcggtttttygccctggatggagatgccacaytgagctaggaatcactggataaaagccaaggaggtcccttggctcaatttatttttatatccccacctctgtttccctctattctgcaaatattgaagctgttcccttatgtaacatcttttatcccagacttcctgtgctctgtgcactcagcaattaattaagctttggtatgcatgaattaattaaaatcctctcccaggttcagaggggctgtcctgaaatatgtatattcttctatatctgccttcttcctgcaactggtttcctttgccgggtgaacacttttgctttctcgtgggcacccagctgcaggtgtctgtctgtctgtctgtcgcatccatcagcacactttaattttatgtttaggagcctaggtctagagaagttaatgacttgtaaattgctctccaacgtagagctagaaatagaatgccagaaggattcctgagcacttacttgcacagagattcaatgatggaggtatcagccccaccataggaagctgaaatagtagtttccttcatatttctggacagccactctgtggtgcaagaacattcctgacaaaggtgcagcctccatatgaaatccgatcttggtctgagacaatgtcttctgcccagtttcaccggatgactcttgtcccctttttgtcctgccccctatccaggtcgttttctgatgtgacggctgagacatgagatcttcagcctccaggctctccagtttttcgtcgagagattcactatggaatcggtgagtgatctctagcccatcctgtccagaaaactcggcgtgggagayacagcgggattcttcttgggagttgaaatgcaaaattttatcaaacacaagcactggaatctaacagagactgtgtgcacgattgttattggagaacagatctctagcatttgtacaggtgtagacygcctactatgttttctgtcacattatccattgcctttatttataaggaaagttgtctgggtggtggtgcctataagaagtcaagagtagcaacaacagtgacaccagcaacactataaggtgctataggagtccactgtgttttaggttctttaaaaacatttcaggctggacatggtggctcacgtctgtaatcccagcactttaggaggctgaggtgggtggatcatttgaggtcaggagctcgaaaccagcctgaccaacatggygaaaccttgtctctactaaaatacaaaaattagctgggtgtggtagcatgtgactgtaatctcagctactcgggaggttgaggcagtrgaattgcttgaacccaggaggcaaaggttgcagtgagccaagattgcaccattgcactccagcctgggcaacagagtgagactccttctcaaaaataaaaattaaaagtacaataaaataaaatttcatttactcctcccaacaatcctgccaagtaagaatttctacattcagttgggtgcagtggctcatgcctgtaatcctggcactttgggaggccgaggcgggagaatcacctcaggttaggagttcgagaccagcctggccaacatggtgaaaccccatctctactaaaaatacaaaaaattagccgggtgtggtggcaggcgcctgtaatcccagctactcgggaggctgaggagggagaatcacttgaaccccggaagcagaggttgcagtgggccaagatcrcactgttgcactccagcctgggggtcaagaatgagacttcgtctcagaaaaaaaagaatttctacattcattttacgggtaaagaacttgcccagctagatgtaagtcaattttcccttactgcaggacccttgccttttttttttttttttgagacggagtctggctctgttgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcctttttttttttcctatgccacgttacctcttgggagaggtagagatatgatttattccattttgcagctgggaatactgaggcctggtgtagggacacatgatgaagagtctaaggagtctggcctcagtggatgaaagtttgtgttagaggatgataaaaattagactggacaggaagaaccatgaaaagctaggccgggaaaacttgtagagtctgagaatcttaaaaagctggcagactgactggcacagggttgacctgttggggccagggtttctaagaagtccgcgtaryggaaagtgtgtgggtgctagaaggggtggttgaatcctggccctggcactgatttgctgtgtgatctcacacaagacaccggctttcggccaggcgcgatggctcacgcctgtaatcccagcactttgggaggccgaggtgggcrgatcacctgaggttgggagttcgagaccagcctaagcaacatggagaaactctgtctgtactaaaaaagacaaaattagctgggcatggtggcacatgcctgtaatcccagmtacttgggaggctgaggcaggagaatctcttgaacccgcgaggcagaggttttggtgagccaagattgcgccattgtactccagcctgggcaacaagagcgaaactctgtctcaaaaaaaaaaaaaaaaaagacactgactttctctgtttcttctgttttcttatccatgaaaaaggggtaatatttatgtttcagattttttttgtgtagtttagaaaaaatgtaaagtattttacataaagtaggcacatagggcattgtaattacttcaatttttaggttgaaaatagtttttaaaggatgattagataagcaaatgtgtcctgaatgggtggatgaagtgagaggctggaggcrgagaggccaacctgagaggcttttgatatgatcgagacatgatactgccttccagggtaaatgaagctttacttttattttcaaaatttttctattataggattacccaaagtcatgtttattttgtttttttctttttttaagtcaagagtccagcacaaaatggcattcattttrcaggtatcttttcaggtgatattaattataattgcaataactcagtgcattattagaattaggttttgctgacaatgacataaaatctaaaagaacattggcttagagaagtgtctctcttacctaaaagttcaggtacaagtaacacagattttctacagcaatctgtgagagacctgggctttttctctagtttgtttgccatgtgaacctctattcccaaggtcacctcacagccccattttagctgcttctgctctagccatcacatctaacagcaggaggaaggaacgagacagagaaaggcaygtcccatcctttaaggatgtttcctggaagttgcacctcctgytcctacttatattctactggccagaatttagttctctggctacattttgcggcaragaaggctgggaagtgtaatctttattctgcaagactgtgtgcttaccaaattgagagttattrttatagaagaagagagcagatattggaggacaaatcttttcctccacactactcattcttgaaagatcgtgctgacaggataggctctgcagccagcctgctggagtttgcattctggatccatggtttcgtagttctgtgaccttgttgaaaagctacttaacttctctgtgcctcggcttcttcctgttctctcctgttttatagacttacaagggttgttttgagcactagttgagttaagctaaagcacttggaacagtgcctggtacatggtaagtgctatataagttctagctattatgactactactattgctagtagtatctctctagtacttctactactactgctactgccacttctgatatgactactgctacttctgttacttattactattaatacttttactcttaccatgactgctgcttctactaatattaccactactgcttctactgtcacttctgctgctgctactactgttgtgactacttctacttctcttctactattattactactataccattattatttttaaattgtatactcatagcatagtaagtactatttttcccaatagaagataagagtcagagaggatagtaacttgtcagatgccattcatggtctacccttgggtgggtaggggatagcgacttgaaggaagcataaggcaggtttctgtggttgtgctaatgtgctgtttcctgatctgggtgatgtttcattagtgtaaaagttccttgcatgacacacttatgacatagataattttgtgtatgtatcttatatgkcaataaaaacatgtcatgtagctgaaaagtggtggaacatgagtgaaacctacactcgcctgattccaaagcctgtgctcttagctgtaacacaaggccagcacctttagtcctctgactgactgattgattcattcatctaacttgtattgataactgcttattacttatgtgccagtaacctggctaggatgcctgggatacaaaggtccatgctgtagacatgaccctgccctcatggggcttcttatctagaggaaaaggaaagaggtaaataccattcagattaccagccaccaggttaggttcagtatgggatgccctggggccacaggaggggcatggaagctaacccagccccacaggctcatctgctgaaataacacagatgtgcttctcaaccaacccctttgwtgggggaaaagttcccacatcagtgggtaagctgaccacaggagggctacatcaagaaatataaagcagttccccccatccyttgcttaactggcactaagaaggggtcagcttttcttgtcttgttgtcactgtcatagttgtgaacctacctgatgttccatggggtaggcaagtgctcgcccttgtgagttcagtagaagacaagggaatcacaggagcagagacttcacttatgaagacgtgtatacagggacctcttatttaaaataaatatacgggctgggcatggtggctcatgcctgtaatcctagcactttgggaggcgaaggctggcggatcacctgaggccaggagtttgagaccagcctggccaacatggcgaaaccctgtctctactaaaaatacaaaaattagccaggtatggtggtgggcgcctgtagtcccagctgcttgggaggctgaggcatgagaattgcttgaacctgggaggcagaggttgcagtgagctgagatcgtgccattgcactccagtctgggcaacagaactagactctttcttaacaacaacaacawcaaaattctcataaatatgtgaatgaatgaatgaatgaataaaatcacagtccacagcaatgcggttgtcatccctgggaaaactcaagtccaagggaataaagaacaagacccgtttcctttattcaccccaaataccataagggagacaggagcgcagcacatggaagtggaattgaatgctgaattctgagccagcagtagaaatcagttggccttatgttcaggtttttctccatatgtagaaaagaagtgacctaaactttagaccctcctcaaccaagcccatgagaaacctctgtgactcctcctccctcttttgcctttccaaatgtcaagcagacgccctgtcattatcatgccacaggctgtcagcccaaattgaatttccctgagcccagctgatgtccctttttggctgcagggcagggatcaggaatgcatgctgcacatggacgggaaacgtgtccctggagctgaatgcagaaggctgacctctcaactctgcattgctaacatagttggaagggttaggaagccttgtgatttctggatgtaaaagaaaaagaaatgtgttttaraaaaacagtattcaagttctgctgcgaaaatcctttcaaaataattgagtctatttaaaattcaactggttgtttcacagcattgactatacttcagttaaatacataaaggaaggaaggttatggctaaactgagagatgggaagtgatgatgctggtcttgtcttcctccctcccttcatttttccctccctgcctttaaaatttattaagcagcgactgtgtgccaggtcctacactcaaacctggggaaatacatgaataagactcatggcaaagccttcttgagcttatccttcatttgtttttagaaaacgtattcattctacaaatgtttcctgagcatctaatttgctcaagtctcttagtagagataaaaaacatggttcctccttttactacatgtatactttattttttgatcacttttctgacgacctactaagtgccagggtctgtgcaagctgccaggatatcaagggaaacaaaaacagcttctgctttgatggagctaaaagactagaaaatgttccattagtttcctagggctgctgtgacaaagtaccacaaacttggtggcttaaaacaacagaaatatggccaggcgcggtggctcacacctataatcccagcactttgggagacggaggcgggcggattacctaagatcaggagttcgagatcagcctagctaacatagtgaaaccccatctctactaaaaatacaaaattagctgggcgtagtggcgggtgcctgtaatcccagcccctcgggaggctgaggcaggagaatcgcttgaacctgggaggtggaggttgcagtgagccgaggtcacatcactgcactccagcctgggtgacagagtgagactctgtctcaaaaaaaaaaagaaatgtattgtctcacagtttggaggccagaagttcaagatcaacgtgttggcagtgtcgtgcttcctctgaaacctgtaggggagaatccttccttgcctcttcgtagtgtctggtgtcaccagcagtcgttgatgttcctcagcttgcagcctcatcactccagttcctgcctgtgttgtcctgcggcattctgcctgtgtgcctctcttctctcttacaaggacagcagtcatactggattgcgggactgcccttctcccatgtgacctcatcttaatcaccaccttaattatatctgcaaagaccctatttccaaataagtccacattcatggatgagggggtggctaagatctccactttttgcaagaggacgtgtcaaacgtatgtaatattagaaagcgcccacagtacctggtgcatggtgggccttgttgttgccttccctttctttccactttatctcagcatctaaagggtgagcaccttgagggcaggaactctgtgttactctgagtgagtgcttccagatttcttgccagggaagtgagacggatgtttttcttgtgctgcggcagggacattcttgtgtggtccctggttgatgggaaatgctctttcttgctactgtccttagtttttgcttcttatgctgatggttgatgagggagtcatggggaaagaataccttgattggaaagctgggcctggtgggtaaagtggttaaaccaggctcctctcctggttctgctgtttgctggtcatgtgagcctggatacatttcctcctctctgtgcctccaggcatctcatctgtaccccttaggagtttgtttgtttgttttgagacagagttatcagggaacctgcccctgatagtcacgtaggttcttttctgttttccctaagcgttggcygggttgagaaataaagagacagagtacaaaagagagaaattttaaagctgggtgtcctggggagacatcacatgtaggtaggttccgtgatgccccacaagccgcaaaaccagcaagtttttattagggattttcaaaaggggagggagtgtacgaatagggtgtgggtcacagagatcgcatactttacaaggtaatagaatatcacaaggcaaatggaggcagggtgagatcacaggaccacaggaccgggacgacattaaaattgctaataaagttttgggcaccattgtcattgataacatgtttgagagcaaccggtctgaccaaaatttattaggcgggaatttcctgtcctaataagcctgggagcgctatgggagtctggggcttatttcatccctacagtctcgaccatagaagatggccacacccaagggggccatttcagagacctaccctcaggggcgcattctctttctcagggatgttccttgctgagaaaaagaattcagcgatatttctcccatttgcttttgaaagaagagaaatatggctctgttccgcccagctcaccggtggtcaaagtttaaggttatctctcttgttccctgaacattgctgttatcctgttcttttttcaaggtgcccagatttcatattgttcaaacacacatgctctacaaacaatttgtgcagttaatgcaatcatcacagggtcctgagttgacatacatcctcctcagcttatgaaaatgatgagattaagagattaaagtaaagacaggcataggaaatcacaagggtattgattggggaagtgataagtgtccatgaaatcttcacaatttatgttcagagattacagtaaagacagatgtaagaaattataaaagtattaatttggggatctaataaatgtccatgaaatcttcacaatttatgttcttctgccacggcttcagctggtccctctgtttggggtccctgacttcccgcaacacagagtctcgctctgtcacccagtctggagtgcagtggtgagatcttggcccrctgcaatctctgcctcctgggttcaagtgattctcatgcctcagcctcccgagcagctgggattacaggtgtgtgccaccatgcctggctaatttttgtatttttagtggagatggggtttcaccatgttggtcaggctgttcttgaactcctgacctcaagtgatctgcccgccttggcctcccaaagtgctgggactacaggcatgagccactgtgcttggccttcctaggagtctttgtgagggccaggtgggatcaaatgtttaaaagagtaccaggcccacagtaaatgtttgctgcttgtttgtgggagtattccaagacttttaataccttccagggagaagggcttccctggcccattcagcacattcccctcagtaaagactcatgctcactgtttagcactgttcaccatcagaacatttcctcatgattttcctaaggcaagtttttcaggaatatggcaaacagcccttgcacaaagatatccattggagcatcatttaaaatggtaaaccgctacaaacaagataaaatcctgctctacaatgagcagtgggttaacaaattaggggcagaaggatgaaaaacaaattagggtaaaataatgcagccattaaaaagaagataagttatgagaacactcataatataactgtcatgttaaaaaaaaggtttatttttgaggaagtgacttaatttctgtgtgcctcggtgccatggtttggatatttgacccctctaaacctcatgttgaaatgtgatccccaattttgaaggtggggcctgatgggaaatgtttgggtcatggaggcggatccctcatgaatgagttctcactctgttagttcccgtgacaactgtttgtttaaaagatcccagcccctcccccacctccttctctcaccatctgatctctgcacatgctggctccccttccccttctgccacgagttgaagcaacctgaggccctcacagaagcaggtgctggcttcttgtgcaacctgcagaaccaagagccaaataaacctcttttctttattaattacccagcttcagttattccattagagcaggacaaatggactgagacactcagcttccttatctataaaatggagatgataacagtactttcctcatacatacgattgttttgagaattaaatgggatagtacctctaaaacacatgaatagtacttggcacatattaggtgcttactaaatactaattgttattgttagttatttatcatgtggtctaaaccatgtgcagaatattcatagaaaaagattagaataagtaacacagatgaatgcacatcccttttccctrttagatgtcttattcaaagggacttccttttgtctgtcagcaaacattgcacagcttctctgtatcaagcactctgatagtctctaaggcagcaggtctccctttaggagtgtgtatgagagtcccttttgggggctttttaaaaaacagatgcttagagatgctgattcagtagatgtgtggtgagtcccaggcatctgcagtcttaaaaactattccacaaatgattttgactctcaaggttgatatataagttacagtctttcccctcaagaagtytgcaaaccagatgagaagatgggacaagcagtggcatgaggcagaacgtaagtgctatagattaggcgctcccaggtctggctccccctgcacaactttgcaaaaataaagatggtctttgttgtaccactagatgtggaatcagaacccacagggtgaagcctttccaggggttctggtgatcagcctggtaggggaccatgtgtgaggactgtgagtgcttcctgtttgagagaacccaggagggggtccctctggcctgggattgtyacaggagctctctctaaaaaggtataatgtgctatctaagaatacattattacatttactgwattggactgaaatgacctgttagatatctattgccactgacatactctgagtgccttgaaggcgggaaccatgcatgcattggtcagccctgtgatagtgcctgcatgtctcaccttggcattgacctctcctgtcccctagtacctgcctaggtgcagcaggatagattgagaaccaaagtttttccaaagctattttytcaaagccatgaggactgatatattttctctggttggtagtagtgaatgctttttaaaaaatctttattttaaaatattttaattgtggtgaagtatgcataacataaaaattactattgttaactgtttttaagaacaattcagtggcattaagtatgttcacattgttgtgcaaccattgccgcgaaatccatctccagaattcttttcatcttgcaaaattgaaattctgtacccatcaaatgacaactccttctcttccctctcccttcccatccctggaaataaccattctactttctgtctgtatgaatttgactactctaggtatcttttataagtggaatcatacaatatttgtctttttgttactgccttacttaacataatgtcctcaaggttcatccttattataccatgtatcaaaatttccttcatttttgaggctaaataacattccattgtatgtacatatcatattttgtttatccagtcatccgtggatgaatacgtgtttgcttctaccttttggttgttatgaattatgctgctatgaatatgggtatacaaatagctccagatcctgctttcaattttgggggggcgggggatatatacccagaagtggaattgctggattatacaataattccatgtttacttttttgaggaacagccaggctgttttccattttacattctgtaccagtttacattcccaccaatagtgcacaagagttcccatgtctccatatcgtcaccaacacttgttattttctgtttttgtgatagtagccatcctagtaggtatgaatgcttgtaactggtgaatgcctttagcgaggacattccattttcagctttgtatttcacttaggttgtgtggcccaattaaacagtctccaagcatttatttaagccctaggcactgagaatacagacctaaataatacatgcatggtacctgccttcacggcactcagagtatgtcaggggaaatagatatctaacaggtaatttcagtccagtatggtaggtgtaatcatatattcctaatagcatattatgccttaaatacagttgaagattccgggaaatcttgactgagtttggtgccttagtataaaacacatgagtacatcattcaggcagtctgagattcctagattgtttaggctggaagggacttgtagactttccagtagaactttctatgaaatggaaatattctgtgtctgccacatgtggcttttgagcacttaaaatgtgcttcgtacaactgagaaacttataaagttcatataattttagggaatttatgtttaaattgaagttagctataggtagtggctactgtgtgagacagagaggtaaagcgaggtaatagtgagcattctttcctggttctcatgcttgaatatgcatgtgggtcacctggggagctgttaaaaatcagattctcaggccctccctttagtgtttctaattctttaagttgtagtagggtcaaggaacctgcattttaacaaccaccacaggtgattctgatgcagacgtagtttgagaaatgccaagtcttgtggttttcaagcttttgtatcctcagaatattttcttcaaatgaaagcttaaagcctgggcaacataatgggaccctgtctctacgaaaaaaaaatttagctgggcatagtagcacacacctatagtcccaggtagttgggaggctgaggtggaaggattgcttgagcctggaaagttgaggccgcagtgagccgtgactgtgccactgcactccagcctaggcaacggaaggagaccctgtctcaggaaaaaaataaataaataaaaagaaagctaaagagctcagtgtatagaacagagagtagagttgttccagcttaggtagttctggctggtaccagaactttatacacgttaggggatcacactctaccctctctggggaaggaactggggtttcttggagtataatttgtacaactctaacctagcacaaccacatcactttattcatcttaaatcctgtgaaatgcaaaataagayttggttttgtaatacctataaacatgccagaaccaattacagaccaacaggcacctctggaaatgcaggttgaagcagaaacacaattagtgcattagtcagccattttttcccttgtcctggactttaaccagccatcttggcatcacatggcggaactgcagagtagtgattaaaaacaggctgtctgacctggcaggaaggcagtctccaccctagagcttactgggtggtgctaggcaagtttccttatctgcaaaatgggtataacagtagcttctacctgagacaatacatgtaaaacccagcacttggcactaagtattcattattgtaacaacaacaacagcagcaacaacaatactaatagctaatgctcacagagcatttaacgtgagccaggccctttcttctaagcacttgctgtttattaactcattcaatccttacaacaatcctgtgagtagatagtattgttatttccattgtaaagacaaactaaagctcacagaggtttggaaaattatttaaggccacattgctggtcagtggcagaagtggaacttggctgcagggartctggccctggagcctgcagttttcacttttactccgtgtgctactatattatccccaggctctaaggaaagcctgttaagatgatcctttcatcccctcccccaagccctagctctaaatctcaaagctttggaattaatctgtaagtcaactcagcttctgcgaatcatctgacccagttgatcactcccttcctctaaaaacacggttttcttttggcttctatgacaccaagccggcttggatttcttcttgtgaytctaccctctcagtctctcagttgggcaccccttgctccaacttacctctaaatatttttgaagatgtctgcatgcaaattatacagacatgcaaattatattatatgcttacaaattttatctccagctgaatctgtcctctgagttccagacttgatgatctgaaatgcctaattaatatccccatttggaagtctagcaggcctctcaaacttaatatgtccaacatggattattctcctcactcctcytgcagctcatgctgcacccctgcttacagccaccgctgatctccaagacccctgcccattttacttagaatgaaattcagatttcttaccgtggcctacaaagactagcatgatctagcccctgcctatctctgtaccctcctctgcctccaccccgtttccccaagaggcttcagcacattggcctccgttctgttcctcacactcagcaagtgctatcctgtctcaggaccctgcttcatgctcttcttctgcctccagggccttgtccctgtacctcctgtcccccactccatggtcgtcacatcctgaagtctcagcttaaatgctatgtcctcagacagatcttcctagccactctagcctttattctctttggttgctccccgtatgttttcttcctagcagttgtaacaatctggaattgtttgttctcttgtgtatgtctgccacccccaccagactataagctcctaatggacaaggtcrctgatggctgctcatctgctaaagttactccagtgccaggcacagagtctggtacatasatgttcagtaaatatgtattgttgttgaaataaaatcaatggctgctgctaagtcaaccatgagcataaaataccaattctaggcctgttatttgtagaatcctttcatggactagacarttttcatatatatatacaagtggttaaaaagttggttgggacttgggctttttttttttttttctgagatggagtctcgctctgtcatccaggctggagtgtagtggtacattagacaattttgatatatgtawacaagtagttaaaaaattggttgggacctgtgcttttttttttttttctttcttgatggagtctcactctgtcacccaggctggagtgcagtggtgtaatcttggctcattgcaacctccacctcctgggtccaagtgattctcctgcctcagcctcccaagtaagtgggattacaggcgagcgccaccatgctcagctaatttttgtattttgagtagggacgaggttttgccatgttacccagcctggtctcaaactcctgatctcaagtgatctgcccacctcggcctccccaamtgccgggattacaggtgtgagccaccactttcgccggacctgggttttttaatgggccttggtctccattttcacatttcttcttcctgggtcatccagagtgttaggatttactgagattctcttaagaaaaacagcagccttggatacccaattcatatgaaagcaggtttgatttcggtttaaaatggaaactgtgagctaatgcattttacagatttgaggagagaacaattttctctgtttttaagaaaataaagaacaaaacgtgggataactttttgtgagtcaccatagtgccacaagctcctgaaaggggttctctgcaaatatttggggtttggtgcttataaacagctacaaaggttttcttgagcgttggtaaccacggcaacaaggacgtcacttccacggtgcaaacatgcttgccaagctgaagtgtggagtgacagtttttggctgagccrtgaacctaaaagtggaggtttacaaagttactgcagacaggtcattagcacgactggctgcagtgagctccctaagtcttcatcgctcctgccttttcatcagcagcgagataattgactgttagactcccgagccacagaccacggcagaggtgagtccgcttctaactgtttctgcagrgtgaggtacagttgtcagaagttcccaaacaatgtgagtttggtaagaggagactggaaatggagttttcaccagtaaagcgacgcgtggcgattgtgtatctacagggtggagagcrcagcgcttagccctgtgtcgacagccctgtgggctgaggccacagtctgaatttgctgtgcccagctgtgttttttcatcaggacagggtgtgggagcgggggcaggcagagcttcaagctatggactcggcaatggaacgtgttacctccgtggtcagcacagttttagttttgggtgatagaaacccaattcaggttgccttaagcaagaagggaatgtactggcttaggtaagagaggagtccaggggtaaaacctggccccagaaatgactggattcctagatttggtctctcccttttctctgcatcaccactgaatctctcgcccccttcctctctagtgctttctcctccactggctgtattctcaggttctccaagtatggtttccagaagcatcggtcctaaagccaccggtttaaagaccccaccaggtagagagctcttcttcccagaagattttgcaaaatctctggattgattcccgttggtctatcttgggtcacgtggtcagccctgtaccagtcactgtggacaaggccatggactattctgattggacaagcccatgtcacctgatcattcccagactycagggagaggttgaaagtgagacccacaggaaccaaaggatgtggggggactccccagtgggaatttgaaatgcattcaccggcaggagtactgggtgctcgggaagtaaaaccgcaaatgcccacccctctaaccaagtaactggatgtagggagagttagtagctcaagttcgaatcagcttccttagcgggctgttgaagagcctctgttgggagagtgatgtcagcaacatggcagaagagaagctcctgactctccctccactcgtggacacaccaaataaacatccattcaccaatcacttccctctgagagagtcagagaccagttgagattcctacccacctggtaactgagaaaacatccccatgtaacgggtcggaaaagctgagactctcttgggcacgcccccacctcgggcgctgagccacaaaattgggaaaggaatctctagcacccagcatctccccatggagaggaggctttgggcctcacaaggcccgccctaactctaaggtgccccacggttggctcttaattcaccaactctggggctgagggaattagacacactcaagtctctgttctgctttggctctattttatttatttatttattttagtggagacggggtttcaccatgttggccaggctggtctggaactcctgacctcaagtgatccgcccacctcagcctcccaaactgctgggattacaggcgtgagccaccacacccggcctgccttggctcttttaaatgaacctcaagcgaccaccagctagcaacgtgccttctgcctctgggattgctccaggccatgtctgtgtagtagaaggaggtgatgtttcccattcccctcttgtagctccttgttcaagctcatcctgttagatcaaagacaatatttggacctcaagccccggcctccatagagccatggtgtgtgtatgtacgtgggacactgtctcgcttttatttatgttcagtctctgcctctctcactagattataacttccaggagggcgggggtcatctcggccttgctcaccacagtgcatagcttggaggatgtagtggacagtcagtaaatgtttgttgaaagaacaaattacaggacaatggggagtcattgagggatgtgaagtgtgacagggtaacttgcccaacattccccagataataaaagacactatcagtggatcacctgaggtcaggagttcaagatcagcctgggcaacatggtgaaaccccatctctactaaaaatacaaaacattagccgggcatggtggcgggcgcctgtgtaatcccagctactcgggaggccaaggctcaagaatcacttgaaccggcgagggggaggttgcagtgagccaagatagcgccattgcactccagcttgggagacaaagtgagactccgtctgaaaaaaacacactatcctccctgaatcccacgtcttctgactcccaatgtcccactttctgccccctgcccagcagtggagttctctgagtaagaagagggggagggtggcacatactaacacagaatggatgcttgtatgcagaccaggctgtaaattacatagcaatgacagctttgatgttgcatctgaaaaggtgtaataaccccttctagcaggtctctctcatggtggaggggaaagtggtttgtgctttattttaatcagcgaggcccttccctgctggtaacttgaggtcattccatctcatctcagaaggtcgtcttgtccttgggttgccataatctcctttggttataaagaggacctggagccatgcaagggtgggatgttgacttgccatctcagtagcacatttaatcctacaggactctggcttcccctatgcaagcattagaataagagttcaggtgagtgtgacctgcgttacaaagggcagtcttcaccatgaaccgtaggaagggcaggtggccagttctggaaaggagccaggagacctgggtccttcttacagcacccagactgctggggagggagacatgggcaagtcctttcacctctgtgggagaaatgggctggtgctcttctgtatcagttaggtgtcttttagtgtcaagtggtagaaaagaaagaaaaatccaaggctagtgctggcttcagggctctcctggatccagggatgccactggtgtggtcaggcctctgtcttctgttgtgatactacatacataaacattaagataaacataaacataataaacattattatcccccatctaacatctccctgctgtgtggccttggacaagccacgaatccctgtgaccctcgtttcctcatctgggaataatattagatcccacacgccactgcagtgaagattaaacaaggcagttcatgagagagcttagcactctgtacctggtgcatggtatatagtaggtcctctgcactgtgcctggttcatagtmgatcctctgggctctgctgtcctctcagatggcctcattttcaggcaggctttctccccttgatggtctctactggttctgtgcttacagactcctggcttgtagtccactctaaagaatttattttcgacaaaaagtctgggatgtggacatgcacccacgctcactggctgcaggcatatgctaccaggcaggaagcactcctcccaggggctggagcctggggaatcctttgggggagaattctgagaagtgagcagtctgcctgccttgcagggaggtttggcaaaaagggaatggggaccagattgaaggtaagatgtcatttccaggcagaagatcgaatagagccttgcaagcccttgttttgagagaggggaaaccaggagagagggaagaccgtcagtgtgtattagcaacatataccatgctcttctgtgcctctgtgcctttgcacatgctgttctctctgctgggacttccttatccactctgcacactcccatgcatccctgagacccaactcttcaatgaagctttctctggctaaagtgaaagctttacccctcccctcccgccccatttccctatcattaattgcttttcttttctttttttttggagacagtcttgctctgtcgcccaggttgaagtgcagtggtgcgcaatctcagctcactgcaacctccacctcccatgttcaagcaattctcctgcctcagcctcctgagtagctgggattacaggtgtgccgccatgcccagctaatttttgtatttttaatagaaaygaggtttcaccatgttggccaggctggtctcaaactcctggcctcaagtgatccgcccacctcagtttcccaaagtgctgggattgattttccatttttgaacaagcatctattgggtggtagcactgcgtgctggggatacaaatgagaatacatgacagtgcctgtgtcagagtgagtttggtccttcctccctgttctgcttctcctttatcagagcagttacttgttacttattcaacacatctttattaagcaccttgtatttttctgagcattggtctagaagctggagattcggggacagtgggagagacaataaaatcaataaataatattaatgaacaaggtgatatctttaatttctttttttttttttttttttttttgagacagaatctcgctctgtcactcatgctggagtgcagtggcgcaatctcggctcactgcaagctccgcctcctgggttcacaccattctcctgcctcagcctccygagtagctgggactacaggcgcctgccaccacgcccagctaattttttatatttttagtagagacggggtttcaccgtgttagccaggatggtcttgatctcctgacctcgtgatctgcccgcctcggcctcccaaagtgctgggattacaggcttgagccaccatgctcggcctgaacaaggtaatttctgatggtgtgtaccttaagaaaataaacacgggtaaagggagaacaagagatggggattagggtgggaggagagtggtcaggaaggagggaccctgtggaataagacctggagagtgacaaggaacaagcatgcagaggcctgcgtgcagggcattccagctgaggggaacagcacgtgcaaaggccctcaggggggtgtgttccagaaatgacaaaaagcagggctgtagtgagaagagaggacaaaggtttggaaagtgaggtcagggagatggacagtggcctggtcatataaggcctttagactaagtcatgggagtagattttattctaagtgccttgagaagccaccgtagtgattcttttctagcttggaggacgcattctccaagccaggcgtcatcctgtcccttaggtgcacaattctccattctcttttggtgctcaaactgtgtcatctaatacagtagccacttcaagtagctactaagaacttaaaatatggctagtctgaatggagatgtcctataagtctaaaatatatgttttcaaagactttgtatgaaaaactctgtctcattaataatttttctttcaatccatgttgaaatgatagtattttgaatatattgggttaaatgacatatgttattaaaattgggccaggcaaggtggctcatagctgtaatcccagccctttgggaggccaaggtggaggactgcttgagaccaggagtttaagaccaacctgcgcaacacagtgagacctcctctctacaaaagatatttaaaaagtagctggggctgagcgcagtggctcatccctgtaatcccaacactttgggaggctgaggcaggtggatcacttgaggtccggagttcaagaccagcctggacgacatggcaaaatcccatgtctaccaaaaaaatacaaaaattagccaggtgtggtattgcatacctgtagtcccagctacctgggaggctgaagtgggagagtcacttgaacccgggaggcgaggtttcagtgagccaggatcacgccactgcactccagcctggacaagagagagagaccctgtctcaataaataaataaataaagtagccaggtgtagtggtgcgcaactgtactcccagctactcaggaatctgaggcgaaagatcacttgagcccaggaggttgaggctgcaataagctcatgactgcacgtcagcctgcatgacacagtgagaccctgtctctaaaaaaatkaaattaatttcatgtgttccttttaacttttttcctgtggctgctgacaatttgaaactccatgcatgggttgcactgggttatatttctgttggccagcactgcccttcaagcaccttcagccattgcttttaccttcatgggttatagtcacctcttgacttgtctgtgctcctccttgaggacagtgaccccagccggttggtggagtcctcaggcaccacattggtgctccccctgggtccccttggcgcaccctggttccctgcaccctgcaccctgcaaaccctcaggctgctgctcctgagggtttctttggcatgctcaggctgcatgcagggcaggtcagaagtgctgggagttcactccccaggagcagccctcagccaaggaaggagcagagttggagaatacacactccatcatcctgcttctcaggtgcacagctctgaggtgtgttctctagcatctcccgaaggtcaccttcagtggtaacctgctctgcagtacacccattgttggcttcctttctgccgctgttttatttccccattcatctagttgggatcacttcccaaatagactccttgtactcagatcctccttccaggctgggcttctgggggaacccaacctgagacctggggtgcccaacaggtaggtgcttagtaggaggagagggcctgtccctccagcacatgtctggtgcaggctagctgcccactgtcaggggtggggagtagggtgaggtcgcagggggatcctggccagtctcctgcagcctctagaccttgagcctgaggacaaggagcagtgacatgagtgtgccaggctcagggcgtggtgtctggctggtccctagtgcctctagctgccacacccagagggacagttgaatcagccactgagttagtgagggcagagccaccctgatgagcactggcctcttgtgtcactgtggcagtagggcccggggagtgtctcagcaggaatggcacaggcagcrtccagcatctctggtgaagtagagtgtttccaggtgcaatgtcttctttctgacaccacttctgactccaaatgtttggggttttctctataccaagcarttctccaattttcctacccgaactacatgttcaacaactgaatttaattctgaccctaactgtctggaattagggcaacccccacaattctgtgggctcagtcccatagaacagctcccacttcagatgccagtcacaattcccagaggctgcgtgtgtctgaccaaccagctrtaaattgagaggtttccacaatttccttctcaagtgtgatgattggctagaactcacagaactcaggaaaatacatctacagccataccaccctgaacacgcttgatctcgtcagaactcaggaaaatacttactattactggtttattataaaggatacaactcagggacagcccaatagaagcgatgctagggccaggtatgggggagggggcggtggtacagtctccatgccctctcgggacgtgccaccttcccggaacatggctgtgctcacccactagaagctccttgatctctgtggtttaggggtttttatggaggtttcattacataggcatgattgattagatcattgaccattggtgattgagctctatctttagtccttcttcttcccccagacatctttttggccgtctcattagcgtacagaagacactcttaccactcaggagrctgcaagagttctgtgccagaagtcaaggacaaagaccaaatctattttttatgataccacaatgatctcataatattaatgagatcagatgagaaaacatgtggaaaggcctgtgactgtgagttgcccagatcatggcatgttatatgtgtgcacatttattggaaggaagtagggaggtgacagatcttgctgtctagaactgctaatatgcatttgacagacatctgcagggcacctactgtgtgttcatgcggtgcccagggcaggcccaacattgcagccagactgaaccttctcagcatcaaaactgttcgtgtccattgccgtcttagaaactctccctcacttttaaagcaacaaccaaattccttgacatgacatccaaggtcttcctcggccacccttgcctacccgtctgacctcagctccaatccctccctgcacgtgttatttgttttcattgcactgagctatttgcaccactccacatctatgtgcgtgtcaagcctccgtgcacttgcacctgctgtactcgtgcctggaccatcctttgccagccatcctgctagttaacctccttcaggaggcagctcagtgtcaccttcgccgtgaagtccttcctgatttcctctttaccattgccttgtcccttcttctgtgtcccagtatctatttcttttagtgcttccatcattcatcagtcacttgctttattaaaggaattgcaccattaactatataggaatccctgctaatatttgtcagcattgaggcactctcgtttaatcctcatggccaccctattaagtaggcactactattaaccgcatatttcaaaagtgcaaactgaggattaagaggttaacagagatagtcagtagtagagcaaggatgtacaacccaagcaatcagattccagagctcttttacctcactgggaaacaacattatcttttactgttctgcattatgttgtaactgtctgtttacatggctgtctccctgtatcagtcagggtcccaggaggaaacagacagcacactggaaatagggtaatccgaagagagtttaataagagagaagtgtgggcagtgggcagggggaccatagagattagtcgggcacccagatcctcaaaggtctgaaggggtgagagagaggaggcctctgggaagcaggagccagagaggctgtgtggagagcaccctgagacacagccgggagggctggagcctggagagcaggggagcactcccctcctctgactttctgctggctgcattttaccacatgcctttgcctgaatccaggtagaagccagagggtggaggagccctgagatgtgtctggagcaggtcagcaggagaaggagggtacagagtgggcctggcaggccatctgcatactctgattgaccataggctccttgagagctggggccctgtattgctcacgtttacatcccggtactcagcacagaggccagcaggcaggaggcgcttggtcagtgcgtgtcaaatgaataaacaacaagggactgatcttcagtacaaaacaccccttctgcaatgtctgcttgtcgatcacacatggtctcaggaattctttttttttaatttaatttttggggaacaggtggtgtttggttacttgaataaggtatttagtggtgatttgtgagcttttggtgcacccatcaccttgtgtgagcagtatacactgaacccaatttgtagtcttttattcctcacccccttcctaccctttccccctgagtccccaaagttcactgtatccttcctatgcctgtgcatcctcatagcttagctcccacttatgagtgagaacatatgatatttggttttccattcctgggctcaggaattctaagtgatgtatgtgtgtttgtctgtccatgctatttgtgaggtttgtcatggggaagatgatggcaaagtccattcaactctgagatgatctgattcttttctgtggttctcgcaaaacttttcacatctcttgccccatttcaacttggatgtgaaactggagagcaagactttttttttttttttttttttttttttgagatggagttttgctcttgttgctgaggctggagtgcaatggtgcgatctcatctcaccgcaacctctgcctcccggcttcaaacgattctcctgcctcagcctcccaagtatgtgggattacaagcgcctgccaccacacccagctaatttattttatttatttatttatttattttgagacagagtcttgctctgttgccaggctggagtgctgtggcgcaatcttggctcactgcaacccctgactccctggttcaagcgattctcttgcctcagcctcccgagtagctgggactacaggcacgcgccatcatggccagctaatttttgtatttttagtagcgacggggtttcaccatgttggccaggctggtctggcactcctgacctcatgatccacccacctcggcctcccaaagtgttgggattacaggcgtgagccaccgtgccaggcctttttgttttgtttttaaggaagcaagtataaatgccatgctcttcttgctccagctgcatacagccacaattactgagatgactgggccttgtcctatagcctttgcctgaattcctgagataaaggaaagaaaagcagcctggatgcggattccaccaggccctggctgtgtggacccagcaggatgctctggcattcagggtggagcacccagcccagccttgtgaccacatctccacgccttgtggttaggaggccctatctgtgcttccaaatggaaagtatcagaatagctcccaaccagagagagaggagagaaacaacctgaattactgtagtatgtgcatctgggagcccacatttcctggaagctctaattccaaattgattatgtctttttgttgttgttgttaatttgtgtatggcgtgccaatgtgtatttatgtctctgaagaggcaggggtagaggtaaattaactccccgccttccccactactcctcaggacatcagatcacatggaaatgtatgttttcctgtttattattcatttctcaggcacatcagcaaaggtayggctgtagacagctgatgtagaaaacagtcctggctttgaaatcatgctttttagtatttaacctctctgtgcctcaatttccttgtgcataaggtggggaacatcttatgccactcacaggatagtgtaagaattaaaggagatttaaaaaaacaaaggagtagaggttgagtgaaggcaggtgggcagtcatgggaactcccttctttgccctccatttcttgctggtaggacttcacttgcctaaactttctattaacacatttcaaagcactttccagtgaaaccagagggaggagaccttttttttttttccctcgagagtccaacttatactggagagcagtggcacaatcatagctcactgtaacctcgaactcctgggctcaagcagtccttcagcctcagcctctccaattgctgggattacaggcatgagccactatgcccagctcattttgcttgcattactttttttttttcctctgctgctcccccacccctaaccatagccagaccccttgggcctctcttcccagcagttctccagggtctcactctccatggcccattcctgcagtggccaatagaatattaaccagggagggcgcattatcctcctaacgcctgggggatccaagggtttagagccctgcgactaagcacaagacaataaccataaaccatccctgacactggcctaggttctttgcgcctgctgatccccaagtgcccaccagggaaggcagctgtcttaagtagccccaggctgagagtggcaatatggagcagttaggaaaccggagccataaatgtgcaagtggacgaggtgaggcagccagtgatgagtccagttaggctaagmtcccaaagctgactttgctaagaggcagattcctgaagggggcccacaaatgattctttttgtggaatcctctttcacatgttaccttggaggtagtcttggatgtcttgtgtttgggggctctgtgaacagcgacaccactatccttaagggataaatcattgcagctctgttatcctctttgtgtgaaaagaagctggatgcactgggctcctgaccttttccaggactaggaggttgggcacctcctgtggaagctgcaaccatggtacaggtcaggattcagacacacttgctcagcgcaactttaacatctgtgctgcttccccatcgggaagcaagtgatgatgatgccagttcgctgagctgggcaaaacttgcattttattaaagtygwcaagtatgtaagcttgttaaaaagcaattatacaaaataatatagccacctagaccaaagcttgaccctaactaaatgcctcggcctcccaaagtgctgggattacaggcgtgcgccaccgcgcccggcctagtcttgaacttttgggctcaagcaatcctcctgccttggactcccaaggtgctggaattacaggtgtgagccactggtcccagccctatccttttattttaattaacatcatcagagaaataatatttttagtattagcttcatggaaaacaatgaagattcacatacgtagtaaaatctcagttctttggattgaaagaacatttatgggctacatatgttgtactctcacatatcttatttaatgtttataacagcctctgaagttgctgtcattagcctcattttagagatgaggaaagtatgtctaagttgattcttttgcccaatgtcatgcaatctgtaaatagtagggcaaggatttgattgcaggtcttttgacttctaagttctgtgcttagcttggacatggctgcttttttttttttttttttttttaaagggagttacactttctccaaggcctttgagcaccaaatattttttaattttatattatctttgctgatttgattggaaactcttataaagatctgcatccagcatggtatcttgaatatagcatcatgcctaaaacctttttttattacacaggtttatcttttttttttttttttttttttctggagactccatctcactctgtcacccaggctggagtgcagtggcacgatctcggctcactgcaacctctgcctcctgggttcaagcaattctcctgcctcagcctcccaagtagctggattacaggtgcatgccaccatgcctggctgtttttgtattttttgtagggacagggtttcaccatgttggccaggctggtctcaaactcccaaactcaggtgatccaccctccttggcctcccaaagtgctgggataacaggcgtgagccactgcacctggccaagtttattattttgaatatcacttatttgaggttgggatcggttgagtagagtgtttttcactaattagcaggcccatgtatttagaatttattttttgtggaatggtgtattagtaaatttctagtttgtggtggtacattttcctcccttccttgtagccccttttcactattcccagcataactgctgtgttcagtttgttgaaggtctaaaaactagctcaccaaacttgttagaattttgagtatggtaagagaaaatgggagcaagtgaaagctcagagggtgcacctgtgattaaaatccataggttttgtatgcaaaaaaaagccattcataatgaatgtgtctgtctagagatttacatggtttttttttttttctggctcttgttttccagaaaagatgagactctgtgtgtgtgtgtgtgtgtgtgtgtgtgtatgtatttctgtgtgtgtgggggggtgtctgtgtgtgcttatgtctgtgtctgtgtgtgggtctgtatgtgtgtatgtgtgtgtgtgtctgtgtgtatgtgtgtctgtgtctgtgtatgtctgtgcgtatgtgtgtatgtctgtgtgtgtatatgcctgtgtatttgtgtatgcgtgtgtgtctgtgtatgtgtgtctatatgtctgtgtatgtgtccatgtgtccatatgcatgagtgtgctctctcagaaaaggaaagagtggggtaaaaattccagccaagtcctggagaaaggactgtaatacatttcaatctgaattctctctcaggcaacagcctgtaacagaaaataaaaccagaatttttgccctcataaggaatatttgggttaccagctctagccatccatagtgcatacaaaattagatatatcaagctacagaaaaaaactgtggaaaaatcttttcttcctgcaaatgtttcatcctcacttatgtcaytgtggcttgaattctaaagaaccctgatgagaaagaaggaaaaccaaagaaaagccactctttaccaaacagtactgtatcaacctgctgttggggtatagataatacactggtaggtatcacatctattttatgtaaacaaattaacagcaaacctggggttctgtttcagctgtggcaagcccattgctgtttgtctctttggcagggaacattattgtggaattttaaatgattgctctggagagattgggcagaacattgattttaaagcaaagaagtctttgagctttatcatcttccttcctgtgtggaatctgccttgtctcctctcccttagccaaattgtgcaagggttgtgtaaataaatttgcttcttcagaaatccattctgtgggagcctgttggctcctctgtgactgtatctctgaaacaatttctgagatgaaatttaagtgcttataaaatgtaatgcctgtacttggtgaattgagaccagtcttttcagtgattctataatgccacaaaataggcctgttgcatgtcttcagaagaattcagtaggatccctaagcctcttaaatatacaatcccaaacacagaggactagttgggaaaatgactctggtagaatgcttctcatttgaccacttctgagataagccgttttcatatattcttagttggttcagcattttcatgggcccattrtataaattaggattagatttcaactctgtacaaacaaaaacccaaataacattagcaattatgtttgtttgtttgttttccctctctgaccagagaagtctggaggtagttcaaagctagtcagtgcctccatggttatcaggagccsaagccttttctgtttccctggttctactctctttatcatattgctttaggatcccaaatggttgctggagtgtcagccgtcacaaccacattacagtaggcagcaagatgcaataagaagggaaggataacaggagtcctcttccagctgtgttagccctttttaaggcactttaccaaaactcctacatagcatttctgcttacatctcactggctagatttagccatatagccaccttagctgtaagggaggctggaagatgagtcttttagctaaacacattgctgccccgaatcaaactggggctctgttagtgaagaaacggggactacatagcaggtacataactggtagtcctgccacatcagcagagtaccatttgtacagagagtgcggtttagtgcaaagggcttgaactttgaaattagatagacttctgtttgaatcttaactctaccacttactcatttcagcaccctaggtctagcacttaacctctctgagtctcaatttcctatctattaaacatgaggagaataatagctactttgtagggttgcagtgagggttaaagaaaatcataaataaattgccttgtatatagtagatactaaatcatcgtcattctagttgttattaacaggtaaggtatgccttccatcttcaccaccatagtggttattttaaaattgagataattcatataaaatttgcacttttaagatatacaattcagtggtttttagtgtattcacaaaatgatagaactatcaccattgtctatttccagaacatttttgtcactcctcacaagaaaccctgtacccactggtagtcattgcacattaccacttcccccacagcccctgataaccactaatctgctttctgtctctatagatttgcctagtctggacctttaaggtatcatacagtatgtggtcttttgtatctgacttttgacttagcataatgtttccaagtttcatccatgttgtagcatgtgccagtactttattactctttatggctgaataatattccattgtatggatataccacattttgtttatccatttgtttgttcatgaacgtttgagctgtttccatttttttgaatgttaagaatgatgctgctgtgaacattggtgtacaaggttttatgtgcacatatgttttcatttctcttgtgtatatacctaggagtgtcttagtcagtttgggctgctataacaaattaccctagactggatggcttacaaacaacaaatgtatttctctcagttctgaaagctggaagtctgagatcagggtaccagcatggttggattctggtgaggccctcttcccttgcaggctgctgacctctcattgtgtccttatatggctgaaaaatagctagagagctgctctctgttttktttgtttgtttgtttgtttttgagatggggtcttgctctgtcaccccccaggctggaatgcaacggtgtgatctcagctgactgcaacctccgcctcctgggttcaagctattctcctgcctcagcctcctgagtagctaggattatatgtgtgcgccaccatgcttgggtaattttttgtatttttggtagagacggggttttgccatgatggccaggctggtcttgaactcctgatctcaggtgatctccccacctcagcctcccaaagtgctgggattacaggcgtgagccactgtgcccggcctggggtctcttttataaggcactgttcccattcatgagggctccaccctcatgacttaattacctctcaaaagtgtcacgttgtaataccatcacattgggttaggatttcaacatgtgaatttgggtgggacacatgcattcagtccacaatagtaagcagttgctgggtcagatgataacacttggtttaaccttttgaggagttgccaaattgtctttcaaagctactccaccattttacattcctaccagcaatgtggtgggttccagtttcttcacatccttgacaatacttgtcaatttccatcttttttattacagccatcctagtgggtgcaaagtggcatttcattgtgtttttgatttgcattttcctaatgtttagtgatgttcagcatcttttcatgtgcttattatccacttgtatatctttggagaaatgtctatttaacccctttgtccacttttaaattagttatttatctctttattgttgggttgcaaaagtttatatattttgaatactaggcctttatcaaatacaagttgagcattcccaatctgaaaatcccaaatgtgaaattctcccaaatccaaaactttttgaatgccaacatgagatgctgacacttttgctttctgatatttcattgtatacaaactttgtttcctgctcaaaatcattaaaaatatagtataagattaccttcaggctatgtgtataaggtttatatgtaacataagtgaattctgtgtttagtcttgggctccatccccaaggtgtctcattatgtatatgtaaacattccagaaataaaaaaaaatatctgaaacacttctggtcccaagcatttcagataaggaatactcaacctgtatacgatttgaaactattttctcccattctgttatgtgtattatctaattgattctgtataacaatcctttgacgtaaatatcattatccccattttacggatgaggaagctgaggccctaaggcagtgaacagcttgcctaacataacacatctagtaactgtgaagatggtactggaacccaggaaaagattagccagggcttttttagtattagtggtagaaacccaactcagactagcttacactaaaaaagaagtacagttgctcacattactaggaagtccragggttggactaacattaggcatgggatagatttttgtggatccagtggttcaaatgaggtcaccacgactctcccgyatctcttgccatcttttggttatgatcattcttaggccagctctctgatgtgtggcaaagatggtcaccagtagctgaaggcctactaagtcttagagagaaaaggcatattcctctgtatcctagcatctatatcagtcctccatgaaggattctggttggccatgcttgagttaaatgcctgttctagtacccatcattgctgttatcaggattctggaatactctgattggacagcctgggtccagccctttagttgggaaagtagagacatgactgacagtctagaaaattacctggagtcagggaggagtagttcctacaagaaggggatgtaggagagacagacaatgtagtcagtatgctaaaagtctgtctgaactgctgataatttcaagatgttaaaattagttgggagtaagtgaaagttaattcttaaacccaaacatcgggagaaaagtagtttattcacacaaaaccccccatgatattgaaaataatattcatgaaaataatatgatattgaaaataagttctctgctgtctatgtaaatatagcaattttataaatttgtttgtataatgcctctcaacmtctaaggccagagcaaaaaacctaattttttaaaaacaaaaaaccagaaaatattagggaacagaagctggatgctgtctcagaaggtttgctagcaattgtagagacttgtttttttttctgaattagagcccctagtgtgattcaaatgctcacacttgaaaaaggacgttaactaaatagcatatgttaagaagaaaactctgcagtgggcgggcagttttcctgtttcaagtggagcaatgccctacatttgacatggttatggaaaaatcctgttatgatacagctcattgttatgtgggttcaaatacattgcaggcgaaatcatatttttgaaaagcaacaagagaatactgtgacagattcatgtaatatagggtatctttaacgggggccccaacccagacggaagacctccagacagttcttagcgttttgaagcagagctggggacctctttgtgtttggagttggtagtcacactgatgtcaaaaaagcatttattgagctataggatgccattgccaagggacctctgagagcctgtgccccaaggtgctgattttaaccacaaggaaaatgaggccgagggaggtgaaattatttggctgaggaaaaggagcctacctccctggcattccatgtcacaaacatcttggtgcaaaagtcacaaatagctaccatttatcaaatgtttcttttggagtagtatttcagagcctcagtggctttgaaaagtgctcataaaaatagatctagctgggctgtgggcaaatcagagagagagcgttacatcaaattacttttacttggactttacattcattggtcacttttaaaatacacctttattttctgtttgaattatttgaatattccatcacttgtgctgaaaaccagtatctctgcctacatatgagctccttgatgacagaggttgtctcttatgttttaaaatttatttttggctcttaaagtatctagcggccgggtgtggtggctcacacctgtaatcccagcactttgggaggccgagacaggcagatcatgaggtcaagagatcgagaccatcctggccagcatggtgaaaccccgtctctactaaaaatacaaaaattagctgggtgtggtggcgcacacctgtggtctcagcttctcaggaggctgaggtaggagaatcgcttgaacctgggaggtggaggttgcagtgagccgggattgtgccactgcactccagcctggggtgacagagaaagactctgtctcaaaaaaaaaaaaaaaaaaaaaaggaatctagcatagtacctgtttagaatgcaaatagtggtattagtagctaatgtttattgatcacttactatataccaggcactgtgctaagcatttgcacagattatctcatttcaatcttaccacaaccttgagagagagggcttatcatcatcttccttttaacaataaagtaatttaaattaaataacttgcctaaggtaacaaatcctgttaaatggcagcactgagattgaaccccaggtaatctgaatccagatcgcacactcttagcccctagaaaggttataaagctgcttaataactgtttgtggattagaactgaactgactggttccctcctaatacctctgtacccaggggaaaatgttgtcagagactcaggaggcaatgatctcatctctgaaaatgaccaagggaggaggaactgtgtcaatcacaataggcaactggacttgagaaaaggagaaatttgacctacactctgcatgtgctgggaagcttctctgggtaaagggtgggtggcttagaaaaacagtacaactaggtgagtactgtggggcacagtcctcttgccccaaattaggagtgtcagttaagtgatggtgtgccaaactttatactgttacaattttwaaatagtaggcaattgtgcataggcattccttgattctgtgatgcaaagacaacataatctgttgtagaygggagtttctgaaggtctttaatcctatccttgaaatataactgggaaaggtggagtgggaaacccttgggaaccaggatacttggcatttggctcagttcccacaaatctgtcagggaacactgggcaagtcacctaactgcttgggaatcagtttccttatccaaaaaatgaaaagtttggaaagcatgttatccttaaaattctcgctggctcttatggcttatagtgatgtaaaataatgacagcgactctaaaaaccgggatcacttctgtggatcttactctcttctggatctctccatttctcctctctcaattcctctcatacccttccccctataaatgtttgttcattcattcattcagtcttccttctattcagtaagtatctcttaaacacttggcactttggggccataatagcaaatagaaaccctccctggtcttaggtaggtcacagtctagttggataaatataaatatttggaaaatggtaccctggaaaatgataccattgaaaagggccataaaagaggaacgttctcattcttgatatagcacagaagttgggcatcattaaaggtgatgaactcaacttaaattcatcaaagaaacctgggtgtattgtaagtttttctcatttttcaggttaatgtgactttatcagaaataagcaagattttaaatccctcgttcctatagatcgcaagtttttaggactcccataaaacaccatgatttttttcttcattggaggttgttttacttgtattagaaatgatgtagctcataaaagggagccagttcaattcaaaacacatttatgggggcccacaagggaccccaactaggcagtgctttcctagagaagaaaaagcctacagggtttggattcagactgactgaatagcatttttccacttattaactgttaaccttgagcaaattgtgcttatctctgagttctcttgcagaaaacacactacctcactaggttactaggaagatttcaggagatggtgcttgtaaaaggccaagcctggggctccaggaatcttctgtccttgctttagttgctgggggatgtaggtgatacagacatgggtaggatttagtccctgaatgctgtcagggattgatagtctgggactttgcggtataggatactcacttggaagatacaaggtgtttgtttgtttggcrtttgttttttgtgttttattttatttatttattttttgagactggattgctctgttgtccaggctggagtgctgaggtgcagtggtgcaatcatagctcacggcagcctcaaactcctgagcccaagtgagagatgagtcagagccaagcccttctgctaacagagctatktgttgctgaggaagttctcagtttctcctctgaatggtgccaatatcctccagttgcttaaggcagagtgagagaagctgactgtggatacccacatgaagattaatcccacctggaggaatggggcaaggagctgctctctagaccagtcaagcttgcatttgaattgggcttgtaatgagttccccagaaggaaaacacacgcacatataccccaacagaaaaagcatcctggggctgtggactcatccattgtctttgataagccaacagagcatggtggctgatcacatgggctatgaaatcagattgcttgagtcctgctccactacttgacaggtaacctctaagcttcaggtttcccatgcatataacatggggaataatacagtacctgctttatattgttgctgcaagtattaagtgaggttgcgcctgcaatgactcaggataatacagggcgcataatactaagcacaattattctttcataggactaaacagaaatacatccctgagttcattcagttgatatttatgctacatttcttctaggttcccaccattctgcctcttttcttcctacttccatcagaggaacagggaggtagaaccagagtagttttttgtctccaaacaaaccatgttcttctctttactgagaaaactctagtggttttgcttggagtatttaaattgaattaagtacatttgggactagaattggcttttttttattattattattamctgaaattgcacgagtgcaattgggaagcactcatacaaagaacatgaaaaaagcagtttatgtagactatgggaacatgagcctaagtgtaaaagatggaatcaagtacagccccctccctccatcctgctccttcagcactttcctttcctccaccacttcattaagttggtagaaaatgaattcataagttgtcaggtgaaatacagatacttcctttggttgcctgggctgggaaaaatactgtatctaacaaagtagccctatacagaatacagtaaagagaccaattttgcaggcagcagaaaaagcattggatttagagtctgccaggctcagggacattaacttgcagtgagattttattgtgtctcagtttccattattgtaatacttgcatctcaggactgttatatgaatgaattcagacattacatatataaccaccaatgcagtacctgactccagatggaaactgagaaagtcatattctataccccagcagccttaggtttctctggtaagtttgggataaatatacttactttataaagttgtcatgaggcttaaagaaggataaatgtattctaaattctatacttagcaaagtgtctggtacgtagcaggtcatggtgaatattttgtttttgcaagaatatcagaatttattttattttttattaaaaaaaatgagatgcagtctcgccatgttgtccagactgctctcaaactcctgggctcaagcagtcctcccacctcagcctcccaagtagttgggatgacaggtgtgtgtcactgcacccggcaagaatatcataagttatatctccagataaggttttcaaagttcccataatatcggaaaaataattgtctacttaggatgtctgagaccctgctaagcactttatataccttagctcgttgaattctcagaacactgagataggggttgtcattgcccccattttatagatatgaaaactgagactcagagaggagaaatactttaacaaggtctagtagcttcttcatggcagagacgggagcctatcttttttatgtgagaatcagcccataattcatgctcctgcaaaagaaatgccccatgctatcatcccctagaagttgttttgctcagattatccttctttacagggactatgttgcatgaaaataggctattttattttattttagtgagttggtcttaacttacttctcatcttgattggtatgcagccagtttgactctagatactatttatttacctccaaaatccaagccatcactaatgcatctgacctaacaaaggatactttgaaaataagcgaggtctctgaagactgtttattcccaaatctgagatcccagacttcgggaattactgtgcagccttccccgctccctcttttttcctcctcctagtgactaatttagagatatctgagtcgtggaatgaaagcagatgtatttatagtcatctttcacagaaaaggggagttcaaagggaattcacattggttgattattcactatgcatcagcctacttatccatattttctcattttatttcacacaataatctgaaacatagtttagaaaagaaggtgaataaacaagaaagtagagttttaagctcaggtccatgtaataaaaagtgtgttcccttcccactttagccattgtcgtcattccatgagggcatcgggagcctgtgatgaatgctgtcgctggctaacactgtggatcaaagctccttgtggtttcttgggcccacagagcacctctgactccccacccacactcccccacctctggtttctggtcagtcatcttgcaaatgcatccccccttggttataagacagatggatgagagtgaggtctgcaactggaaatgtaactgagagccaattccctgatggcaagtgggtcgttagcgccattgctgttcagaagaataagccaccactgttcctgctgcctttttttcaaggcgacaaagtgcatcctgccataatcatggtgttagaaacctcagtcagcagtgctcagagtaagaggcaggcatgaggaggacaagagtgctgaacagtcttattataatggcgacaacagagatgatgcttgctttatataaagccaggtgcacacaaatatgtgtgtgcgcacatttttcctggctttggggaggatggtgtatatttcggggcagctccacacaaagaaatccagcatttacgttttgcccatgtcagtctctatttgctttcagatatccaggaatgattttcagagtatttgagaaaatgagaggtgcagatggttttcactgaggcatggtttcaaatttaaagaggattatggcccagaaatggtgagtagaggtgtgaacctttgaaattctaattgcagaccagtctgaggaggtatatacttaccaaagcacaatatctcattgtgagcatattcctttcttggccaaaggagatgggggaggagcagatacataacataatcttcaaatgaaactgaaacagcaattgatggcagcagtttggagtctttggtgaattcagtcaagaaagaaatccccagctgtctaccattgcagttagcttagcttgttgtaataatctttcttctttgcatctccagagctgactgtatacacaagtcggctcctgctgggaggaatctgtggtcattttgacacactcactcctttattttacaaaggatagcactaaggcccaagatgacagcatcagttactaggagggaaaactctggaacccagggcctcttggaattgaggcaattaaacactgacttttggcttttaataacagctcatatttattgagtctttactataatgccagatgaagaagatggaaggaaccaccacctcagtggaggtgacaggtgctagacgactacctggaatagatgggagaacaaaataaatgcaagaatccaagtctgaaattgtttccagcctagaggaaggaaggccttcttggagtgaagcctaagtgccgtgtgttgtcagtgctccatggggtaactgagtctcagagagcttaattagctyaactagcatgggccatatttgttccaagtcacagaattttccagatgcagagtgacttggttagtatgtggggaaggatggtaggattttctcctgggtagctcatacttcaaaagaccatgttctgtcaactatggcacatgagcaagtgacctccaggtatggatcttcagctgtctgctatcatcatctggctgtctcctctgaacttcaaacttggtgtgtcccaaaccaagcttttaaagtgctaatgaggacaaagtgggtgcctgtttatttatttactaattttttaaagaatgtgttttgaagttgacttctcaacttccctttgccagggaagaatatttatttatggacattccccttacaaaatttccctttaattagctggaacccttgttagctgaagcatggcctcttagaggacattgatgagcatctcgctggaggcacagtgcaggttcagtacagccaatagagggaggtgaacatctcacacttttctaatggctttcctgtgcacaaagcactttctcttccatcatcagtgaactcaacataacagccaggtcctggggttggtgtccttatcttttgctttcatgtgaggcagctgagggcccaagatgccatagacaacaggattatctgggtgacttactcttgtcattcttttctcaagatgtcaccttgtcagcaaagccttctctgcagattctttatactatagcgactccttcactttcttactttatatttactccactttatgtatttgtgagttgtctagttctgtcctagaaggtaagcttcatgagagcaggggccttggcattactcaatctccagggcacatagtgcttagtaaatatttgagagttaatgaggtgctgtattttgacagccactctgctacttctgtgtagcaggcccaaggctaagacaagatccctgctttggggcactcccttgtagtcaggggtaagaaccagagaacggatgtgaggcttaacagtgcaagatgggccgggcgcggtggctcacgcctgtaatcccagcactttgggaggccgaggcgggtggatcatgaggtcaggagatcgagaccatcctggctaacaaggtaaaacaccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaacagtgcaagatggcagaagcccaatcccgggggtgaggggtagggcgcggtgggtgtgtgtcgcagaggacaggctcagccttccatcctaaggctatcaaaggctctcctggcttgaattacaggtaccaatcctgtggcccttcccaaaggcctagctttttttttcttcttcttcttcttttaaaccaaattcatactcagcgaatggtgagaaattaaatggattcttcggactaagtagattgagctagttttaaaattagccatctgtcaaggccgaggagtgaggtggtactttttccaccgaaatttggcatctgcttagcatcgaacaccatttgcagctcgggcaatgccttttacattccctgaccctcggctttcctgcaagttaaaaaaaaaagtgcaaatgaaagattagaaaattattttttttaaaagcccccaaacccttcattcgtcttcacgctgcattgtagcgacctaaggcaactgcacaaaaccagcctgtaagcggtgaggagcaccctgcagagagatggggcgagcgggcagctgcaagcccgggccccgggaggccgcccctgcgcccagcgcttccttcgcggggtcgaaggccctcgcagtagaaggcggctctcccggggcctcacttcctgcacccacacgcgactaaaaaagaacacgtacaggtttttgggccccctcttgcaaaaagctcagcgcaacgagctcgggaagggctccacaccaacgagggacagggctatcataaggggtaccttaccacaacgcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctggacgctgaaaccccatgttgtggaattcgcgcacgccccagcggccggccggagcccagacccccgcgaagaccccgcgcgcagccgcgtcccctcccccgccgctgaggagctgccgccgccggcatgagcagagggaggcgggtcccggagagccccctgcctcgcgcgcggcttggagtttgaagggccccgcgccgagccccgccagcgccgccgccgcctgccttcgcccgcctccttccctccctctcgccgctgccggggacgggagccgcgcgccaggccgggcggcgggtggcgggctgcgcgccggggttcatgagcctccgggcggcccgcggccccgggagcctgcgccgtgactcaccccccgcccccgcttgtgtctcgtccctcccggcaggatgccggaccagatctctgtctcggagttcatcgccgagaccaccgaggactacaactcgcccaccacgtccagcttcaccacgcggctgcacaactgcaggaacaccgtcacgctgctggaggaggtaggtcgggccgggacccccgccgtccacgctcgccgctgccgccgcgcagctggaggatctcctctccgagctgggaggaaggggacgcgggggccgggggcgccacaccccctcagggagccgccgggtgaataagggacttcggacgggcggcgccttccccatctcctcgccctttctgggtcttgcgggttgaaaggcctggggactggaggtgggagaggactgagcgagctgtggacactccagggaggacagaagatggaagtcctgtccctggcatgcactgttcggcgcttccacatcttcgtgaccctcctgtaaccctcgaggtaggtggcgtcaggccaccgagggcccagaggcgaagtagtgcagccaaggtcaccagcaagggactaggagatgggcagtgaacgcacccctcagcggcccgactggaccaggcaggcgtagctgcggagacgagggccgttggaaaaatcccagaggacccagagagaactcaggctgggactgtatccactccaggagtcctccctgttagtctctggtgcctgaagcccagatggaaagagatctgtgcacataggtttccacccggcttccctaacccggagggtttggtagggcttagggctgctgcgccagcaggacctgcccgcagggcactccgaggctggacaaggagatcggaggccggtgcagcctgcttgagctgaccagacacggagaagggaggcccgaggcgacagtcagacagctcctcttacctggacccttcaggaaagcgttgctggtggggggtggggggcagggccaaggccaaatcgattttctttaggattttcagtgagttaatgagagagtggtatgggcaaagaggaacctgaaagccaaggagcagcagaagcctctggggccacgataaaaataggatatttgcccaggaactcagcatcatcaataagtgccataaagcatccctccccttcaaacaaggcaaacgtatttcaactgaaaatggcaccattgggtggaaagtaggaagggagatggttttccctgggtgggttatgctgtggctggtttaggtgaggtttggggagctctttctgatgtaagccccccaccccaaggacggacctctgtaatatggggaagcttgggcttctgtgggccgactcatcttgaaatgagctttgatactcatgtttccacacacgtagaactgggattcagaagtagagggatcccaaattttaggaggagagagacttctgttagtgctgggtcccatctggcctgcttggtgctatgactgaatgtgtcattccggcatacttccagagttctctctggagtcagtattgggtgatgggactgaattgtgaagtgaatggagaaataccacctaactaggtttgtttgaaaaccagaggtaaatggattttttcttttcttttttctttttttttgtctttgtgaactgccagtctgttatactcgtctgggattaaacagaattgccaggcattgaaccccatcatgggtctgtctttcacttaattgtaataaattgaaacatgttgatacaggagcattttgcatcccctttctgtactaattgtatatacttctaaggatgtgacattgattagactgagtggttattttccttctagataagtttttcagtgcctcctaatagagctgccagttattttaacgttctcttcctgcacatttagatagtgttgctgtattctgtttgtgaagggtgtgataagattaagtattcggtgatgctgtttgtagaggtatgcgagcatattttccagcaaccctgtagtagagggttaatgttaaattacatgcagttgctgttgatgttagtttaaggttaataaatttaaaagcaaatatttttttttatgagaaatactgttgtaagattaggtagaaaaatagagttaactataatgcaagtgtagtcacttaggaacttggaaccaggctagaagttcagtgtcatgttagagtacattgatgatacccatgttctcaaaaatatagcaatgtttcaggatggcacaataattttacaatttttattctgaacttgaggaaggtattggccaggaaaacattgtctccggtcggcatattttaattcttgaggttgcactctcttgagtggttactttttgcatagatgtgaaaagtatgctttaggtttttttactgawggatagccaccatagttgaattttaatttttcccccatgcttacatatgtggaagtagtgcattattataaatatcttaggtgggtcacaattcagttctttaaaaatatgggrcttaacattaccacactcaatataagaaaaaatttgggggcataccacaaaatcttgttggcatatgcttcacaactgagatatttggaaactttaagaatgtggcttgtgttattttgtggttattcttaggaagagaacttttgggtactttttggtgatatggaaactccggaataggaattaatttgggtaacttggaattctcatttaaaaaaaacattttcctagttctagtaagtaccttcctgttgatgacctttttttgctctttrgatcactaatgcacatacatagagcgcaactgaaaaactgttagatctccaagattggagccccaaattaatccatactctttcttttactatgtctccttggtagagattgtggtgtgttgtgcagatgttgatgctttyagttaaatctctgtgatgagcactcttggaagtagatgagaaatatatggtaagaaggctgggcgtggtgggtcatacctgtaatcccagcactttgggaggctgaggcaggtggatcacttgaggtcaggagttcgagaccagcctggccaagatagggaaaccccatctctactaaaaaattagccaggcatgatggcgcatgcctgtagtcgcagcttcttgggaggctgaggcaggagaatcatatgaacccgggaggccgaggttacaatgagccaagatcgcaccactgcacaccaggttaggcgacagagtgaggctacgtctcaaaaatggtaagaagaggcaaagaggagtttacttctggtttacttctgggctttaccttttggggcgaagggtcacacatggctcaggggttcacggtttggctggcacacaatgagtggctaccttggggaggcaggaatggatgagctggtgttctgccaaggtttcatcctggcgtgtgagtgttttccaagcaaaaagccagtgttttacttattcagcagtgaaagcacactgatgtgtgccattttactcttgacmatttttaagttatgagtaagtgactaggagagcataagcgttttccctaaacgggagcaggcaggcattttaggactgctgtgacccagacagtagaagggaccctctatttaaagacttagagtggctaatacttagtacctttgtcagagagagagtccaacatgataaatggaagtctacttggttattttatattgggccacattttaatttggtgacaatgaaggaggcaagttctgctcatttattgagcagctgctccataccaggcctgctgtcgacacatggcatgaatgcttacatttacctctcatatgagctctctgaaagaggaacatttatcgtttccattttatagagaaggaaattgaggcccagagagatgaaatgatttctctctaaggtcaagtggctagtaaataaaatggaatttaaaaatctccctcccggctgggcgcggtggctcaggcctgtaatcccagcactttgggaggccgaggtgggcagaacacgaggccaggagatcgagaccatcctggctaacacagtgaaaccccatctctactaaaaatacaaaaaaaaattagctgggcgtgttgtcaggcgccttgtagtcccagctacttaggaggctgaggcaggagaatggcatgaacccgggagacggagcttgcagtgagccaggatcacgccactgcactccagcctgggcgacagagcaagactccgtctcaaaaaaaaaaaatctcactcccttctctccgtgaaacaggctctctcactctgtcgccgaggctgcagtgcagtggtgcgatctcagctcactgcaacctctgcctcccaggttcaagcrattctstcacctctgcctcctggggcagctgggactacaggtgcacaccgccatgcctggctaatttttgtatttctaatagagacgcagtttcatcatgttggccaggctggtctcaaactcccgacctcaagtgatgctgcctgccttagccttccaaagtgctgggattacaggcatgagccaccacgcctggcccagagtttagaaatcttaaaacagttgagacataaaataggtattctaaatgtctacaaaaacatatttcagtggctttatagggaacataggagactttgctgtcattgcaccttcaagttttggtctgattaaaaaaggtgcctaagttccttggaggcttagtgtttcttcatgtttatatttcagagttcttaatagtgatacttaaatatactattttttccctgtactttcgaagatttggatatgagttttcagatttaaatgtgggaactcatttgagtataatccgtgaacagcatttgttcaacacatttttggggaggccctgctatatacaagtcattttccaagtcctactgaggtattggggttatccagattgtattatggagaagctagtggtctttaagaaataaagaaataaggctaaaactctttaacagggtagaaaggggcagttcataggggagggaaatagtatagaacattcatcctaggaatacaagtgaaatcactcaaattaccatgtagtcaatatacagattgttcagtgcctcctatgtgcccagcagtgtgctaggcccagggatacaatgaagaagaaccctgccctcaaaaaatgcagcctaaaagttttcttatggaaactggaaatcaagtttgggtctggcattagaggcttttcttaatgtattcacctggtgtgttcagttatttctgaagatatagaaatgtttgatgaaatgaatgaagakacagaatgtagattcagtatcaagctctatctcataacagtaacattcctactacatgcaaaccctatacatactattatttaataccttttttcaccctactatcatcaatggctccattttatagatgaagaaattcaggattacagcagttaagtattttgtccagctaggtcgtacagccagtaagtattctgcccaggtcatacaaccagtatcagatttgtgattaatcgcattactgtcaagtcctcatgcaggccagtcagacttctgtgtgtgttccctcaccttccatttaagtttcagcctttatctatgtccttttgggtgtctgccatgctgatgatagagctcatcagtctttgataaatactgttaggtccttaagtgattttctgtgaaatcttacgcataggatttctgtggtcagggtttgacgtctgatcttgttcgtcagctccccttgctcaagaatgcaagtgcattacctcttaaattttaaaagctggtaaacttaataggaagtgcttctttatattgcaggtgctaaacttaaggagcccattaattacccccaaggagattgtagtcttaaaaaaaaaaaaaaaaaaacccttaggaaggatttagctaaaatcaagatttatacttttgcttaatgtagagaaagtatgtttgggtctgtctctgacctcttgaagataatacaacaaaaggcaaacaaaccttcccataatgtttctctcccacacacaagtcaaggctctgtgcccaggcttttgacccagtctggaggtacttaggatgaggttttgtctggatgaaaccagcaaaggtcagtgagtgaatatatctgtctgtagaatcaaagggagaaggaaattgtatatgttggaactcatgctctttctaaaacaaggcacaagcctgttagccagatattccatgctaatgcttttggtcctgatatggtttggatttttgtcccctccaaatctcaagttgaaacatagtccccagtgtcggaggtggggcttggtgggatgtgattggatcgtgggggcggatgcctcatgaatggtttagcatcatcatccccttggtgataagtgagttcttgctcaattagttctcttgagatccagtgttttaaaagtttgggtctccacttttctctctctctcgcccctgctttcgccatgtgatgtgcctgctcccacttctcctcctgccatgactaaacactccctgaggcatccgcagaagccaagcagataccagcgccatgcttgtacagcctgcagaatttcctttctttataaattacccagtctcagatattcctttataacaacacaagaactgcctaacacaccttatatatatatctttggatttaaaaaaaacattttttacacctatcatctaataaaagcttattctagtagcattcttattattgctttacatatgaatacataaaggctcacagacattaaataacttgtccaagatcacacagtggtaaatggtagacttgggctctgaatgcagaatctgcattgaaaacccattccgtttcttctgtatttcactgtcttttatgcttcctgtctgccagtttgttttgtcttgcaggacccgtgagaaaggcatctattaattatctttttacctctatttggtttctagtgctagagagaaagagtttgggagagggaagaaaaatgaaaagatagttgcttttctctgttcttctgagacctcttgctggacccctcagtaaatctctgccttttgtgatcaaagacagtgctgcaagcaatcctycttggactgggcagatgtgaaaatgaccctgttgcttccagctccaccctggcatgcttagtctgggactgttgacccaacctgatttgcctatgagctgcccagagccctggctaaagaaccactactctcagttgcagtttcttcagggctgtctggctgtctgcttccagcttcctggctgtacaagagccctgagtttttgctgggtgttagttattcagggaattgccaagtgtccaagtaaaagcgaccttggagaatatctactctggcgtttgccaacctgaaagcctgatctccaaaaggctcatgaaagctgtgatgggggtctgtagccactttgtggaaaaattagtggacactgctagtaacttagtttggcataactctcatgccaaatgtgtttgattttggctgaaatgcatcagctcagtggtgtaggacgaatcatcttctgctgatcagatgcttggattgccagttataaagtgggaaagcaaagtgttacctcattgaggtgattggcttcctagaagggctttgtatctccacgggaggaacctcatgaatgatgggacccaccagatctagtttagtcctcattgctttgagaggtggagactgaggcccaaagatgagacagaaaccatgcagggatttgaattcagggctgcccaacccagggatttttgcactctgctgtttaacagggttgtggggactggcaattcacagtctgggagtcctccccagtaccactccatgtaacttgcttctaggtggaaagagtggagagtaaaccttaagtttggaactggatcttgctagcccagtctgctgtcattaagtcctggtctcagaagacacactgtgcgaggccgcagtagctttccctgatgttaggctagcagcctttcattagaagccatttgtggtgttggatgttcaaacactacccagacctttgccttcattgtctgtttgtccagggagcctcagagagatggtttccatatatgtaacctagtcatttggggactaaaaccagatctgggtcttggccattcccacatgtattacttaaacatgagtaaggtttggggctacacttcatgtctaagcctctgtttccccatttgataaataaatgacattgctttttgagtattaaaggaggcaatgcatgggaggcactcatcaaatgactttatgtgtcagtaaagtatgtccctatgggtgtcaaggtctgactactcagctctcctgtgaggcagggaagaaggggaggcaaatgaggctagaagcattccttcatggagagttagataggtaggactgctctctactgaggaccagtggcaacacttgggttgaggagggtgaaattctcttgccaaggttaattgtatccctattacttctagcgtgtgttgggcaagttactgagccttactgtgtcctactttcctcatggggataagtacctacctctcagtgagtcagtatctgtaaagtgcttacaacagtgcctggtgtgctaagtgctctataaatgattgttcttattatccttgttgctattgccctgtattattgtattattgcattagacaattgcatgtgtaactgagaagatgagacttggtagactcatttctgaagggtcagtgatgaggtcagatgacagagaaatgaagtcagatgtgtatacttcagggacccggactggggaggcacagatgggactaaggagaggactarggcaacaccaaacactttgaccattgtgggtcatggtcatagccaatttgatctgaagcagactgtcaactcagtgtaactgtataatcagcccttagtgggctctgtactctctgaagtaagggaaccagtgaccagtgctgcccactttgacccaggccagcctgatgggctctaccagtgcaacctcattgcccatgcttccttgtgtcactgctataatctttctgccttcttctacaccccactcgtcgagtcctctccattggtgtgtgaaagctgccccttctgattcttgctggggctttggggtaatgagctgttttctctgttacataataaatgcaggtatttattatgtacctgcataattgattgtggtcatttgtggggaggtgaaacatttatgccttggccctgactggtacagagcatggcagctaggttaggtgctttactgattacagtttgaagcactgagaccacaagaaattctattttggttaggaggcaggagccttaaagcaaaagagatctctccttgaattttcatttctgtgtgcttcatagcttgttttcagtgtcagtaaaacgagttttaattatttgtgggcaggagttaggtcaagatcaggaggcacttgactctacttggtcttaacagaatccaggagttcacagtaggctctttccagcccacagccctgtctgaacagccctctgtcatggtgctgtttgtggtcagttgtgtaagaactgaattttaatgccaagctatggtataattttcccccaaagaactggaatatgtgtccccttgataagacagcacctaatttagccactcaaaagctgggaaaataaaatcagaacctcatatgccaaggaggtaaagcccaaaagacgactgcattttggcaccaactattatagaaagcagagttggctaagtcaatctaggccacccctttccctgccagatgcgttttgggtggaggaaaatgtaagctcttcttagctctattattaaaatagcctggataccttgcatttctgtagcattgtacccaaaggctagggtcagaatggccttgtctccagtgcctggtatagcacccagcacgcagtgggctgtaagtatagtgaggactatgttattatgacgcacattctgtagaactggaaaaggcctcagagaccatctagtccaactcctctttttatggatgaggaagctgaggcctagaaaccccaagtgtgttaggctgttttattgtaagaggtcccttccccttccccagcaaaatgaaatacattggttaaagcaaaatggggacttattggaaggattcatgggagatattttatggaacatgaggggcaagaatgagggtcttctcttttgggcaaatggtagatgaaggcagctcgcaccaaattattcccagctccagtgccctacaccacattggtgtctgcctgattctgaggcgaggatatctgggaaggaggattggattggctccacttgggtcaggagaccacccttgctccagtcagctttggccaggatgagggggttatgtgatgggtggggctaagtcttcstcttcagcctgggggtgatggtggtcctcagaggagagtaggaggatagggaagcacaccgtttatacccagatcacacagcaaagctgggactagattcagttcttctggcctcatcttcatttttcattgacatgacagttaaatgtaaatgatggtacttcacagctgttgggagaatcagtaggaatataagggaggcagatgcctggcactcagtgacgcttggaagatgttagtttctctgcccttccctctgcaagtgtcacctccccttgatcctttctgctctgtactcatttgggatacttggaaggactgtggtcagagcactgtgctgcctagttttagctttgctgatgtggtcaggaaaaatcaacattccacatagggtatggccagaaaagaaacatcccattgccactaaatccaaagtgatggcatggtgctccttgaataatctttccgtagatatccaggatggatggaagaccaggcagggcaacttggctgtcttcggaaaatttctggtttaattggtttttcctcagtgttaaataacagagcctgcttaaaggtccagtgaggactaatggctttacttccattgaacggcttcttcactgcccagttacatacgaaataaaattgtcttcattgttttgaaacatggggagccttcctttatgttgcattaatcattttttatgatgcccatttccttttccttgtaatgtttattcacattaatagcatttacataaaattagatactccttatttccacaaagtacaaatcaaaataagcactcactgctggcccagcagctgctgctgctttaataatagtaatatttttcatagcaaggcaagtgaatacactgcctcccaataaataaactggtgccaagtcagtgctgtcacatcccaaggcttctgcattttgtgtgtaagagtttgaacaaattcagaatctgcgaacattgctgttaagaacctactctatgccgggaactgtgctgattgccctacccatatcgtctcatataatcctcccaacagccctgtggggtgggtgctgtttcttcatttcacagatgatgaactaggtttagaaaggattcaactcaatttatgctctttctactcagactcatcctcaaraaaaaaaatgcagatatgcatgcaatgctaatgaaaaagaacaaacaggaaataggcttctgctgagacatgagatatgtaggttagactcaraagaacttcctgacagtgtattaaataccaaccggatggccatggaagtaggatttttttcttcctgattttgggataattttgtcaatgataggctggtgagctaagttgtgttcttattcatgttcacgtatgtcttcacttttagtagattgtaagtacctcagggacatcccccctcactttttaaccctaggtttttaaacttgttttgtttttaatgtagttagcattcagatatttgagtaaaattatgaagattgtagcaaaactacatttgatttataaatcttgaaggcagacctggtaaaaagttttccaaatacggttaagtctacctctctgggctttatatatatgcctaccaattgcatagagcagttggaaaaacccacagttactaaatttcttgaaggttgtgctgcagatgcttagcagacctgaatgctaaagccagattcctagtctgtccttttggtgtctgcaacctgcagtcctctgttggcctagtaatactagtcacagagttggctgtcactttttgagtaccagctctgtactgagtacttttttgtgatgttgcccaggctagtcttcaactcctgagcttaagtgattggcctgccttggctttcttggcctctcaaaagtggtgggattataggcatgagccacctgtgcccagcctgtactgagtactttacataggctgtttcaaactctcacattaccctgctagtacctgagggaggtgggaatcaaatctgggtttgcctggcyccatagcccccacctccccactgccaccctgccttgctttggtattagtgatttagctgcaaagtgcaagtaaacggaagagaatctggttagcatttactttcttggtggaaacaaacacacatacagagacacaaacaagacatgcatctgccagtggaaaaggaaagcatttttccctcctgacttgtttctttcgagttgacggggaggcatttaaatctagataatttacatcatgcatctggggcagccagtcacaatatggtatgaaagggattaatgagagaattggtattttcaaaaagtattgacctctcagatttttctttatggatggtaagtagtgaatcatatgattttatgagcagttggtgccctgagtttactctccagcatttctgcgctctgttataatatattctcatttcgtccacacagcactttgttaggcaacaaagccactattttctcatttgacagatgaggaaacgggctcaaaaagttaaaaataatttctcaaaggtcatttgactgaaaaagcatgatgaggcttgagttcagttctgccaaccagtctcccccttcactttgaaagagacagacctatgctggagatgttttgtcaagtaatttgtaactaaaacaatacctttaggactaaaacatacgggttttattattggataatttcatgatactttgcattattagattctccttcctccccacctcccccataccttttatagtctgttttgcgctagtagctcagtcctccaagtggttttttactttgggcagtttttctttgttgttttttgtttgtttgtttgtttgtttttttaagagacgcaatctcaccctgctgcccaggctggaatgcagtgacataatcatgcttacttactgcaggttctatctcctgggctcaagtgatctcgcttcagcctcccaaaatgttgggattacaggcatgagcaactgtgcccagccagtttgcttgctgttaacttaaatttttgcacatgcaatagcagagcgacatgtaactatcattcagtttcaacaattgtctgcttttggccaatctttttttcatttctgcctccttcccctgattttttgaagcaatatcaggtatttcatttcatccgtaaatacttcagtatgtacttctaaaagataaggacttgaaaaaaataaacctgaaccataatatgttttctcgtctgaaaaaaacacttcctcggtgtcattaaatattcagtcgctgttcaaatttccctggttgtctctttaaaaaaaaatggtttatttaaacggatctgtatgagatctgtatgttgaaattcatggacatatttcaaatttcttttaatctgtggattcctccctctttttttcattgtaattcatttgccaaagaaagtggtggtktatcccgtagtttcccatagtatggatagtgttgactgcaaccctgcactgtcatttaacgtaagctacagtctactcttaacagacttttgttattaataatttcctcttactaaagaataagaagaacctattccctttgtagaaaatgaggacaagtataaaagaagaaaatttaaaagtcatccataagcccactaaccagaggtagccgctactgtcacttcaagtattttgctcagatacatctctgtcctgcttattttcatttaacacatcatgaacatttccacttcattaaaaagtcttcaataatatttaaaaaggcatgtcattgtattaaaygtttccctccctcccttaagttgctcccaattgtgtgttttgtacmgttggcttagcagtttcaccaaagggaggacctgttgttcaccttggagcggtgaatatttgtgtatatctgtcatattctgctctagtgttgatagattcctagagttggagttagaggctcaaaggccaggcatattaataaatttcttatatatttgtcatattgccagcttgtttcaccagaatggtggtctttgccttgttccagccctgggcagcctaggaaagtgcttttctccacagagggacagctttgaggtctcgatttaagtttctccaaaagaaaaaactgggctctgaatgtgctgttgcccttgtgtgtgttggtgcattataagttacatcaagcgagtaggagtagtgaagggaaaaaggagtgagtgtgggtgttttcaaactctctgcttagcagactgaaagccagtgtcatctcagtgttagggggtggtgagtagctctgccttatcagcccgtatccgccttagtagtgacttctctatctgccccatacagcctcttgtctgaaattcctgcttaccatggaaataagtttgttaaggcctctctcttgggctcagaaataaataaatagcattcactatgaaaaggggaaatggttaaagaccagacatggccagcttctagcctgcctgttgcctgaccccaggtagtgcctccattcttccttgcctgaacattttaacctcccatgactaagtcacaggacatttctccagctgaaaacctttttggcttagtaagtatctttcacagacccaacctgtactgccccttcgttcacacatggttgtgaattagtttggttgcttcccacttaacacttggcagagaagtagggtgggaagtatcttggagagaggggtagaagttagatgtgcctggaggggtgtagggtggggggcaaccaggttcttggagcaacttgaggggaaggagaagaggaggaggagaaggtgccaaaagcaactttaacttgtcgtttctgagagttggcatcttttttaaaagtcaagttatatttcacattttgtccttgagctgtcctttggctagggaaccccatcactttgtcatgtgagtttgttacgttttgtgtttgtaacagccgcttttgtttttcttaggatggtgctttctcagttccagaagtttcagagaggccctcctcagtgtttggaaattgcttctgggtatattgggcctctgcttccctagggggccaaatagcagctatctggagcatctttccctgtggatttcagcttagaatggacatctgttaagtcaaggtccactcttggtagaatgtgctgggtttcatgctgagtactttacccacggtattttacagaaggcctctgttactggatgttctgaggagaaaatctggaaagtaaacaatattaacttcattttacagatgaraaaactgagggaaggagtgacttgacgaggatgtgcagtcaggggaagctggagtttgtgtctctgaggtctgtggtcttacatgatgagtgccacccttgccaatttgccttcttcatcctcctcaccccctaagacttcttgattgcccttggggtctcaggacattctcttttccacctcaccgtgaatgccctggctcaggaccgacactttcctttccaaagtctgctttcagctaactcttggaaggaaatctctcccatgtttcactcaaaggtataaatgcctgatgaggcattacagcaacttatgctgaagttagttttaggtgttgggcatggagatcctgtcacaccttacagggtagctggctgtctcttcccatctctcggtccagtgaacccttagaaaacaatgccaagagtctcctagtttgactctcgtttcttgctgctcttttatctcttatttgttaataaataattatataaataaatgcttttcctgtttctctttttggtgccaggacttccctaaagcctgttcgtgaaccattggtgactgaaccttggtcacttggtacgtgtccttcactgggctgggcagtcaagttgaagacacggaattatttaatctttgcaccagcctcatcaggtgatgctctggttcccattttatagattgtggaaacagagactacttaagaggtgccaggctgttgacacatattttatcctttgatcctcataacaaatctgtaatgttagtaatattttaattttcaagtaagggtcctgaggcttggcagtcagcagtttyctgtcccaggttttactgccgaagggaaagaaccgaggtttatacaaagatctgtctgaccctcaagtctccaagtctctgccattaactgctctgcttgcagttcttacccaagatcccacaactgatgcttggttaagtcaactcaagcgcttagacactgtgggtgcttcatggagcttactgaaaacaaagtgagtcatggataggagtttgacattgtaacacttgagccatacatccatttttgagaacagggtggccttcctggcgccctgcacccatccaggcaagctgtgggtggtaggtgtgtttcactctggagcagtcagttggaagttttgtgtcgactttaccttctgctgtaatgcatcttgtcactagacttagtgacttaatttgatctgtaagcaccctcacagccacgtggtgttactgtatcacatttaatgtcggttaaaaaacactctaaaaaaccacccctccaccactgccccccagcgacaaaacaaaaacaaaaacaaaaacaaaaacaaaaaaaaacctagtattttattcccttgaagactttggaaagattttgtcattcatcgcgatgattggtcagcctcaagaagcatgcaggagccatcataagagtcacaaggtattaagcttcctctttggagcctggtagtgtgctaagttctttatgtaaattttatccttaaaatagctttgcagagtttctccatttcacaggaagtgaatgaatgcttagagaagatcaataaatgcccaaattgcacaactgttatatggtggagctaagtttcaaaccaagtttcttaactgttccatgtcacactgctttcttagacgttatagcctttttaaaaaggagatgtggaatgaacatttttaaattcaaagtttaagtatacacacacattttatgcattgggtacaagagtataaatgccatgaatacttactaatcagatatttaatatctgcttctgccctttctcctagaaaagtgatagtatgaagggagacagagtgatttgttccacacccaacataaattattgcccagggtgagttaatttgtgtttatttctgaagtggcagtggttgcttcctgagggtctaaccttgtttgactsttttgtaggctaaatttctgcaggccttctgcagagccctgtcttcttcctctcagagacaacccaggtgtttttcattccctagaaagttcccctttgccttgtagacacctttttcacacagatgtgtgggatccttggtaaacagtgacttatttggggttatttctccagccagtcctttcagccttttcttcacgtagaacccactgtgccgaaatgttggttttaagcctattgcattattgttttgaggacaggacttatttattcatctgtttatctccaaagcctgcgacccagtagaatgaaccccatttgaatgaacaaatgtacacacacggaagccttgaagaatttaggcaaggtgagcctggctctgtgtatggtggaagtgaggataaggagagtccagaagaagtactgtctgtaggactgaccaagagggaaaggggaggaatttcaggacttgcaggatttcaagggaaatagtgtaatcttagagttttagagccagaaggagccttagaaatcatggaggtcaaccatctcattttccacatcattgagatttctcatcagtcctgagtttacagccactgccaactgaccttcagggcacagaaccagacatacctctttaagttagtgcttttattggttaaaacacttcctgattatagcattgtgttttatgttttaagtaattgatttttttgtgtttgagccctaagatgattttgtcaggaaggaagctatttttaaacatctacaaaccaagcagatagagcactgccttcaagtggaggagacttaccccatgttgaatcttgtgatagctccttctttttgctgacttccgactctacttgctattaatatattcccctccctgaccgcatcgatgtactcaaggatacttgtaaatttgctgattcttaaaattttctctccataaagtcctaaactgtttgttcacctcttccacagcatggtctttaaacaggtgtgaaagtttccagcgtcttaaatttgttcttaccgagaatttttctttacgttattttaccttgagatattggtgaagaaacgatagcccagataagtcaccttgcttgaaactttagagagggtgggtggctactggttaagtgttgagtccaggtgagatgattcgtgtctatggcttttgccatgacaaagaccttttaaagtctctccaatgaagagtcrctgtatctgtatttaagtttccttaggattccttgagcttgagggttcattccccctctctcctcaggtgctgtcttcctgactgctgcacttcttaggtggggaataagctgctcattagtgcccaggtgcttttgttactctgcccccatcttgtgattttgattgtctgcccagcagcccaattctggaccaaccagtgtgcagaaagagcccagcaactgctgctctgggggaaatgcccaggaaacagtcctcagaaggattgtgatccactgaagcaacaaggcagccagagcagcagtaggaagtcagaatttctgctggctctctgtgtggagcattggtgtggcaggggagatgggattgtcctcagcattcagctgaggaaaccaggcccacagatgtcatgtagtttgaaggtgatggaaccggagccactgttagcccagtgtgtacattttccagcacaccccattgcctgctgttaataaaagaaatggaaaaaattccacacagatgcatgactagctagagtcattaaagatactgcagagtgtttgctgggatgactgtgggcagtaaagctattggggagtagtcaggataatgttcttttcttggaaggagagtcctgtctttatttacctgacacgtatcttctgttgttgctggctgttctttgttgaatacttcccctatgcagaatactttaattgtagcagctaatttttattgagtatttgctgtatgtcaggtagttaactacatccactgatgtaaacctcatgaccaccatttaggtaggtactgttaagcctgctgctgccacttaactgtgcagttttgggcaagttactttacttctctgttacttaggcatctgctgccagcatcacctataaatatatacctttttctgaactgtaatatttgtattgtactattgcatgggtctgttgtgagggtgaggtgaacgaatgcatgtaaagcatcacaggctccttaggtcgtcttatcccccagtgcccaaatatgtgatctagggcaagccacttcaccactctgagcctgttcttcctctgtaaaatgagtgtaatatgtatttcaacgattgttgtgaagcaaaaatgaagtaatggattaggcatcttacactccacattggtatgtagtaaatgcacaatagaaatagttgctataattgccatccccatggggaactggctgtcactattttatatgtaggttcgattttaggatcaagggagtttgctaccaagtctggccattgcctcttctctgttctgacttaagagaatgttttggtggatgggtgagatttcaagttgagaggagaggaaagtaaaagacttataaaaatggaaagaaatgcatgaaaacagatgtattacagaaggtctttgagaagttgtggatgaggtttggctagcctttagtacttcaattttcatgggaaggagagaaacctcttccttcacccccatctatacataaccaacttttatttcctgataggattatgtaacaatttttttctgttaattatcatggacatgttaggatttgattatttggagaggactagcatgcttaattagcgttcagaatttacartttataacagggctctctttgcagtgtactcatttttgttacactggagacttctaaaaaagcaaaaagttgccttgattatcaatgaggaatcaaatgcaggtggttggtggtacaggaaatcaacccaattactgattaatatgagtgatagagtgattttcctatgatcttatttgaagcatgcaccactcaattggagttaagatgatagttacaagtaagcagatcctaaatcaaacttaaatgtaatttaacatggaaaacatgaacatcttttaaaatatttttgaattaatctcacccttttaccaacctgtggcattattttcttgctgttgatgcccaagcctttccttatttcctcatacaaactctgatgtgagtcctgactggsttagctatttgtgattgtccctattgtaaagatatgtaaagtatggtctggggttccctgtgggaagtcccaggatccttccaggggttctgagagatcaaractatttttatactaaggtcaagacattttttgcccttttctctcttattctttcataaatttatagtttatgagactggagctgtttgggagaagtagtttcttsaaatgttctctggtggtttcattgggagtttagtatctttttagcttttctgctaggtctgacatctatctggcttaccgtcttttagagacaatgcaaataggtacttttttgtcactgttcggtgacttatgtcaaaatgaagactgtcaaaaagtatttttccccctggttggctttaccatgctcctctcagattgtaagagtatggcatcttttctgaatctctttgatgcatcacatgatagatgccgacaccattcatcctgccttagtctttatttcttttacccatgtaaagtgcctaataccaaaactggtacatagtagacattcatcacatattagttcctttggtttattgccttgtctttatccagcttgctttgaatgtgtttctcaaacttcaatgtgcatacaaatcacctggagagcttattatgtgctgattctaatttggtaggtttggggtaggacccaataatctgcatttcttttcaattctcaggtgatgccactgctgctggttcactgaccacactaggaatagcaaggatgattgatgtatatataaccttaaacatgctcccgcacacatgcccttttgtaactttgccttcttctcccccactgtgattattaagttcgaagcaggaatcattgccttgagttgattgatcactgaatttattcagcaaacatttatcttgggtgatatgattgttttcacagggctgtttctgaaacttygttttgcattatcttaatcccaggtgtctatctctggtaggctgatgagacartttggagttgagtagtcttcattgcatgcagcctggtcttattctggggctctcttttcctgtctcacttggaaatttcatttcccagtaatcatacttcataaccattaagttgcttggagttcacacttttttcttttagtgtcctgaaacttatttttgactgactcagaagtactataagagaaataagtttccatatcatttttattaacctcttgtttagattcaagcctacagagtagctactcctgttgtgttcacaggattttytcctgagctacattttyttaacctcagactatctctccctgaccaaagagcccagtagtccttagtggggtggtgtgggagacacagcctcagcagggctgctgtactcttgatcaactgttgaaagggaaagtcaggcccagaatctgcctcccaactctttttttccatctctttttccactagggtggttgtatgctctttaggcactgttgatttctggctttgaatcrtgatctcttcatatttcagtatgcatgaataataggacaatttcatgcattcattttgctatttctgagtagaagttagtgtgaccaaccaagttttaatctgatggacctgcatctgaatcctggctatgttgctcactatttgtcagtttactacacctctctgtgggtcagtttctccaagccttggtttctcctctgtaaaataggggtcataaagtgaccttattgaatgacagtgaggattacatgaagcaatctatttaaatgcttggctgagggtctgttgcatgatcggcatccaattaatggtcatcctcatggtgataaagatgatcagtgtcatcaaatgaaaatgaaagggaatacagcctgagataatagtctggggaagtaagtgcttgtggtagggaaggaagtaataggcaaaaagtatgctttagctctctggatcccagtctgaactctgaagggaggagagaataaatcagtgatcgttaatccgtctcatacccagtgacagagcagtgtggccagagagaatttggggaagaagaacaggaagcacaggaaggcaatgaagacaaggagggatgcttgatattctgaaaggagggttggaggtctgatatgtatttggataatctaaagggagggtttatttatgacaaaggtactttgttagtgggatgatgatttttagtcacattgctgttttgtattattaaatggagagctgttggtatttgagagagatgcccagtttttccagagtctgaaaagagatttttgttgatgttgtagtataaaaagtactctgtgacatggcacatggctgccaaaagtgtgaaagaaacaggaaatcactacacacttgaaatataatagaccttttcattcatcttgtgtttttttccctctgaattgttaaataaaagtatattctgttacatgctacagctagaagcaagctttaagctatcagaatggttgtgaagaactgtagaataatatgaagataactgtatttgtttcatggcataaagttcttttcaaatttggttactcatcctgtggtttaaaagttaaaaagagaccatatatattgtctctgaactctagctgaatctatgtgaaacacaagtagaacttttgggaggctgtgaggtttgtagaagactttaatagaaatgaatgaagagctggcattttgtaataatatttcatcatgtgcttttctttttccgttacccaaggaacatatttgatgtgcttgatatttttgttgttgttgttacctgaaaatcaaagagtacctctttatatgtgtgcctcagcaactttttgtggtttataggataatgtccactctccttaacagctgcacctagagtcctctgccttctgctgctgccagaaggagcagaagcaaactggaagcctcttgcattttcacgtctccttgcctcctcctgtaccagatgaacacctactcatctttctggactgagctcagatgtcaccttctgaagagacccttcctaactactgcttttccctgttccccagtccccattagaagttggcagcccagtccttgcagctccagctgctctgtgcacactgtggcccaacacccatgaggcttcacggggttccctgatggctgtgagtctcttctgtaatctcagcttctgggggataggcatggtgttccattctgcatgctgctygtcacataataggccctccagaaatactactgaatgaataaatgcatctaatagtctgataattttatctgtatgattggcgaaaatattaatcttctggtgttgtgacttgtatatgaacctttctgtttcatgatggcaatatgccctgccatacttkaaaaaaattgttacagccatgccgtttgttttttgttttgttttgttttgtttttgagacggagtttcactctggttggccaggctggagtgcaatggcacgatcttggctcaccacaacctccgcctcctaggttcaagctactctccagcctcagcctcccaagtagctgggattacaggcatgtgccagcatgcctggctaatttttttatatttttagtagagacagggtttcaccatgttggtcaggctggtcccgaactcctgacctcaggtgatccatccacctcggcctcccaaagtgctgggatgacaggcgtgagccaccgcgcccagccagccatgcctttttactatagaaataaagatgaaaaatctcaagtaatcccatcaactaaagatgattagagttaaaacatgttggtttataattctttataaaatagccttttaaatccaactgatttggactagggttgggggtgcttaggaaataaggagtagataataaggtagtatggagtagatatataattgtaattcccccttgagttttgagagctacttacccaaaatagagcatgacacggtttcgcctccaaacagaatttccatatgaaagattgaaccgctttgtgcttgaatcactgtgaatgttgctgctgctagttctttctgtaatgtgaatagaatttccttagataagttgtcagtgtattattttccctttaaaaaaaaaaacttcttttttagctgttatagatttcttagatttttatatagaaatattttctaaaattttttttacaaaaataaaatgaaaattgtgcctgttgtgctgcatgtgctttcaagttagaatcagtcattgacatattaatggcttcttccaggttggaaaattaataaagattatccttttacttgaagaaagtgataagagaagtagaaagaaaatcaggctgagattaactaaggaagcagcctttttattctactttcagccattcagaaragggaaaaaatccagagtttctaataagaaaacgaaaagttgttttgcattctggaatatttccaaaagcattgctattgatgttgaattccactttggggttggagattaggaaatttttggaagtgttgaagtaaaattagwtgttctttgtattattttttatttgacagtgtacaaataatgaaactgtaaactaaagtacaatgacataatcacagaaatgatcataaaaatggttatttaacttgaagtgggattgaatattcaaaaagtgcaggtggtgtggatgggcttctgggtgaaattaggttttctctttcagcaggaaaaaagacagagttttcattatactccctgccattggtgatatggtgtagacctgtaatgataacaagcactcaacatcttcattgaaaagcaccagaaagatgcagagcagaagctgtaaacttcacaagtgccatcaaatcagactgtttcttcaaagttgaatggaaaatttcagatgttggtcatgaaatgtttactctgtgacccaaaaccaagttaacaggcctccaagagaggtgcttgctcttggatttgaaatagtagccatagtgataacttctcttctctgtgtaagccctgtaattttgtgtattccatcattctctctggatttagtggttctgagaaagcaaacctagaccttgggccgagacttcacacagaaatatttggggatctgctctatggttctctgggtttgggcctcagtttccccatttttcagcttttgtggattctgrtcattctccccacttgatgtgcattgtgtgtttgcatgtgtgtgtgtatgtgtttctagatatgtctgtgaattttggggtgtattttttaaatgctttgcttgtatttttaatrttgctaataaaatactagctacatgattttgagggcttggcacctcttgactaggtaacagtactgtgctaaactctttacatgtttatctaatacttttctcatgataacctgatgtgggtggacgtcctatttttttacaaatgagaaaaggctctaaaattaagtaacttcctccactataataaggaaggcaggaagtaaggctggatttcatgcctgccagattccatagtctgtggactaagcaactgtgtgacttgctttacttaacattctgggcccgttttcttcagctgatgcccagggaagtgaagtaaactgaccaagttgacacagttagtaaggaatgctcagagccagtgttcctttctctctccagactgcttccatggaattcttgctctgggcttggcagttccatcatggttcagaaggatggatctaagagcaagatgacattgtgatgtcaactaaccttccagagaatggtctaaggggtaatagggccctactcgctctttccactcraaatagccatgccccctttccttaactttggagcccacaacacttaagattagctgacatttaatatgtgtgcctgctaggttccaggctctttttatatcctatctattctttatgtccatctgcttgggaagtaatcttattccctttttgcagctgggggaactgagcattggaaaggctggtctggccaatggacagctaaggtctttctgatgccaaagcccatttttggtacaccatatcatctgctactgagaaaaaaaggctagaagtggaaggaggtttgtttgtactttcaggagcatcccagagaatcgtagaattgggttcagtatattcttcatggcttcacctaaaattttcagctcggggcatttttataggtttaagaatgattatatgtaaaaacaggcaaaatttccagaaggcaacaaaagataaatgatagaaccctgtcttctgtccctttccccatagagatacctacacacatttaaactgggaaaggaaacaatgatccatcgtaaagcttacccgtaagacaaattgcctttggcaatataaaccttaaaygctcatgaaggcctcacatgagttaagtacagtttaacatgattctgccatttgagcacctactatgtgcctggtttttggtagatgactgagggaagggtaacagaatgaattaracatgctttctgtcccaaaggtgttcacaggtgartggggtggtggttgtggggtgccaggttagctgcaatatagcatagaccggtcagagctgtgataattcagattgctctgagagcacacatgaggtcatgacaggttccaactggagaaatcttacagggtcctttcggacctggacctgaggaatagatgggtagaacatttcaggcagaggacaccttttgagcaaagacccagggtgagaaaatgcaaagtggaatggagactcccattagatgggtagtacggtttcatgcttactcagtttggtttgatgaagcaatctctctctctgtctttgtgggtttgtgtacagtacatgtgtgtctttctctgttaaatgccttttatgttttgttggggacgtgtgtgggagtgattcatttccagctgggtccagctgtaatgaaaatgtcctgtttgacaaattgaggaattagattacaactrtctctccctgaaagctgtgacactagctgtaacatcaaacatccctccctttgtggggcaggacaggagggaaatggtgattcagggctgctggatgtgttgactagaaaattatttgagtaaataagactgtgttgctccagttaattgataaacatggcttctcactgagccatgtggttttcctccaaggagaacttagaatggtgccatctgaggctgccctagtagagaagtgcaacacgtcataagtggtcaaaacatttttattggaagtaatgcatctgtgtgattttctgtttagtccctatttcagagctctttgttttttcttaaaatgtaaaatactctcaactttagcttgagaatacctgaagtgtttagttggacatttattatgagccagtaacatatttgcacaggagctctggaggagagcagtatcacttgtggaactctgagcgagttgtatagccacccacccatgccactttctacgtctgtaggactatagatttggaccagctgacctccaagatcctcttaatagctcttgggaaatggaatgaataaatccaagatcctggatctttgctctaccctttggcaatacttaggatgtagcaactgtgcaagttctcacagtcttaaatgaaaagagccaagccaaagctgaagctttgttgtatcttcatcaagggaggttcccacccaatgtctgttccacaactggatgccatgttttgagaggagcamcagagaccaggatggaaacagaactggaaaacttatttakttaagtggcttagtgaaccgctgtgtcactcagagatgaggcagcagcagtggttgagggttaaggctggattttgaacagttggagggctctcataccctaagtgttaaatccagtgtgaggaagagccacccaccatctggtcaggagtaaaatgaagtgcctctggggaacaaaggcttcagtggaaccattccagcagatatcatattctgaccattagaaatttgattaagggaagtgttaccctatatttcctgctagtctaagaggtctgacttttaacaaccataaaaatctatacagacccatgtctgtaatcccaacactttgggaggctgaggtaggaggcttgcttgaggccagaagtttgagaccaacctgagcgacatagggagaccaccatctctacaaaaaataaaaaaataaaaattaattgagcatggtggcatgtgcctgtactcctagctactcgggaggctgtgaggtgggaggattgcttgagcccaggagttcaaggctgcagtgagctatgatcacaccactgtactccagtgcactccaacctgtgtgacagaggagaccttgtctcttaaaaaaaaaaaaaaaaagaactactgagccataactaattaattgggtttttacagctttttgtcttaaaactgcccacatctctcatgaaaataatatggtgcagtattgtgtggccaaggtgttgtgtttgtgtggagggcctaccacagggggcagatgatcagaacttacttctactcagcaaaatttaattactttatttttcctccctcatcctgaaattaatacaggtttattgtaacaaaagtagtataaaggttgtcacctgcactttcactgcttttaagactattgactactgtattatttgtcacagtggttaagagcatagtctttggtctcttggccctggttttgaaactctgttgtggcactacatactaattatgtgaacttgctcaagcctttttttttgtccaccagtcgtggtcatttcctcatttagtaccagtttcacagaattgttatgatgataggcgagaaatgcatgtagaatacttacgacactggccaccagagttcaagtgctcagtaaatgttagacagctgcagtagtggtgctagaagtagaagataataaaactcagtgtgtatatatatatttttyttttgcaaaagtgggatcctgttaaatcacctgtcttaaaaactgccatttccttttatattgagcatttctccatgtcattagtctaccaaaccatcatttaaaaaatagctttattggtgcttaattcacgtagcatacttcatccatttgaagtatacaatgcagtgttttttaactatattcagagttgcacagtcaattttagaacatttttatcatgcaaaaggaagtcctgtaactgtcagagtcactcctcattttcctccaaatcctttactaakctactttctgtttctgtggatttgcttattctggacatttccaagccatgctttttaatggctgcacaatattctgttatgtggatataccttactttagcagctattccactgctgttggaaatttaatttattttcatgattataggaaatatttatattaatcttctttacccgtctcagtagagtcacctgagagtcttaatgaagattcttccatgttacttaattaagaagtaacataaaatcttcacctgtggtcttacatgcctgtgctgtgagatgttcctgaagagcttcaggctcctagagctgctatcacaccataacaaggtccctaacactggagccaagctttggtaacaccctacactgaggtccagttggagctgttcagggaataacagcagcagcttgcccaacaatkttggtacaacagtttggtgggagaggatgagtgacttatttgagcggagccattggaagacagacagggccatagtatcaccagctgttcacatagtgccacaacactcaaatccaaggacaactcttagaggaactggagtgmagggagaattattcattacatctgctcaraaagataragtgccctaccaacacctttgcaaattgaaattcccttgctcttggcatgtgatcatcctgccaactctgtgaaagctcccttagctactcagatgctgcctcctgggggcattcatccagttattcatatctaaatcatggtgctctgatgtggactgacctggggaggggaaggaataaccacagtgggtctggtgtgccagaatctgaaaggctaaattaagatgacttgcgaaataaagggatcctgaagaaataggccactgattgtctctgaatatattctataaggtcattttcagttctcagggctgggaaacacaatgtggagagaagcattaarttaatgctttgcttttaaatgttgggattctcatagaagaatccatttctgctcatttgctgtctggctgtcttaatgcattcaaagtgtagaacmcttgaacatttacatttatttgttgttgctggtgttttctctactctttgttggcctccggatggacaccctgttaatattctttgactagcgtggagcgagctgtttaagcttttttcaggggaaataaaaatgaaagttgttgcaacaggagttcagcagtgttgcaccaactaccattccagcacatccagtctgttcgtggtgtgtattgaaacctgtattttatttggggtggaaattgcttgaggcatttcaacttgtttgtgcttaaattggggatcctattgcagcactgatgttttataaaagttgtaggaaagtgtggcccttacattgcaggcaggtgaattcacaggctttgcaagtcggtgcatgagtactgtaatcatgatagtagacttgtaaaagcaaactcctgttcttttgtacgtgagcatgctgggacttctctcatttgtcggtctccagcagtaaggatatgcgctgggaagtcggcagtgaggcactgcattgagagtgaggcatatcacatgccacctcctccttaaagccttctctgatttccagcaaccctctactacttagaactatagacggtggttaaggacacatgctgtggagtcaaaaagacctaggttcctaagccagctccgccatggcagtttacttaaattttctccattttctcatttgtgaattggggataatgatrgtacttaaaacatcattgtgaagacaatagaaaatttcatgtaaggtgcataacttaccaccgtttctggcatatttagtactccctaaagcttgtgattactgttactaatcatatgttttgtggtctcttctcggagccttggttttgtcatccacaatataagaacaaaaacatctatctcaacagcagtttataagaagtaggagagacagtgctggaaaagcatttagccctgccctaacttagtcacttggcatttcagcatgtggtaattaatacagttataacacttcattctgttctatgtatggtaactagttgtttacgtattagtgtctcactaaactgtaaatagaggctatgctttcctctttgtatrtcccaaaacgccttcctcagcacaatagctgatcttcaactagtcattcagacaggtgtgtttgaacttttagatcacatagtttaagaacagatgtctcttactttgcttatagagtgaacaaaatatgataagtgctacagatgtctttttcttaacaaggatacttgtggtgtggttaccaaattcacacgaggcaagcatagtgtagcactggtcttttctcactgtgcactgtttgaagttggcctcagtgckagaaatctgtattacctgagcaaatgtttaggaattctctttgcttttgaatacgttgaaagaaaggaattctttctccaatttgttcagctctcctcctagttaaaaagaaactaccatatttgaccccaagaaagagttaaatgtgaactcatctgagttttcagaaaaggaaaggttgaaagctcacacattaattattactgctgctattctcttccgccccccagaatttgtcagtggaattttggtccctaaatgtataggcatgtttgggttagggtaggacataccccacctctggaagggcctgcaagcagggctgccggtgagcagccagtgttctgggttttgggggttccttgttctcagtcacctttgcttggcttttgcagagctcggggttacgaggcagactgtctagagcctctcctgcttcttgcaccagatgctcatgcactgtgccactagctgaggatgcaagggtgtgcttttgcttttcaaaagaggtgctgtaaaaaatgagtgcatggttaagatgygggccatgtgaatgttcattacaagaaccttaactgtctgggtaaaacagatgaagttgtaagtaccactgaaatttcccagccctattcttgtatccatagacttggaggcctcatattttaatggattttacgaattatgcttcctaaattgttgcatagttatattaggatataattaattcccttgaacacatctgagtcatccattgcatgtattgtcagttcttggttatttgatgtcctttttctaagtacttgcccaagtcagtttgcctcactgtgccttaatttccttttctgtagagcaaaggggtcagacttagatcatctttaaaccttttaaaaaattacttctttgcaagtggatacagctctccagttggttaatgataytcaaccttttcatccctacctgcttccaagacagccttagacagtttcggccatactcccagacctgctgtttccttacccatgatgtttaccttctcatttcattttgttaaaagagaagtgagcctaacatttctggaagctcagtaaaggttaacagccaaccagccagagaagtggggttgagtcatgatgcttctggcaggaccagggaggccctgccagaaccgtccagatcttcctgattagaaactcacaggccctttacagaaagttggcttctactgatttgatgattgactcagagggtttgggttagttggtttctaacagagctggcagggaaggagaggggtggcccaatacattttgagcccctggaggaatagggtgataactgagggagtagtattgttaggaagccctggcagctctgggagccatggggcaagaaaggacaattgctcctgcatctgcatctttttgtttctgggtatttatttacagataagtggttttttttaatgcctggtaatctattaggcagtaggataaaaagatgccctcaaggatgtctctcaaggctagaggggagatgcttattgtttatcaaagatctrctgagtgcctagcattgtgttatgggccttacatacatagtatgcctaattttaatatagtatgataaattctttgcaagtgatgtctgcaaaggactatgggaccatagaggagtggaggctgcattctggctggaaatgggaattagggggaacagacagtagagggaggtaggaggagtcaaaacggtttttcacatgagatagaactttcagctcttctgcagatggcactggaaatgtggtcactttcttatccaacatgacaggggactggcaggtggaaatctgtgccttgaaattacttatatttgtctgatagagctaggtcagtttaatgctgcctttcccttgtctgatagtgttggttacagttttaaaggcttatttgttcttttcagaaaagtggctaaagaaagtatgttccctcttgtttctttacactagtgtttaaaaacatcaagagtttctgtccctccttctcacatccctaaatgagtgtccagtccgtaatgttcaggcttgaatagaacggcatagcagtccatttgcctcagcattaggaatcttgtcctccccaggaacatggtgatgatccagaacggagtcttaatactaccatgccatcaacaggagcagttgcttttgtttaggaacaacagtttccttccatttctgtgcagtagttgtctgtaatgactggagcactgtcttcactccagcagatgcacgataatttcattgcattgcctattctgatctttttctcatccagtttgattccacaaatgcctagtgcttcacaaagcctggatagaactggtcctatgggtgttttgttagaaagttccatccgacacatggacttccttctcctcaaagccttctgcgtctccctggcctggaaatgatcttttcccactgctctccattgcaggtctttgtatatctctctttgctcttaccacattctgccctttgttagttatacgtatgtgcatcctgtctctcctaccaggttgtaaactcacttaggtaaggactgtgttctatacatgcttcacaatccctagcatgaggatttgccataataagcactaaatgaatatttgttgaatcgaactgaatccagatagcattatattgaactgagtcctcatcattaagtacaaaggaattgttagaaggtcagtaatgtttacttcccctatctgattcctagtccccagttctgtatttaattacttaagatatatgtgccatctgcagcctgaaggatttggcagccagtgattcaaatacaaggtaaaatgaggcagtttgggataagatcaatgtaatacctctctgtaggagacagcggggactcaagacacctgatttcagcagattgcagtaactccataatttatttgcatctaagagaaggaatcatgtttagttacagcattttcatttttttttttttttaaccacagatggcataaaattcatctccagagagacttctaactaaacctgagtatgaatttttatctctcagtttcttatgcartttttcactgcatacctacatagccttcttttggaagttgttttattgacttttaaattttgcttttgtgtgttttacttgctgcttctcttgtcttctccccagctgatttttcttaacaaaaaatctctagagatgaagaaccgtggcagcacagtagcatcttcattacatttatgatttgcattcccagctcagcactttgcaatgcatattttgcaaagcaagtttaatttgctagaagtcagattgagatttagcatctatctttttaccatctgttatatgccaggtataatgctggacacttgcacacttatttcattttatcatagaaaattaaaagagaaaattatatgattattaagagccttgaatctcatactaggggaagtagtcctctgggttttatgtgatggtgggatgagataactgatgttaaaagacaaacgtggtatctttctggcatattagttttactcagagattttgagtgggaggagtggaagaacttagacaatttaagtgactagtaatcattttatatttaarcaaccatggaaatacaaaggagtgcaaactatgcacaagtgttggtgataaaacagagtctttattaggtttatgtagttagagtagtgagtgctttaggatgcaccccctgacttctaagggatactttgtggaaaagctggagatttccatctagtaagtacatctctctccttttttgtaaatgtagaaattgaggtcccagagttcacattcctattgactgaggagggattttaactcccaactcactgattgaccctcacatgcctgcttcttcttgccctttggaatctttggtgctgaaccagaccctcatgtgtaagcccacatggtcaaatggagccgaatttgaaatcagttgtacttgcagaggtggcagagtaccataaatgaggctatagagtgggttgtaaatgccaggcctgcttctttgcagtcacctgtctctgtagccactggggcttattcactataatccatgtttttttgggggcaggagattgacagccttttggaagatttaattagctgctcttccaggaaagatagcttaatatgccaaagattaaacttattgtgtcttggaatcacaaaatttcaaaattgaaaggatccttaggtttcctcagccagcattcttgatttatatatttgggatgagataaaaaggttttctcaaatttctggttgtctctatttgaagttagataggtggctagcccgttagttgtttacttgttttattgttcctgatgtctttaaccgaagactgggcatgttgcactctttggcaaagtaaactagggcaatggtgttgatgtctactgatctgatcagtggtttgggatagataattttactcttttccattggtaaattctactttcagagtagcctgttagaaaggatgaaaagctctgaattttctccatttttttttaatgtgatactagagaggaatgatacttcttcctggtwgtgtggaaagctacatctaggttggttataattttcattttaactcttcctccttcatacagccctagacttctcagtgtttaaatctaggtgtcaggcctcattcatatgtatgtatgtattctttttcttttttttttagacaagatctgactctgtcacctaggctggagtgtagtggtgctcgctgcaacctccacctcccgggctcaagccatcctctcacctcagcctaccaagtagctgggactacagacaagtacyaccacaccagctaatttttgtattttttatagagatggggttttgtcatgtcgctcaggctggtctcaaacccgtgagctcaggcaatcctcccacctcggcctcccaaagtgctgggattacaggcgacagccactgttcctggccctctgtatttcttatgatcttaaatcctggaggcacatgacatatatgctcattgatattccattttggcagtgaatttgataggcatgataaatttggttttgcattaaaatatagtgacttttctgattatgaaagtaatttcccttttttattttattttttaaagaacattrtaagtaatttctcattataaaaatgtggaaaatacagaaaagtacaaagaagattgtgtgctaattttgtgaatactaatagcattaactagacaggaatatgttaaaatgtacttttctatgcattatatagtaatagtgaagactttatatagaacatgtaaataattgtatgaagtagttagtgtacaaaataatgtcatatatgcagctgcattttctgcctttttcacctaraaagttttttygtcatgtcattaaaaacttttgccctctgttttcatgactacataatattctgttgtgtgggtgtacctgtcttactgcttcacctactttattcatattcctgttactgatgttggtttttccatccctccgctattttaatacgtgcgttgctctgttcatctttttgatgattcccaggaagggatctcagtaagtagagttgctgggtctagggcttttgaacattgcccagttcctcccagaatgcttccaccagtggatgccagtgtgtcccatcttcacggataaggtaggctctgactccccattcacaggatttgtaaatacttgctctgttctgtgccactcagtgttcccatagccctgcaagaagggtaccacactacctcattcagggcctggagcaatccccaccaccccttgaactggctgctttctccccatttggtttttagtcttcattcactaatacgacagtctgtcagggaagtgccaggaatttttctcaacatacttttattcctttttttattttattttattttttaaagaacagaaatggctctcttaaaattagtagcagctgggggctggttctggctatgtgatccaatgcaacagtaacataaatgagggtgccattctatttctagctgcagaagcttccttgccatcttagtgttcttcaccaaggtgctcaactagctcccttgcaatttcttctccaaataaccacagtaattgctacagaggaagtgaaaattgtaaaaacgcttcagaagactgacagtggtgctgattataggagtgactgcttttaagttctaataaattgttttaattttcttataatttctactcagataaagcagactcctagcttttaattctgcttctaatgggttttttcccttcccacttctcctgtagtagggcagtgttgcagtgatgagaccatcagctgaaggccccattgctttgtcctgctgatctttttttccattggccactccatttgrcatttccactgacaatgtcttatttctgagatgaggggaaacgcttttttaagtgtctagkctatatttgaagttagatgaacatggactgaacyccaactctatcacgtagtagttttaaggccttgggaaagggacctaactgtaaaaggaggtgataataccacttcactggctatgagggggattaaccaggatggcctgttaaaaatgcagagagctggcagagtgaacagtaaatgttttaattcgctgtgtcatttgcccttagctaggctgtttcacctgccgactcattgtgttgctatgaaaatgaaaggagatgttcgtgaaaatgtctggtatggtatctggcacatagtagtgcttgccaatagtagttctcctccttgtagctctgtctaactccatggcacagctaatgcacctcatcataaaaacactgggctgggtatggtggctaatgcctgtaatcccaacactttgggaggccaaggcaggaggatcacttgaagccaggaatttgaaaccagcctgggcaacatagtgaaaccctgtctctacaaaagaataaaaaatgagctgggtatggtggtatgtgcctgtaaccccagccacttggggggctgaggtgggaggattacttgagcctgggcggtcaaggctacaatgagctgtgactgcatcactatgttacagtgagaccctctctcaggaaagaataaaaataaaaaacaacatctggtccatggattccatcaaacaagtgctattcctttttgtcttgtcataaaaactctctatcagtggatgctttctgcacgtccatttgctaatagtttcctgttccttgttttagctattttggtaaaagtgactaatggtgcagcaaccatttcttcaccagcccttcctcagctctcctctccactccctcctcctcaggattatagggtccttcttgctgctgtatcaggtctcagctcattagttgtttgaggaaagggcctgccatgccatgttcatcacttcagccacaaaggatggcttttactcagcaatcatgtgctgaacatctgctacattccactcttagcactagtgaaacaaacgcgtagcaacagagccccaggcctcaaagctcacaatggaggtaactggtttccaggttaagtgcactaaactgtgtggaaggtgttatgatagtacctctacaggttctgatggaagcatcartgatggatttggcttttccatttgggagaggaggctataaaaaaccttcctggaggacgtgggctcattctgattcacagacaggtccagccccttcacttcttactttgaactactccatctggaatcatagaaactcattagcagctaagtgagtcgtagaccctgttcctacagtttcaacaaaccctgatggtggcatttcagtttatcgtagaggtttcttttcccctacaagggtcattctctcttgcccaattttggctgaraagggaggaatatcatggccgttttggctgtatggtgttactgtataatgatatggggattggtgagtgaaaaataaaatgaaccctcacttgcttaggtaccagttttatgtaagaagaaactcacagcttttgcacattatttgagatttgcttcttctgtttaacatatttgtggtactttcctaaaaagttttgttatagacagctgtagagattaaaaaaaaaaaaaaagcatgatgtgaaactaaaagcaaaataggaatgagtctcaaggtgtataatgtaccaaatgatagtagggcctggaacattcaacagcatagcctgtactgacataaggttaagaaacattggccttcaagtcactttagactcttcttaatgagttgtcgtgttggagagcctgcaccgcattttgttatttgccattagttgatctttggccagtattaattatttacattgagctgcatattacagggggaaaatcccaaataaacagaagcttaaatgcgatagtttatttctctctcctctaaaaggaacttagacataggcctggaatgccaggtttgtggcgtcctttgggattcaggcctccttccttttgatctcaccttcctcagcacatgacttccatcctcaaggtcacctctcagcttaagattgctgccagagctccagctgtcatttctgagatggagaatctaaaatggaagggcaaaattgggctttcccagctgagccacttcttttccagaacccatataaataacactagtatttattgaccacatttgactgtaagagaggctaggaaatggaaacttgtattttcaaaatattctggtaaaaaccaggattctagtactaaggagatggggagaatggatgttggggcagcacatcagcagtgtctgtcacaaggccacatcaggaatacttggagtagaaaagagataaagcttagtgaagtgaggaggtggagaagttgatgtttaccaatatggataccaaaactgctgagagtgatgttgcagtagaaagaattgtgattagatggaaaagttattgaagtattagtgtcctggagctcagtagagaaagatggttggcatagccctcagaagaggagactggtatgaagatggcataatagtggtcacaggtgaacttgtggatgggaacagacagtagaaaagggacagcattctttgagaataggtcttgaggaaagggaataccttttaagctgaaaagacrgaagtgcttttctctcctagccatggaatagatgatgagttggtcctctgcagagaagggacccgaagggcacaggcgaagggagtggccaatgccagtgggaagatgagccatgaaaccaggtagagggagtagataagtgggatttatatctaggcctaggctagtagctgtattaccaagaaaaaaggaagctagcacttggaagttagggagaatgggaatgatggatgggcagaagtgttgtgaattggtttgggtgctcartgttgctttttttcttttgcattttccaatttcctctgtacgccatacactgtaatagtcattccatttaaaattgcagctgggtagaccagatattgctagggggcatatctgtcattgaacttgggaagcaggggaccctgctaatggaggcactccagacacctcatgggagcacagctgggaagcaacaagtggtctatttcttggctcagcctaattcagactcgcctcttctccttagagaaaggaagaggagcctcttccttatgctctgctcaatgtgtagggtttttcttcctatttgttgcaattctgaacattattagtggatagtcctggttttgagacttacccctgccttagaccccctgttcctagctcttatttcctgggacccagtttcatttttctctttctggatctcaactctcatccctgacagggcatgatcattatgttatatgatctctcttggttatatacaaagaatgtaccagtttgtggagtattcatagactttttttggttttgtttcttcttctttttgtaaatcctagaatgatcccctcccatgccaccaccatgatttgggactgcctactattttccttgtgaactctccctgcccaattgatatgtagtattttttgcttgtttttactttttgatatgtattattatttctgttgctgtagtgttttgtggtttaatagaggctcttgtcacattttctccactaattgtcatagtaaaattgtgacgggagcagacagtagttgttacttatttacaaatcggtaaccgaaattcagaaaggtcacccagctaacttgtggaagacctggggttggaacccactttttctctctctctcttaaagttcagaagttcagagtaagcaaatgaatgttaattattggcctgaacaagatctaattaaagtggtcagtctgctgtggctgaagtagttgtctgcacatcccgaccacatctaaaccagtcttggattgtttaatgtttagtatctgtggcttagctccctttcgtttgcaccagttagagcatgtagatgccacagcagttccatcctgaccctgtgaagcacgtttttgcaggtccccaccttgcaggtgccactgggaagcgcagcatgctgtggtttggaaagcctgcccaggcattggtactgaacaggcctggcaatctgtgtttcctagtgtgggtattaactctgttatccttgatacagcacttagtatttctgggccttcaactcctcattgtgaaattggggtagaaacaggtagtttttggacaatttgttacctctgcaaacctcagttccctctcatctgtaacatgggcatgatgatacccactttgtaatgtttcaagattaaataaactgctgtataaaaggagctcagtgccatgcctagcaatacagctggtgcttaacaaatgttccacccttttcttcctcctcctcatcatttcaatatgttttgagagcatcataaaaagtggtatgaaggttaaaaaataaagtcagggatgtcacagtatgaaagttgttgcccctccagtagaattaatatgtggggtgtaagtggggggaggaagcttacctttttgaccccaagtgagagccttgcatgattgttttcttaaaaatggccttttctgaccaaattgaaggtgacgcattctagactttcatttataatgtccatttacatgcagtacttctatattcagattgacttcctgtcacactgagtgattggtgggctgcttgccagcctaggggtggactgcagcaaattgtgtgtgagggaagccagcagtctgcagggctgagctgaagtggggagaggagaagagcatgggacgtggtgtcragtgcagtggcattgactgcagacaggctgctgctttacactgggggattcattccctttcccccagtaaagactgttaaaatatcagaactgatagtataaagtcatgagttttttagttcatgcagaatgtggatcatgtctgagataaaaattcataagatttttgaatatcctggggctgatggttttaggcagtgaagttaatttaattttattttttattttctgtagctgaaacgtctgcttttctgtgaggacgttgattatgtgttccactgccaaaagaagtttctcattttcaaactgcagctcccctagttgggcaatataactgtaatttgagaatcccacaagggtagtctgttactcggcagataaccctacagtaaatttgcatgaaggcattatttaaaacagttttcttctctgacctattattgcacagcaaaatagcagtttcctttctaaggtaagagatttggaaggaggactcaatttatacgtgatctcattgagagtgagagctgcaaagatgaggaaaagaagtggaccttttaaaagttttttttttttttaaacggttatgttattttattttgttgaaggcagaggatatgttttattttagggacccaccagaattgcttagaaattatctkcaggctttagggatttttgcttatcagtatatttcatttgccccattgttcagcccatccaccacctccttccatttgttctcagaaactaaactaggagaacataagcacttggttatgtgaaaatgtacttatgattcttccatgaaaacctaaagtattaaaaacccaacagttcacttgtgttctttcatgaacaggtatgtgcatgctatgatkgctttcatttgccaagtcattttttaatttaatgagctgtcactctgctgtcattggatcagttgtagatgaggggacaccttttggccttcatttgatgtctttctcacgtgcttattccctcatcttgtttggttgaaaatcacattggcaaaaccaaatccagaatgctagggtatgactaaatggtagaacaagctaagcaactatttctaggggggawaatttctgtgctaggctttgttactacagtggttgaacatgggctttagaatcagaaagatcagttcagatccccacattggaacataaaagttgtgctatcttgatttaatttcctttagccttgttttccttacctataaatagaaattataatagtacccacctgtaatggttggttcagtgagataatgcctgtgtatgccttgggcctggaaatgtccctaatgcagaggacattcactatcaaaagggagagaaggccccctggagttgctacgggttgcagtattttttttaaaaccagaattcctaatgggttttttttcccctccttttagtgatattgtattttgcttaagtgtgttagatttagctctcgtctggtttgtgttcaagctccctttcaaaggtgccatcagtgctcaaggccaggggttcagctgcagggatggtggatggtagccagctcttttaggcatggtactttttttttttttttttaaagacagggtcctactctgtcacccaggctggagggcagtggcgtgatcacagctcactacagcgtcgacctcccaggctcaagtgattctcccacctcagtttcttgatagatgagactacaggagcacaccaccacacccagctaatttttgtattttttttggagagactgggtcttgctatgttatccaggctggttttgaactcctgggctcaagtgatccacatatttacagtggttggtgttcatttagaatttaatgaggtgaacaagagtatatttgcacctacatgttctaggctgaattcggatcttctcatttagaaggagtacaattaataaatcattatggatcgtattcaaattactatttttttttgagttgtttttgtttacttaaaagtagatttttaaccatctagcttgacatactattattatttagcctaaaatctttgctttctataattataagtaacctatatcacttattttgccttttttttttttttgagacggagtttcgctcttgttgcccaggctggagtgcagtggcgcgatctcggttcactgcaacctccgcctcccgggttcaagcgattctcttgcctcagcctcccgagtagctgggattacaggcatgtgccaccatgcccagctaattttgtatttttagtagagacagggtttctccatgctggtcaggcttgtctcgaacttccaacctcaggtgatcctcccgccttggcctcccaaagtgctgggattacaggcgtgagccaccacactggaccctattttgccctttttaagtactggcttaacgagtgaaaaagatgcatgtgcactgaaaaaagactaggaaaagatagaatacaatgccagtagagattgtctctatgagacagcataggctattgttattttagacgtaaatttctctacttttcaaaattaccacctatttggataccttttcttagttttataaaatatggccattrgggaaaacttgaaaattgagcaaaatacagagaagagaattttaaaatgacccatgattccaccactcagataactacagatggcattttggtgcattgcacttgtcacttgtagtcagaacagcaaatgtgcttcattttccaggcctgcaatttgttccttttgcacacatttctgacaacctgccctggactgcgttctcatagaatggctgtcctccccactgtgggagcccttgctgagcctaacaaataaagcctccttcacaatagagctaaagaggagcttcatcagagaaacactgccgccttagtagatactggcccaggttggtcttgagtcccaaacttgtacagtgggttctcaaagtgtaacttaaacattatgttggcatcatgttaagcttgtttatttatagtaaagctcaaatatatagggaaatggaattgttcctgcattgagcccattcagaaaattttctgtcaagtttgggcagaatttaaagactatttcctttggtgggcatgaagtagtactgtttaacatgcttgctcaataaagttttcagactttttttttttttaactagagaatatgtgatttggtgattgactctataaatagtgtgacccatttttaactagattgctgatatgtttttcagcaggactttgtggtttagttaatgaaatcttttcagggatgatcctctgagccttctgtctagttactatcactgctgttgcttttatgacttaattgcctttgtggtttaattcacttcatgacacatctatcaccatgaagtttagactcttcacccctatctttccgagtatttgcttgatgactcctggggtcaaggagaggttgataggtggttttatgctgttaaaaataagtggtcttggctaacttatcacttagttaaaacagtccttttaattttaattaatgcattgaagctacttcttcctcataattttctacttcataattctgttgtctgagcccataacaatrgttatttctattatttgtagagaattataaagctctttcatatttgttctaccatttaatccctctatctttatctcctcccctcccctcacccccctccccccccmaaaaaaaactgtattagccccattttgtagatgaggaagctgagacaaagaaatcataggcaagtatgccaggtcggtatggttaatgtatggtagaactgggaatttctactatagaaactggacgattgggatattacgatttagaaaagagcctctgtttttttattgtctgctattactgaaattaccatagtgttaacatcataaaaatatgtctaaagactcatgctgagttctggattttgacagattttcaactaaacctaggaaatttgcttggtcagtctttgatttttgtggacatggttgggagttcacctggcagtacagcttgtgattaaaagtccagttttagaggaaccaaaatctgttcttcctttagagccaatctctgtttgcattgagttttctcattttcccctagccatgaatgaaatatcaggaaattccaaatgcatctcaatatcagaactgtcttctttgtgctaccctctgcatagcactcctcggtggctgccctttgcttctgtggtgagagccgcatgtggtggtgcagcccacaaggccgtcctggtcacgcctctgtcttgcctcactgcttatcttgcctcatctgcagcagcagttgcataccgtgcctcatcttatgatgtgtccattcatgtcagcccagctatctacttgttcatctcattgattctgcccattgttgaggacttagtctaagtgtcawagcacccaaagtcttctctgataccttgccacccatcacctctctgttagtcaggatgagttagtttttctcctctgttgttttataggaaattgtgtacctctgtcttagtacttattcattctgttgaaattaattgctcacctgtctctctgtgtccaccatttgactcccaagactgaatttcgtaaaaagggactatgccccaaagcaagcattgtgctttttaaaatagtaggcactccagatattatcaaatggataatccccctgcctagcccactctttgatggataggtgcttcaggacatgtttggtgaagtactgaaaatctaaggctaccctggtcaactctcacctcttttattatgcgtgtaagtcatttgtggtgtggagcatcaggcaaatttaaaataccaactggctccctttccctcaactgcccgtgatagttgtagactcttcattgtcattcttttttttgaggcgcacaccaccgtgcccagctaatttttgtatttttagtagagaccaggttttaccatgttggccaggctggtcttgaactcatgacctcaaatgacccacctgcctcggcctcccaaagtggtgggattacaggtgtaagccaccatgccttgcctcttcatcatcattctacaggcccatttcttattagttgataygtactgagggagttgaaattatgttttatgtctgtcaaaaatatagatgttgaaaaattaaatctattgttgaaaaaactttaaaaatgatttccggattctccatgtttgggattcccttcctgatgctaatgttaattgctttcttccttgatgctaatgttaatttgactataaactattgttttatcaaaagatcttagttacacttactcaatttttgcttaagatactacaattattttaaaaagaacatccgtatcttattctaaaggactgaattatttttgtatacagacatacatacagaataaaaaatgtacaacttgattttagtctgtttgatttaaattttatatattgagtagttcacccctgtctgcctgtattcaggtttcttattttgatcataacatggggttgggttattttcgagtttggagttgagaatcttatttttataatccagtgggagaaaacactcaagtatattttgaattggacaactgtgaaaatcttagcttatagaatctaagtttggagtagacttttgaagtcataacttataaaatttatcactaagatggatagttatgtgcatttaaaatatttctataataattgaaggagcttgtgataacattataaattcaagaatgttttgctagaagcaaattgactatgggttttaaaatgtaagcatttcctaaattaattctatgtcaggaaatggagacaacttttgaggaaggaagctgcttgctgaggctgtgcaaacattatttctctcaagtgtattttaacactaaagttaaaaatccattttatatattaggaaaggcaacttaaccatagtagaaggagtaagaaatttggagccagaaattcctgatttcaagctccgccatcaccggttactcctttgtgactttggactagtgttttgactttccgcaggcttttggttttctcattggcaaattagagcgtgggaattgggaaatggaggtgcttatcgctgttactcctacctcaccaagctgttagatgatcacttgagaggtggaagggaaacatttaaattgtccagcactatgcagatgatgtgtatctttctctcatagaaaggtggttacctgtkgggtgttggggagaaaaaagtaagagaaaaactagaggcaggtggcaggtaaaattttaccactttgctctggattgctagacccatttgaatcactggaggaggaacaaccatccctagtctacttggcgtggcttagacctaaatctgtgggccccttgccataggttgtacatattatagattaacagttcccattttgagtccctctttattttttgccacaggatcagataaaaatctgtgacttatagttaaatattatttcctgaatacttaattatattcacttattcaagaaatatcaaatggagcacttactgttttatagtaattgttctgggtgttggggattacagcaatggaaaaagcacagacagaattcccttcttcatagagggtacattgtagagggagacagataaagcaaaaaaatgtaaaattaagttcaggtactgataacttttatggagaacacaaatagggtgacttgatagagcgagggtggaaaaaacttagtaaggattgcccagaggtatctctttaaggaaattatatttgagctgcatcctgagatgtcagaaggagccagaatgagaagagttggccaggcacaagtgctccatactgagggagctagtacagacactcagacctgggtggagtgaaggaaacatgtttctagtttgttaggctctgaggtctctggcctgaaatacttaaatttttaattggaggagaaaagcaccatagagataagacagagagatggggaatacaaatacatgttaagttacatggtccgagcattgtgagtatagctgaagaatttatgtggtccattggtatttacttaaagtttaccctaaatatatgaatgaaatggcttcctagctcctttcatccttacatctgctaatttaaccttatgcagagagctgagtttgttccgyttgtgccctaaggttattaacatctgtcccttagtctctccagtaaaaagtttgagaggaaacaaagaaccagctctacttagacctttgaccaattgatcatgtggatccttgggggctttatgttaatgtcaatggataaggtattctctttgcctttgaattgattttgtggctttaaaaaaacatttatcaaagactaaaggggttgtcagtgtggggagagggacatttaaaaaggagctattaatccaagtgactggaaagaagtcacttatgtgcatttacagtgacttgctaaatagaagtcaggaaatatttgagtgagtgaatgacttgctaaatgataatacttgtagtgaaaggtaacaccttctaagtgcctactctgctagattgcctgcagtatcaaggtgtttctatacataattttccctgaatctctctaagaaacccgtgaggttagtattactatcaccattctttatatgaaaaatttatggcttaactagttaaccttcttgctgaaggtctcatagttggtggctgaataaatttggactgaggactttatgatcccagaatcctagttaatcataacaagtcatgacttgccctgatgatgttggaactgtaagtaagggacattgagtgaatattgtctgggggaagaagtgatgaataggagtaaggagatctaacctaagagcttaaatagtgatgtgaagttcttggcactaatccttaagatacctctcttagagccttgagggggtgccagtgaaacagctggtagtaaagtccatttgagtggtccagttttggagttgcttaagggtcagatcactttctatttctgacttaaggctagtgtaactgatctggtctttagttttctcgatttataaaatggagatggttaagtgatggatataaaaatgaatgaataggctgggagtggtagctcatgcctgtaatctcagcactttgggaggccgagggaggaggatcacctgagatcaggagttctgaccagaacctgaccagcctggccaacatggtgaaacaccccctctactaaaaatacaaaaattagccagacatggtggtgggcgcctgtaatcccagctacttaggaggctgaggcaagagaatcgcttgaacccgggaggcggaggttgtggtgagctgaagcttgcggtgagccgagatcgcaccactggactccagcctgggcaacagagcaagagtccgttccaaaaacagtgaacgaatctttcattaattgagtacctacaatgtggcaggaattgtctaagcactatggatagaacaatgagaaagagactaagaagtatgtgcattgaatttgttttttagtggggacaggcagtcaagaaataaacagtatgttaggtgtcagtaggtgctatgaagacaaaaagagaggagatacaagagagaatgattgttgggcagtgtggtagcaggaggggagacttcatgagcaaacttaagttgtgatggagtttagctgtgggggtccgacagcacgaaggtcctcaggtaggttcatgcctgacacattcacgaaacaacaaaaggaggtcatgtggccaaggtgtagagcgtgtgaggaagaaraggttggaaaggtggcaggagccagattatgcatggcctgctgactgctgtcaagactttggcttttactctaaataatagggagtctttggagttttgttgttttgggttttccatttgtttgttttgttttgtaattttgagaaagacaagcagcactgaattaccatatttacacttaaaacggatccctctggctgctctggaaaatagattgtgagagtatgaggtggaaagagggtgcccagttaagaggctgttgaagtaagtagtttaggtgagatcatcatttagttggtgatgtacttcctgtgtaaaattgaaaacatcacacatttgaacaaggttgaaattaaacatgagattgtcacatacaaccactgtcactggggtgggcagatgcatagaagactattggttgtgtaaacgtaaattggacagcgtgtttcagggagtgcagatgcgtgaaggttggctttgagcctctgctagacttgaccaggttcataggttaaaactgtttttatctttattctttcaatatattagtattacaatagaagacttagagaacaattgaggggggaaatgatgttcctttttttagggtgaatgtgtcagactttcaaagatgactctttggatattaggtgttcatatctacttagaactggaacagaaacataaaatatacaaggcgttcttttccgggcagtataaaaaaataatatataatcagttctaacataagatctaggagccgtttctttttttaagccaaaaaggcaaaaaagactactccattaatccatgtttctcagtggagatggaatgattcaatttgtagagtttttttttaaagagcagttttaaatttacagaaaaatcgagccaaaagtccagagttcttatgtaccgtctcattttgctaccattgccactgtggttttccctattgttaacatcttccattagttaataattaggtaataacatcttacattagttaataataatgtattgatactgattcattaaccatgacaagggtgccacactaatgtaagttcatagtgtagttcactctatgttgtacattctagggatttgacaaatgtgcgatgatatgtatcctctgttactgtatcagagtagttttagcagcactaaaaatctcctgtggtccacctagtcrtctctccttccctcatcctaaacccctggcaaccactgatctttttgctgtctacatagttttgcctttttcagaatgtcatatagtcagagtcataaagtaaagtatgtagccttttcagattgacttttttcacttagcagtacgcatttaaggttcctccatgtcttttcccagcttgataggtcatttctttttatataataatataaaaataatattccattgtccagaagcactacagtttgtttatcctttcaggtaatgaaggacatcttgattacttctctggaaacattttttggtcaccaactaagtggtagaggggatactggcaattagttgacagagggcaaagatgctactaaacaccctgcagtacacaggagacccccgcaacaaagagtcatccagttcagaatatcagtaatgcttgaggttgagaaagccctagtctaaatatatcttaaatagtataaagaaagtattttaggcatacacttatagttttgctgtgctagaatagttggagaatctcagccttacagcaaccccaggagcaaggtgtaatacaaattccattttgtagctgaagaaacagtctaagatgttagcatgcttcctgtcattctgctagtaaatggccaaagccaggattcagacctggagcctctgtctccaggctcagcatacacaggcacctccaggtgtttgtggttttcccttctgccttargtatggattctttggtttttaaccaaacaaaaaccagagtactcttttttttcccgtggtgacttaaatttcttgtaattgtttttatttcagttctcttgagtacataccaggtcttacaatgttgtagaaacagcaaagaaggagaagacacgatctttccacaggaagaagaactttccatctgattgtcttctggagttcttatttcttcatagttttctccccttagaagtgattgcaccagaagataaaggtacattggtacatgtcctctggtgattcagctcctcctagccccagaaccaaaagcctcttttctccagagaaccgtttgtttaatgaagctaatgaaacttgagatgtccccaygtgcccctccccctcagctggtgtctctccagggcttggctgccacctttggccttctttctatggccattaatctagtgctcccagcagatggcagctgatctggataaagaacttggttgttcttttcagtgcccattagaggcctgccctctctatctgttcttcctgtttgccatgaagaacagctggccgtgttggtttaaaagccagaatttttatttgtttggagttttgcctcttcatttttagcatttctctctcatctctttctgcctttgagatagctgttcacagtgccacattttctgtrtctgtgaaaaaacgagccccttaacctccagtacacaccatagacatactcacccccttctaaaatatttattcttttagcagccctggctggtttccattgtgtttatttaatctttcaagaattttcttataaaagactggacaatcaatgcctttttactgattaaggtgaaaagttrtacatggtttttcaaatatttgtgcaaatgagagaatgtatgagtctttgcatgcatgcagatattatacctaatgttagactatagctgtaggcagattatctatttacctgtctttctctccttttggaatgctaactcttaaagcacagagaatattagtagttgagtacttaccaagtagcaggctctgggctctagattttggggacacccctgccatcgtggaggttacagtcttctcattacaactctgacccagtcattctacttctttgaagattatcctgtatgcaagctttacttagaattgcagaaagaatgagacatccttagtggtaaacattaatgaaatctacgaatagatactctcaacaacaaygcatatgcatatctgttgayatggaaagacagtcgtgttgtattaactggaaaacagcatgatataaaacaacacagaaaggatgatcccattttatgtacctataaggaaatattgtaggatatatttctggttacattagttatttctggttgctagagtttaaggacaattggggttttttgggtagtgaacatgtgatttatatttaatcaatatataaagaaatagagcaagaaaaaaacaccactgccatgattattcagataggcagacttttttcattcattcaaccactatatatggagtgcagctatatgccaagcacaaggcagagaacacaacatgctacagaagtccatgcctttagagcattctagaacacaatttacattaaaatgctactaggtaacagaaggagcagcagtgtatgtggattagagtcacctcaggatttccatcgtttctcagaacacactgttttgtttgtgggtggaataaaggaggctgccatgttcagtgtacataaagaaagcaggaggttttctcaaagagcaggcattggtacaacatgtcatttaatagttaagaggtgggggaaggtagcctaatgggttatgccagccacttatctttaggatagtctggataaaatataaagtactatttctcatgtcstctgcttatgctgggtccccatacaccatctgaactaatggactttttggcatcatctccttaaatgcatcatagggaatgaatttctccaccaagaagccccattatggctttgtcagcctaggttttgatttagcgatagcaatatgtgccttccagacataggatggcaatgagggagggcctctgctggtccttaagtgcagggagccccccttcttagagattaatcatcattgtgacagatgtgcttttgctgaaacttggtccagagagcagcagataaagatttggatgatgtctccttccttctttcttggccaaaggaagccagcccagtgctgggctttcaagaatccagttgtttagaaaggagggaggtaataaagcagaaaaagatgttttatttttagaaattaatgtgcagctttctgatctcccaatccagttcaggttctttcaacttcattatctgttgagaactattagcctaagaaatgatgtgactgtggttctctaccttggctgtgtgttagaatcatgctagaaactcttaaaaatctaggccacatcctagacaattaaatcagaaactctgggggaggggtctaggcagcagtgttttaaagctgccaggtgattccagtgtgctgctagaactgagaacttccacaatatggttataccagctacacaaggcagagagtttttaccttgaaaaaattaaaaaacagcagtagtgtaaaaatattatcctcttattaaaagaagaaacatgtgacagagtgaattcatttagatgtcttgtttggtttgattttaaattaccacacttaaggttgaaagccttatctgttgttccccattctcatggcctgatcactgtgaaattctgggaccttagaagccttttgtattgactgctcgctcgctckctctctctctctctctctctctctctctctctststgtgtgtgtgtgtgtgtgtgtgtgtgtgtgtgtgtgtgtatttttcttttacttcttgtttggccaagaaactgtatgtgttaatagcttgtttgtttttcgtcttttgttttggctaaattgcttttcaagaaactgcctgactccttgtttaattaacttccatatcctgcatatgtggctcatttcacagtccctccatcccttagtggttttccagtccaccacgaagatttgtatgaagaaaatagccacctcatctatttatactattttatcttgatgtttttcattgtttctctgaagcacattatttctgatcttgaaatgtaatgttttaaaatatatttttataggaatttatttttctcctctgaattgcctttgttgttattcctttggattttgaactcacttaactctgtgctggaaagtttctgctgatttttgtcttcttgatctctctgtttctttaaattctaaattattttgcatttttccttactgttgaattgcaacacttagtctctctatcttgtcacaatttatggagaatgatagcagaatccatctcaatagtatagcaactaaacatgtatatcatcgtttcctagctgacagcctgcatggagatgcatcctttaaaaaggggatgaggatgagaaaggtactgtgccatatagtgttgggcatacaaccaagacggcagtagacacaatttgttagtgatgtccagttactagtattgctgagtttatttgtgacctacttttttaccttttgtattccctgtgcatacgtgtagcattaaaacagtgttctgttgccaacatctccaaacattagaaacataagtaactgtttttttcagtttccctgggctccacagaatgtagagtgggcacatctgcacaaagcacagggcacagcttgcccttgaacgcttcacagcctctgtcgttgccactgttatccgcttgtgtactcatcctagcctctgggcagacctgcagaggcacggacacacgggcatccagcttattccttcccttttttcacctccccatttagcttgtcttctttacccactttccacagtcctcttaggtaagaggccattcatttcgttaataaggatgtttgtttatttgtgtttcgaaagtacatgctatgttccaagcactttgctagctgctaggatgcaattgactacaagacagatgtgttttctgccgccctaatacctgtaatctggtcgggcagacatatgaataaacaggagtttacagtggagtgtggtcagtgctgtgatggagttagtgcagaggttctgggagaccatggcagggcacccagccttgtctcccgagtcaaagaaggatgtccagaggaagtggcacctcaactgagatcagagggatagaggtgggagagaacctgccacttttgaggaagtaaaagatgtatgttatagctaaaggataatggggaacaagamcggtaatgagcctggaaagatggggggcttatcttggaaaggcatggaaagcctttagggtttgaagcaaaggattggcatgctctgatttgctttttagaaggaccattgtgactgcagtgtggagaatggattggagagggaaagcataaatgaaaggtaacagtgtttgtagacatgacccagtgagagctattggtggcctggcctcgaagaggagatgggatggagctagcaaagatagggattcaggaaatatttaacccatgccttctgtctcagggcaggagtgattttcaacccttgaaaatgagggcttgtcctgcctgtctgccatttggagtcttcatctatgttgtacatcatgttgaaaagatgtgtattagcttcctactaatcaaagcatgtttgtggatatggacaccattacaggtttctcatgcttcccttggctcccagacactgggctaaagtgttggattggttgtgcagtatccatacttgtcaactagctatttgtcatttattttgcaccctagaggccaaaaatgttagagcagaatgattccttaagttttatcccatccaacacccatgtttagcaatgaagacatggggattcaaagaagggaagtgatttgcctggactcccacagagaattgggactggaacccaratgtttcagctcccagttatgtgattctttgggccagacaatggcctctctggccaatttagctacaagagcatgtcactttgccagttttacttttcccactccttttcagcagcagtgagttagtctaaaatgtggcagttaaataaatcaaggctgattttgggtgcacccttcctttaaggcaatgggcctctccagaaggaacagtgtgaacattgtcttccagctctacctctgctccccgcccccccgctttgttttctttgtctctgacagcagtggactcagaacctaaattcccccttcttaagccacttggtgagtggcagggagcagtaggactctgagaggttctgggggttttattgtgatgggagatagtcgtcctgcacttctgtagattacaggccagcaggtggaagcctgggctgtggaatcagattgggtttgagtcccaggtctgcttcttggccactgggcatgcaaggccttcattttctcatcagtgaaataggagcagtcatacttagttgacccttgaacagccacaggtgtgaactgtgctggtccacttatatgtggattttcttcagccaaacgtggattgaaaatgcagtatttgcaggatgcaaaacctacttataaggaaggttgactttctgtaccctcaggttctgcagggccgactacgggacttgagtatacacagattttgatgcatggggggagacgaactaatctcccacaggcagtgggacaaccacaattagacttcagattttaaaagataatatattttttaaaaaccagtgcagcgcctggcccatagttgatggtaactatgcttaaattagattattattcgctgtccttttactacagtttcccaaaccatagatttaaccccccacacagctgtctaccatcagttgccctggtatcagttttttaatgaaatttcaggagtgtgggattctttgtctctgcccttctaataggtgggaactcttacctctctcatccacttagccccccaaaaaagacagttaaacttgaaagctaccagactgtgaaaaagtaaataagaaccmctggccagggagagggcttcagccttagatgtttacaagggcctgaagcagagaaagagatagaaaatatgtaaaagcaaattttacctgcttggaaagtagcttaattttttttttttcttttaaactaattctgtagtcggccttgtgctctgtagagctggatgaatggttaaaaagaaagggggaaaagccagaagaaattaattctgtggcacagagctgtgaattcttccttgatgcaggatctgaggttgaaggaggttaaatatgtgagggccagaaggaagtatcatgtaatgaatgataaatctctagctgctcctcagcagggcaaaacatgggcttagcaaatgggaaaaaaaaaaaaaaaaagggaagtagcaggtggagataatttaaatagcacagggacccctgcttaccaatccctccacagagttttgccctggagtaagcatgacatcagggtgcttgctgcttcctccagtggcccgagctctgtgtgcctttgttgaacaaggttttcgtggagctgaggtgactctcatgaacagagaatacctgtccttcatacagagaagcacccaaatgcaaacatctactttttctggtgttcaaccaggtaaacctctgtttagcaagaaacatcatccccagagtggggactgtcttgtcctttcagaagctagtaccctaagcaagactcataaggaaggtcgggcctccctaggtctctgtttcttctgaacagtgatgagctaggtgcagagagagttaaaggtcactatgcagctgacaagtgtgaccagttcccagtaaattccacttggctggggtttcagaggtgagcaaggcaggctttttactcattacacaagaatctagacatccctttaattgggtggcattctgggtgctaaaaggaaggggctttgagaggcaaagatgatgggatatcataaatttttttgtttcctttttaatatagcgcagctcctatacttaagatttaactttgaaatgtagcatagctaagatctggtccaaaaagatttctgatatctccatgaatcctagttagggattgataggaaaaaaaaaatcttgtgccacagcttcatgctatttttaggaacctttctgaaaccagtggcagcccaagttagagcccagcattaagtccacctcatgcacatcatacagttgcagcttatggtaaaagctttctgcaaagcttttctgctcctgggttaaggccttccagcatcagtcacatgtaattaacagctacattgtgtgcttactttttgctagatgtttcataaacattatctcatataaacctcacaataactaggtattattrtcccgtatccctgttttacagctgtggaaagtgaagtgaaggatttttgtcatacagccagtaagtgccagaactgacttgaacctagctctctgtcttgattcaggaactactgctctttccattggtggctcctggctaatcaatgtgatagtctttgaagaaaaaaaaaaaagagttactatcttcagagttttaaacttatctgggagagaatttaggacttttctttgtgagacagtcttgctctgttgcctaggctggagtgcagtggtgtgatcatggctcactgtagccttgaacttctgagctcaagtgattctcctttctcagcctcccaagtagctaggactccaggtgcatgccaccacacctggctaaatttttaatgtttattcatttatttattattttgtagagactgggttgcgctatattgcccaggctggtcttgaactcctggcctcaagcaatcctcccacctcagcctcccaaagcactgggattacagatgtgaaccactgctcccagcctaggacatttttattattcctctcgctgttaatccaacaaccctgtccacattcctgtaaattggctttgttcatcttttttacttccagacatgttaattttaaaaagaaggcatcttactatctttttaatggcttctgttttcttccaagttaaaccaaagagtcatttgtaatttgcctcagtaattggactgtgactttaaatggctgctagaattggccttttgttgactttactggagttaaaataattctctgttttcattagccaagagaaagacttgtgactcttgatgcttttcccactgcaggagcaaagcagtaaccccagtaagggagaagagaacttagatttgtgtaagtccactgtgtgttggacacttaaacatactttagatgtattatctcattcatctttctgactgcatgaaggtgctattgctgtccccattgtgtaggtgcagagagagttaaaggtcactgtgcagctggacatgtagtcgatctgggattcaaacccaggtctgtccagctcatgttatttctactgtatcacacttctcacctgtatatgttgaatggccagagtgaaggctgggctttatgggatacagaggaggtgactgtacaccaggggaaatcagtgtcacctttctgacgctccgtggcattaccctcattcagaactcattaccaaatacttcatgtaagtaacctcgaaagtcttatgagtacatcgagaactagttccaagtcacagaactgttcttgtggtgaaagtggttgaaaggctatagttcattttggttattggatggaaatgccctctctctctggttgattaacggagaagacttagtataccagccattgtttcttcgtatggaacgttgcttgttttgtcccattttctcatctgcaaaatgtgggtataatacctattacgtaagattattgtgagaattgagaagtgtgataatgtaggtaaaacattagcagagtatttggctcttacatagaggctcaaattgcattagtggcaggaggaaagtctgttttattcattgttgctccctcagcagccaggccattgcaaggcacatggtgcacattcagtaaatgttggtgagtcattgatttcttttctccctttgtacttattttttacagatatttgagcacctagccttgtgctggacaataggggacatggggtccttcacacaagaaacatttgtagcctcatgagatagatggtcatttgtgaaaataatctaaagaaaatgacccattgttgagtggtagatggtgacccttgaggctatagtgtgcaaagctgatttggaaatccctccagccagctctggggctgattgtggtgggggtgggggaatccttacttactacttttggccctgctgtcagaattggaccttgtactgtcattctaagctgggttgagcctgagcacgtcttgtcacctctgtgactgaaggctgatttaatatgtcatgaggcagtttggtttcaggaagtggtttgctggggcatgagcgatggatgttggaagttagaaaagagccagaaattaaaatgctgcctcagttgggtgattgaatccagtcttacctggtggggcaaccacttattgatttggaaagccttggtgaatccattttttgctactcacactggggaatggggaccagcagcatcagtatgacctgggagcatcttcagaatgctgaatctgagcctcctcgtcagacctgctgaatcagaatctgtattttaaagagatccccagatatttatgtgcagtgtgaaaagcaagctttggaaaagaaagggcaattctgtagactttaagcttaggaacaagagtatttttctggagtcatttgaatgtcagtcgttaagcagggctgccaattagggctgattttctcactgtttaatacttgccaagtatcttgagcagtggcttcccagactgagctgctaactgaataaaggtggcatgattgccgatgaaaataatagtacattcgagttttaaaatgtttttatatagatccttttctctgttcacagaacagtcttgtgagatcatctcatctctgctttacaggtaataaaactgaagcacagagaggttatgtgacatgcctagagtcacacagtaaaatcagtagcagttttgaactgaggtcttaaaattccaagaagttgggagcttgctttttttttccttttcaccatctaaattttccacattgagatatgagagaaatcctccatttctgccattgcatttgtgtaggtgcacaacagggaacgtgagacaattatagtagagaataatctggaccaggaatggcgttctgcaataatcacctcttgaacaataaacttggaaagtttcgtggttgtttctgattcagagcctggaagagcaagccatttccctcctcctacccttggtttactaatcattcacttcctcttctgtaaagcccaactcaaaggacccctgctttgtaaagccttccctctgggatgggattggggggcaggcagataattggttcctcattcatattttattcatacttctgttaacaaagctgatcacaccatcttaactgcacatcttattacccacatgcgcagacaaggctgtaagattcctgaggatctagaaagagtcttcttcaccattgtagccccattgtctggcatgtgttggtccttcatacatgttaagtgaatgaatgcgtgtatgcatgattcagactttgttttttgcctttcttttctttttccctatagtctkctctttatagatttttaatagcatccaaaagggtagtaggggcaggaagctaaagggtaggaaataaaactcaaattcttcagtttcgagttcagttctcagttcagctcctctccagcagcttttaggaaagcattttaaagaaagggaggctcacttggggcttgaggatggtctggtccctcacagtgaatagacaagcatcaggcgcagctgcagtttttacggaatacgtgcacattacctttcctcagtgtcccctcgtaagcagtgaaatgtaataaatggcgttttagggagccgaagagttgtcaagtttccacagtttggagaactttaacatatggcatcttgggatctaatgaaataaataattcatgcctggaaatataagcaagagtgaatctctctccttgctatgtgaatggggactttggttgcctttttcaaggtatgtatgaaacatatttattcagtccactcatttatgtccctttactttctcactcactcgtcaaacttatcagcctcctcttccccttccttttcccctcttcttttccctcctcccctcatctctcttctcaccgaaaccctgagggagataggaaggtaataagtattattgttttgtcagtgtctccatcacacaccttctgtttttctttcttgaggcatctcagagggaagtggcaggagatgactttcagcagacctttccccttagtgaggacagtaagtcccaaggacatgtggaggcaaggatgaggggcagatgaacaagcagctgtctggcctaggtcttacagaattatttttcctggaattaatatgcttagaatgtatactttagcaagtgtctatttctggctccagcatttttctttgggtgtcaaacctggttttatctctgagatttttcgacactaggagaatttgacattcacattctaagagtgttctgtaatgtttccatttacataccagttttcttcattttttggctggaggggtatgtgaatatatacaagaatctgagcagattcatttttagctgcagcagaggcaagcctcaggggaaaagtcaagataactggattcctgaaatggtataacttggcaactcgtcttttctgttccttagcctgtaaagcattatttggttttagaagaggagtagctcctacttgtgaaggtcttcattggaatggcacattgaatgcatgaacccttaaaatccttactccctttaacccaagccacatctcagtggctttaaagcatatcaaagcaaggaggggaaagtctgtgtgatacggtactaaaattgatcctgtagtaccaggcatgaggagaggaaggaggagtatcatcattatcctgttaaggatttgtcatgcctcagagcatctgcaaggaaatagtccacagataaagttcagcaagtgatttgcaattggtagaggtggtttggcattttgaaaagctttataaatgtgactgcagcctgagaagaatgaccaccactggaatgagggaaggctggaaggatttaaggggttctttatgaaatcaggcacacatccccatgtcgactaggctagactcaggcaccataatagccctggttcagggtcactcctctttccaggaaggtttggatcctacagttagaaaagaggaatcttggatctctaggtaagggttagagaaagtattctgggcatcccaagttagaatctggtgtctttgcttaacgagttctgaacatttcatgtgagggaatatgggctactgttgtaggccttgctgtttcacctgaaccatccctgcccttgaaggacttaaagttggaaggaatgtgaggaggcggagtagcacagttatatgacatctaatccaaagtagaatatgcgagccttaagagaagtgcagagggctgtgaggagtatgaagtggctggcaaatagattcagtattatatttcatttattcattctgcagatatttatggaccacccttttatgttgctattgctgtgctagtattggagatacaaagatgaatatgacacctctcgggccgttgccaactgtcgagtaccaggaagagcgcttagataaatgaccatgtacaatggggtacgtgcaattataggtccactgttatttgctgttctgaattccaaatgttaagagttttgacatgaaattttgtttcatgaggcttttagaagctaaactagaaacgtactggatatttaaaaactgtgttaccagaatctgataatggagttctacactagtccctgtggggtatgttgtataataaacaataagtatactgtaatttctttctgaaatctacaaaagtatgaattctaaaacagccagccccagctaaaggattgtggatacaagtaagatacttcaggtgatttgagagtttacctggctgtatgggctaccctgggaatataaccactctttataacatcctttcttcgagaatggtatgtgctaagttataaacagctgacttagggccatcattttaaagtatgaagccttccagtcttcgcctccccagtcttttccattcttaaagtttggacyagtctgcaaggtagctgcctccctaaggatttggggtattctctaaaatttgaatatatgatattcttgtgccctttgaatacgctgtttaaaaataaattttaaagaatattctcatgtaaaagtaacacacatactttggaaaatacaaaacataggaagaaggaaaaaatggccacattcttactgtgaacacactgatgctttttctgtgcatgtttttgtttaatagtgttagtctgacgccttcttattcattataacatacccattttcccatgttatttacatagtcttggtaagtatagtttttttttttgtttgtttttgttttttgttttgagatggagtcttgctctgtcgcccaggctggagtgccgtggcaccaacttggctcactgcaacctatgcctcccgggttcaagtgattctcctgcctcagcttcccgagtacctgggactacaggcgtgtgccaccacgcccagctaattttttgtatttttagtagagacaaggtttcactgtgttagccagggtggtctcggtctcccgacctcgtgatccacctgccttggcctcccaaagtgctgggattacaagcatgagccaccgcgcccagccttggtaagtataatttttaatggttatacacagtttcattctgtgaatttatcataatttgcttaaccatctcccatcattggacattgttatttgtccttccctcccttctttccttctwtaagtaatgctgctgtgaacatcttgcattgaccagattactggggcagattacctgtgcttccacagtggttttaccatagtacagatgccatcttcttcccatagtgcccttgcctagtacattttaaattcttggaggacagagtctccttcacatttgtctctgggtcctctacactgccctgcttagggtcttgaaggtgattaacacatttgtttaatggatatgcagtccagacttctgaatgcccttttccctcttagagttaatgtgtaagagctggcagtgctctgtaaatgcacagctgcaggtaggacactgcgcctccaaataaaacatgtcctgataagcatttgcagggaggtttatattctcaaagatatcctctttattaacagttgtttcaacaaggaattttttttttttttaatatcagctcttgtaaaagaatggaattaccctaaggagtgagttctggggacccaaattgaggaatggtgccctcgaagtcaaatactggaaccagaaaggttagaaatagattaaaagcctcagctttatcagaaaaaagccacagatgaaaagcctcaagcagcttccagcatggctgaggagataagcttcccatatttgcattaattagcaggagcacctagcactgattgcttgatgcgtgtagctggagctcctgccaggggagaagagttccacgcagcatggatgcaggagtcggactagagcacagtttgaaagcgctttgggatggcctcaccctgcatgggtgcttggttgactgtgcgtggaggtgactagaaaggacaagcctggggaagagataggctggggtagggacctaacagggcaagagggtatgtgtttgaaatgttaagtcagtttaccaaaccttcccagggtctctgctatatgctagactgagtgggaagggctaggggtatagaggtgacaaaacccaaacacagccctctgagcrttccctatgttaaagggcacaaatagttgctataataatgttctattaaatatgtaattatggcctttgacataatctgtgtctgatagtttgcacccaaacttgtgagatagggcttacgcattttgcagaggagaaattcaaatgcagagggtttgaggcatttgcccacagaactcgccttccttggctgttaggctttgtgggttaggctttatgtccccatcatcgcattgaactgtgtttcccatggtctgagaaatttagcctaactaggcctccccccaaaaatcagtttacttctcaaaaatggatggatgagggggtcagtgggtgaatgggtggatggatgggtagaacaaagacaatattcataaaggagggtgtgactgatgagtaagtgcatggtgccatcatctatactgcattgtccctttgttcaagctcttcctaatctgaagtaaccttacctaccctatcttatcttttattatcccccaacatccatccatcaagctgtcctgtcatccttctatactttcatccatctaactattatttgctwgttccaggcactgtgctttggacaggcaatatacaaaaatgtgtaaagttcagtccttgaactcttggtgatatgtagtcagctttgttcaattagagtcagataattctgcttaacagtcaatttccctgtgttccttctggccccattactaaaaatgctctaactgctcctctctgagcagtactcttcaaggtctccctccttggccaccaagaagtcttccctcaaattgtgctcattcgcctttttgaccccctacgggccttcttcatctgaatcgctccctgctatgaggtgtttccttataccattagcatatcttaccttgtttataaactgatgtctagataaatgttccctgtgggtgtgaacttttgcttctcatcatttcataatgataagcacaaaggtgttaaagttgtttgctcatttgtgcattcgtttgggcagttgcacactttttaaagctcagtaaacatgtcggatgctgtgaatcttgatcattttccccagtcctggtgtgatgagcatgaagatgatgatgggtaacccttattgggtacttcctgtgcaccaggcactgttcttagtgctttacatggtttaactcattaaaccctcaccgcaaagctcactgtatagaggaaggaaccagagcatacaagtattaagtaagttgctcaagcaggattagaaactcaggaattctggccttcagacaccctctgtaactacaactccatcagtacatgaaggagttctctagctgctgtgactcccgattttgtgaagtgtttttattttatatcaaagtaagtgatggacttaaactgtgaatggaagtagaatgtcatatacgcagtgagataaacatcagtgaaataaatgctagctttgtttttagttaattgagaataactttgtaagttcattttgcagcaggtttttgttatggcccagttttcgccaaagcctatttctagtgttttataagaaacagtgcaatgtacttcaggtggtcctggtgtctaaaacctactctgccatttgatactgtgagaacttgagcagattactgtgccctgagccttcttttcttcatttrgaaaatagcaaataattctgcctggcaaatttgttgtgaggattgagggagataacacctgttattttctagtaccatacctggcacatagtaggttttcagtaagtggctaaaaataatagatatatcagaaacttgttagcaggcagtgattttctaagttaagacaggtascaaattatttatgatatctgttccagtaaagccttggctcattattttgcttttatttatttttaatcagtattggaacattgttggtactcgctcagcaggaacagaacgtgataaagttacatcagaaaccagaggcggaaaactttccacggtgatatgcataaacaaatatttcatattttttacagaaagtctggctattgcctatagaagacaaaaactggtaacagccttattccagctaaatttgaatgccaggttgacactaatcatggatgctttcccagagctttcagaaaaacaaaaccaacctgttgtgtttaactttccaaagatgtcagagttacaattggctgaatatttttgaagctacatatatgacgactctcttcatttcagtaattaaaacaaattttttaaaaagatacctcctgaatagataaatatgatcataattatgtttttccttggttttatttagaccataaaattttttctagtgataagatcattttgttttggccgacatacataaaattctcttcattcatgaaattctgtgttcactagtacctgtaggctggcaccaagtcagttttgttttttgtttttttttctttccaacttggtggtttacaactccttgagtattccatttttatttgtgtatgtttctgaaagttctgcaaggaaggtcaactatttaaagtcattactggtatatcttaatatttattttactaatacttttttttcatgcttgctgtaggaaaatgaatgtgggttgccaagtcttccttttctcttaggtctggtgttctctgaactaattcactccaaagtgttgctgtcaaggaagactcaaattataaggaaccactaggaccatctttattagagactggcctttactttcttaggtcttaaatagggtgtggatgggagaggttttccagttcctgtttcacaggcattaggaccaatctttgtgggcagccacccactcatgagtgtatgtctctctgtctctctctctctttctctctctctctcagtatggtgtgtgtgtgtgtgtgtgtgtgtgtgtgtgtgtgtgtagagtgtaaaaggaatgattggttttactaccccatgaggagatccagtattcttatggggggagggaatattaggaaagatgtttttttcttctgtgcaaagctgtcatgctttgtcagtgattacagagataaacttaacagctgcattgctaaattacccctccctcccagtggctgcatcctacatcacagtctgcatgtggtctctgtggttcattgtcactggttcccaaaycaaaggaagccattggtcttgttgagtggtgacgcttatcttcataaatcctggctgtactgggcgcatcccttttagtttatkttcagcccagccctcatagctcactttcccctgcttaaaaattttcatgggttttccctcacctttagagaaaagttgagttactacaatttgactcccgtttttgcctttatgggggttcatttgaacctcatactttgtggctaaattacactatagtcacttgaatccatttatatatacaatttatcgttttgactactgtctagaatggttgtttgtccagttttcattttcctacttttattgctccaatgttttgagatcttggatcattattactaaatttccaggttttatggatagaattttgtttttaaaagggatttgttctttagggcccccaaattttcaagacrccctacacattcggttggccattttaatctcttctcagggatgggttttgtccattaraacctctgtcctccgtgccagtgaactggaaatttaaggcggatgtsatgatgatgagtctaacaaaaagctgtcctcatcacatacccagtccyccacaaggtttttgtggatacagtcagtgmaatacccactcttaggccatctagattagttcctcacagattctggggatttcctacatctgatgagtttctgattgcatgtcctgaaatggcaccatttttttaggcccttacccttcattggacattatcatggcttttcaatttagacatctactgacagtgattctactttgcccatcaaccaaatctgattttctagacctggttttaaggcatcctattatctgacccttcctcatgtatccagtctcaactacaactttctgttcttatcaagttagtctctttccattctgaaacactgttccccacacatccctgcctttgtttggccttctttagctgtctgcatcctgccttctttttttttttttttttttttttttttttttctgtgatggagtcttgttctgtcaccaggctggagtggtgcagtgacgtgatctcctctcactgcagcctctgcctcctgggttcaagtgattctcctgcctcagcctcctgagtagctgggactacaggcgcgcatgccaccatgcgcagctactttttgtatttttagtagagacgaggtttcaccatgttgccaggatggtctcgatctcttgacctcgtgatccacccgcctcagcctcccaaagtgctgggattacaggcgtgaaccactgtacccagtgtttttttggtttttgtttgtttgtttgtttgtttgtttcctggcatcctgccttcttttaaggctaagtccagatgccatgctctctacaaagagggccttacttttccagctggtgtggatatatttttcctctctccaacagtagttactgcagagctcacaacgtagtggcccacttgccaaatccatcccatgaaggttttgtttgctccaccaaatttgcctagttgctgttatttgtatttcaggaaatttcacataaatattggatttctggcttgtttgaagaacatagaccatttaataatagtgcatcccctttcccaattggcaaaagccagctaaagctattcaattagtggctgttttacttaaatgatgaaggttgttgtaactttgccgcagcgaaacccactccttgttataataggccaaccttgcttctctcattaatattatcttcctgaccccagtaactatttcagtttatgatcctttgggttcttgttcatttagttgtctacccccaccacactctatttcaaattatttgtgtaatttttatgagagtagggataacagctttctaaaaatatattttccccaataatgtggatactttgttgggtaattgccaaatcagtgattggttttgatattgtggcttgaatgccatggttgatgtacacatgccagagctgaaaggcctttcagtttgccaaaaggggatcttattaagtgcttgcagttacattcacacatcatgattaataatgagtatccacgtggagtgcagatggtaacagtcgtattgcaattggtgaaccttaagcagtttcagatgaaatttcaaaaatattttgatttrtttttaccaatagactaataattaagccatttctaaaaggaggaattaatatacaaatgcaaaagcgatttgtagttttgactaaaacatctgcaagtgtggagtcacaatatattttatgtttctttattttttcctatttggcaaaataagtagggaaatagtggtttcccagatatagattattagatccctaaaacatggtatacttgcaggattttagacacttctgctttgacagtgtgattaaatcaaattggattctaattaaaagatactgcaaaatgtagaacatatatatttggttggtgcaagagtaattgcgatttttgccatgccattcctttttttttttttttcgaggcagagtcttgcactgtcgcctggactggagtgtaatcggtcatgatcttggctcactgcaacctccacctcccgggttcaagttattctcctgcctcaagtctcccgagtagctgggattacaggcacccgccaccttgccccgctaactttttgtatttttagtagagatggggtttcactatgttggccaggtgggtctcgaactcctgacctcgtgatctgcctgccttgttttctcgaagtgctgggattacaggcgtgagccaccgcgcccagcctccattacttttaaatggcaaaagccacaattacttttgcaccaatgtaatataagatgcagagtttcttagaggaaaatgagttcacatgccatgattgtgtatgttgattcctgggttccccacatatcaccatatagatatgttgcaaaacagaataaattaagttgtttgtttttttaacccccccaaaaaaactattttttacactttggataagttttttagcctgaaaatctggaccagtacttagttgtagatttacagtacctagacttggagatataaacccctgttcttagaaggtagaaagccctgtcatgattaaaaaaatcaaggaccaaggagggtattccctctctcccagtagtaagttttcaaattagttaataagcatatgtcagtctttatggacaaaatcaagaaatgatgtcattgaccatagagagatttgtaaaaacttaaaagcaatggagaaagctataagtgatagggaaacattgtttatgttgatccacggatctctaatactaattttattgagttgtaggtttatttatttctcccagcatcctttgtgagggggtacatatcatttccagttttacagataaggtaattgagtttatctagatgaaataaccttgttcagtgtcatacagccccaggttatctgcccccaaacctctgctatcttctaccacacaacacagccaccaagtataatgttttttgagtacatatacatatgtactctaaacctatttgttatttggaaaaacagcatgttggttgttacatgttatttggaaaaagtgaatctgtaaacatatttactcacccatttttagacagatcagtgactgttagacaaatcactgacatggattcttggttatggttaaatgaaatggtgctattaatgaccaagcagaagaatgaaccaataaaattatcatttccttgtttatttttaaatttcaataaaaactgaagtgttaaattctaacatagaaaattaaattcacttttggcactcttcccagccccaataactgattgttctgaattttaagtaactggataattctgactattttattacaaattttcactctctaatagaatcgctgatgagcatgtattgctctccctcttttctattgccttttgttgatttggataatgctacagctcaaagctggaagagtccagtaggattattaaattatatgaatcatgctctaagaaagttctagtctggattctgaaaatgctgacatggttgactgctctctactgtggcagactgtgtgtcaaggatgcctcccaggagttgtgctgatttgtgaggactagttgtcaaaagattccataaccattatcacaagtagactttatccacaaaatgcccagtttcttgggacatataatcacaattgaatatatcacacaccacttttaaaaacttgtattctaggccagaggtcagctaccattttatcctgctagattctcctgaaatccatactccatatgagaagtaaaggtagaaaagggacagcgaggaatatgagcaagcactggtctggtaaaatcatctttgttcagttccagctgggctacttactggccttgtgatgtgttttaaaggccccttgatccctctgaaccatggtttccttgtcagcaaaatagtcaagaacactacctctgcctatctctttttgatgaccaaataaaataaggaacatgtaagtgccagtttgaggtattcttaaacagtacaaagttgctgaatgagacacagactcaggtttctaacctggcacatagttgatgtttataaaagttagttcccatctcctctttttagttgtaggttttatattgattattkgttcaagagaggcaaaaggttgtaaatagctcagggtcgctttagttatggacgcccctaactattttagtggaccggtttcctgcttaacgctctatgttctttcctccctgccttcacttctcttttttctccttctctgtcaactactacattgctaactctttctcatctgtagtatagaaattatacaatatttttacaatagagaaagatctagaaattatctagtcaagtctatttgttttatagatgaaggaactaaagctgaaagaggttagtttcttgtttgagatcacacagctgataagcacccaagctggaatttgaaccctgcgcttgtttcaaaagcaaatttattttcactgcactatgctgcttttatgatttgcattccccccactccatttaaaaatatgcttaactatctctgcagaagtggatttctaacatctgccattaacatccactgcggtttgtgagccagtcctcacattccctcgttgccatattcaagactccatgtgggacagccatggatctggcagagaagcagatttcagcagaaggtgtgggtgacttcagaacccctagtgctgggtgtatgattcagaccttacatgaggaaagagtaatttcctgtgcctcccccgtgtacttttaggctatagcaaccacaaagttcagaggaaggtgtaggattcgtgtacttctgttcattttttttcccctctctgtctcattgtgaatcaagggcttgattttggagattttgcttttacctgccaagcagagggaccaggatttgttctgtcccgtggtagacatggctttcgataccttattagggtatcactttcaataacactttctacttcagcttcctcatctgtgaaatgggtttgagggttcctgccttgcttgtctgtaaggattgttttgartgaactaatggatgaggaagggctttgtaaacatgcctaacactctctaattgtgagggcctttatgaaaagacttaaaagtaagaggtaaaagccatggatttgaattctggttctgcccccagagtggttactgggtacggtgagtagatgttgggtggcccagaaacaacagctccccctctcttctgtttcacccatgcgtatttatatttagaaaggatatttaatgcatatggataaaatatcccaggaattaattagagtttttttcgtccaatgtctctcgactgttttatcgtatgtcccagtccaatatttgcactcttagctgcaaaacttgatgatgcatcaaggaaaaaaagagaaaggcttatttgcatggaagacttttgcaaagaatgttttcttattggcatatattgtcttcatgtgtttctaatgaaacagaagccagtgagtctctgggtaatttctttgtttccaccctgacgctgttgatgtcaacaaaaagtgcagttcatttttaggtagggtcatattttctttttcttttttttttcatttagcacaggagtggtggacttaacctgccacacccttttaatttaataaaatatgtctagattatgggatgtgactacagctttctgtggttggtcgtgtccatcctaaagatctggactcaataccttgaaatgctcatgttactacaatgaaaagcgtgtgtaacacagcagtaagtgtttacattgctcattccctttatgctgtctaacatcatagagagttaaagaactcatggtttgagggatattggtactaatttacataacttttataaggccctttgatttttttttttttttctggttttcaacacacttattaggtctcttgtcatggcacagggaaataaatcttcagcctcgctgagaaccatactactttggatttcttcctttcatggctaagaatttatttgctcccttgagctctacccagatgaggtcctcccgagaggctccctgccactctctacatctctgtgaactccactggcagtctgaaaactgtcctgctacgtccatgtgatgggcccacaaacgcctacagcccttcgtcaacagacacaatatgagtggcaaagacatttatgtaatctggggacaaatttgtaaactcttttgagaaatcttacagaaatcatttcccaattggagctaatggctgcttgctggtggtgtttcctaaggcatttgaaagccatttctatatctgtacttcctttattcccactctttagacttcttggtgccctgttagatttagactattatgacacttattttttgtttctgtcatgagaactctgtgtcactttgtgcttgtctttaggagttttcaatgtttgtttttgcttacatttttaaagatgggattgtctaaacatttttcatgtggtaaaaatggaattcatattttgaatttgtattttttctactgaactttctggttctttcctctcaacttcatctgcttcatcttttgttgtcttaaattcactggatatgaagaactagtatggcttatagttattggtgtttttctcctgttgcctatagccgttgtcctcgttaccaagtggctgctacaggaaaccatcttttaggtgaatggccagactggatggggcagactggttcccctttctcgctgacgctgtttggcagctgctttctctccagtctcactcaggttaccgtggcctgtggtcctcagctagagcatgcatcgtaatcaactaggagattctgatctggagagtctgggatggggggccctcggtgcctgcattgaaaagcacacacatgtgattctgatgtggacgggtgagggtggggttacgctgtcaaagccgtacctattgtgagtcagctaggctgcacatggacaagggaccccagggactgacctccctcagcagcaggcagagtccttccatcgtctgccattgagttcacttagttttctgtgtctgccaagaccgctcctggcactgtgagtgcactgctctccttgtccctttatttctgttccttaatttctgttgactcacactttccaccttctcatagtttagggtctctcatgctgccatggagcttttttgttagaggagagagagagagagagagagagagagagagwgtgtgtgtgtgtgtgtgtgtgtgtgtgtgtgtgtgtgtgtgtttgcagtcttggctctcagttcacgtttggcctgcaaatcccaatcacaaatccatttggtcagaattcgggctaagtatttactccagattgtctcagctgtggctgaggtactgtcacagaagaccctgggatcagcctacaggacacaaatgccagcttttttgtctgaggatacctgtcagtagcatagaccatcacatggcttagcaagctggttcttcgtagtccatgattggctacagtagaagaaaagcctaaattttgaattcatagttaagagttacagtccttgttagcacttgtttacagtgtgatctggggtaaatcatttatcctttataaaatggagactaatgtagcttttgtcacagtagcagaatgtatatggaatcactttgtgaacttagaggaaatggaagagattgttacagctggagcggcccagtgccccccagccttcttttttaaacaaatgaggaacgaagctctaggagtttgctgtgcccaggaacatcataatttattagcagcaatgccagacctagaggtcaggcccgcagggttctttttgtgacatcttttgtcagggcaaagcatccattcatggaactgggctgaatctttctcatactcttcccttaaagaggcttgcctttttgaaacttggttctttccttgatcactctgtcatagaatctgttcttggagccgctgatgaagtccggtcattatcagtacctttacttctgcaaaaaaatgtgactggtattatcttctacttggttgtaacggtttacgttctcctccagttctgttgttctcygtgaggaatgtagttttttacatgccttttccattggagagttacaacaaaaaagcaaaataaatctatcttttctctgatatggcctccttatttgttttaaaagcatttttatgtttatttgrataatatttagaaaatataatagatttaaacataattttaaaagcatcraaatgcttacgtttctctaattgtgcaagaatctttatatacatagtttttttttttaactgaagttgcatcctgccagtaaaatttgaacgaattgctttataagttgataaggcccctttaaaacccttttcacttcttagctcctgtgtgtacctctgtttagaaggtgttttctccttcctaggctagccaggaggagagcttttgtgtgcaggcgctgggacgcctcaggggactggtaattgagagaggggtattgacctgggtcatccatctgaaagtacgtaagtgctgctgcccaaagccattattactgccttccaggaatctttgataagtgaattagtggctttctttagctctctttgacctgtggaaagcccaattacaggcttctttgttcacccatttgtaacttctttctgttagggccaggaatataacttcatctgaagacttctcccagttgtgggtttcaaagcatttggaagaagaaaaggagctaccatttgttgagtgccttcggagtgctcagagctttgtatatgctctcatttcattcttgtctaagatctagagatggttaggattattcattcctgtttcacagatgaagactctaaaaaagttggagaagtagctcaaggtcatccagctacaaaataacacagctaggagttgaatatggagctacagtctcaagagtctatgcttattatgtctcactaaatggtttctgttccaagttaagggtagtggactatgaggaaaagcgaagagaggtttatcctccatttccacccacaggtatacagaaataagaactacagtaggtgtagctaagagccaatccaatcctgtactggtggtattcaggaaggctttatgtggatcaagattctatgccagagaacacagattccttcagttcacttcagcatacatctgctctgtgcctggtactctgctaaggaaaagaagtccgtgcttccaaggaagtgaacttctgttgatcactcggacttgaatgaaatattatgtcatccagtattaattctcaaagatacatcctcaacaatgaatgcgatagtgagaagagaggcagaggttgctatgtcaagttgatattgtgtggcggggttaagtatccccttacctgttttccatttaggatttaaggtagatcgagtggtctggtgcaagggttcagaccataaaccacagctgtttgattcttcagcctggttctttaccagctattatctcctctctaccaaagaacatagtaacctccccatttctgcacctcctccaaaacaaaacttccccgtaatggtaagtgaaaacttggacttactgaaaaatgccagcaaggcccagttgaacctccatctttcatgccttattgatatgcatgccacttcttccatcttcatagtatcagtcatttgtcatcctctaataatttcaaggcttgctgtcattttgagttggtacttccccaagggaaagcaatgcaggcagggaggtatacattagtatgagaagaatgaaaaatgattatataaggtattgtgagtcatagacttttacattctaaaggaatttattgcaaacattacctttttggagatggggaaactgagaatcaagatctcaaagccagttagtagctgagccaaggctagaactcaggtctctttacttttctcgtggaccccagctcctccgccccccttcatcctatggaggatgctgggactaatgggattttgaacaagtcttgggagtaggaagtgatgagctttttaaatgagaacaggcaaggttttatctatgtggcggatgttaccagacagggcagtgttaaccctggctgcccattggaatcacctggggagtgttacatgtgggctaatgtctgggtcgcaccacagaccagttgaaactactactttgttctcctcgaagtgtgacctatctcaccagctctgtcatctttaggaatgacattataagccaggttttctggaagtgaggtttgtagacaacctccatcaggatgcccagagatacccagagaagcagataccaagatcctgtgagctcctccttaatacaagctcctgggttcagaagcctggctgctgtgtttatagcaagtttcccaagtaattctgatgcacagccagtgtattggatgtggtttatttttcttctagtccacatgtcccccgcagttccttgctgatgcctcctgctactttgcttccttactttccccttctgcagaycttgagtggaagcaggcgtgaccctgccttgggagggaccgctgaacttcaaggttttcaattgattttgatgcttttctccttcctcagaaaggaaagagatttagcatatgggctttcttcatattagatttaagataagaaatgataattacaacactaaaactagcctttaaaaaaatctgttgatttgtttggtaaatgagtgataggattttatctttctccattagattagcccctctgttcttattgatacactgtatttatacatgtttatggggtacatgtgaaattttcttacatgcataggatgtgtaattatgaggtcagggtatttagggtatccatcacctcgagtatttgtcatttctgtgtgttgggaagatttctagtcctctcttcaagctattttgaaatacacgatatattgtcattaactgtagtcaccctactctgccactgaacagtagagcttattccctctaattgtatgtttgtactcgttaaccagccattctttattctctctctctcccacctacatactcttcccagtctctagtatctgtcattccactttctacctcaacatttttagctcccacatatgagtgagaacataagatattgttctttctatgcctgctttatttcagttaacatagtgacatccagttctatccatgtcattgcaaatgacttgattttattgtttgttatggtcaaatagtattccatttgtatatatactacatcttctttatccatttatctgttgatggacacataggttaactgcatatctttgctattgggaatagtgctgcagtaaacatgggggtgcaggcatcccttttatatactgatttcctttcgtttggagaaatacccagtagtgggatagtggaattgctggattgtatgatgaatctattttagttttttgagagatctccatactctttttcacagcgactgtactaatttagattcctaccaacgatgtgtagagttaccttttttccacgtcctcgccaacataggggttttgtttgtttgttttggtgtttttaatggccattctaactgggataagatgatatgtcattatggttttaaattgcattttcctgaaggttagtgatgttgaatttttttttatatacctgctggtcatttttatgtctattcatgtcctttgcccattttttgtttttgttttttgagacagagtcttgctctgtcccctaggctgtagtgcagtggtgtgatcacacctcactgcagcctgatctcccaagctcaagcaatcctcytgtctcagcctccccagtatttgggactggagcttaccgcagccttttagtgacagtaagtctttttttaaatttatttttattttttatttcttcatcattcaacttgagacagcaagtcttgcttcctccccttccattataaaacatgactttttttatttccataaagattttatacattataaaaataacaaaatgggaggaaagctcagagtggcacacaatcttcataaacaggatactagagaatagaatgataatctaaatttagtgatttttgaagcagggatgactatgtgaaaatgtatagtttcattgggaaccatttcctaatgatacgaaatcctggtaatgaaagcaagtttagttcagtgggtgatcagcccatcgtttatagtttaacatttagtttcatttaaaaaaccttggggcttgtatcatactcctaaaagatgcaaaaacaaaagaccaagaaatagggagatgcaggttggtaggtgttggaagctaatttgcaaagttagctgaatagcccacgcatctgagcggtacatgtagaaatggaagaaatgattttgacttcctactctccttttccttgagggtggtaaataatcttcttatcaaaactatgtaaaaggtatatataatttcttggtaaagaaaaacaaattccttggaactgtgtggcctacaagcagtgcagtgtcttaatagcacatcagaataatttgtacttgatttttttaaaaagggtagagtgaggttgaaggtacatataggataaactgcccctttaacatgacacgtgctgaagcatcatcctttcctctgggtctaaggcacttgttagtatagctcttctggtcgagttcagttttaggagcgagcagcccctctgctgattggaagaataaagacttgggaatgagaaggatttgttgcttgcagggcaagtgagaccaaatcagagcagcccggcagcaggctctcctgatcagtgggccatccttggggaccaggagcagccattcttgtttcaggacggtgtgatcctcagattgcccccagtgtgatttgtttggccaagtggattgttcagcacttgttctgtgtgctggtgactcatcttacactgtagggtgaactacttctcaggtaatacttacaggaaagatttctgtttcaaaaaaggaggattaactcaattcattaggaaaaattaatttgagcagatgagggaaatggcttttaaaggtagagagaaacagtggactaaaatctgtaactcttttctaaggactgttttttcccagcagcttctacctgttggacagaattaccttctttaggtacctctgtttaggatagattttgtttgttttttattaaactcaaatattagaaccaaattgccttcttgcaaagaaacatacaggatgaagatttagcctagttggtttagtttttgtgttcttatgcatgttttagttgaaagacagtttctatgaacatagagcaaaatatgagcaaaatgaaaagctttgaatttataagttacttgtctctacactggttatccaattaaccttttaaatgagggaagttatttctttatacttttacatacagagctgattccttgagatcacacagatcagacagaaagaatgttagaattaggaatcatcagaattataagggtctgcagaagtattcaaactgcaggtcacaatgtatgttaatgggtaatgaagtgaatttagtgtgatctttaccaaaagaaaaagtttcatcttattggagggggaaacatgggcccaaagtgacttagcttggtactttattgtaaatgtttgataactttttatttgatttggtttgattttttattttttgagacaagattctcgctctgtcacgcaggctggagtgcagtggcacgatctcagctcactacagcatctgcctcccaagttcaagcgattcttgtgcctcggcctccagaatagctgggattacaggtgtgggccaccacgcctggctaatttttctatttttagtagagatgaggtttcgccatgttagccaggctggtcttgaactcctgacctcaggtgatctaactgccttcgcctcccaaagtgcggggataataggtgtgagccaccatgcctggcctgatatttaacttggaacgaatgcctcaaaattttgtgatcctggatgcttggaacacacacttagcacatttatctaatgcaggtaccagagaccagataagacaaaaattaaaagtaattctacccttgcatgaatccagaggcctgttcatataaccagagaccctgacctttacgtacctttcaactttcccaggacagtgcctcatctaatagtgacccccttaggggtgaaagagacagtcacacatagttatcaaaacctagaaaacctaggtttgctacactaagctgagatgaccactmtgtcagtatgaaacttggagagggactttggtaggtggcatgtattactgggaggcagtttaatctgttgggacataagtttaacattcttgtttctttcctgctgttgaccctgtgagcatgtgtagacagccacttgaactgtcactatctgtattctcaggacatcctgctaacaatttttttgtttgcttccttcgagctagaggtacagtcaggtcacagaatggctattttacttggaaaytgtatcacagaaatctgcattggccttctctctctgggtgtgtgggtaattctgcaaacctcggattttactttcaaatttatccacagctaaaccagactctgcctttttcttaagtctaaagaatgcatcctagacaaaaggccaatttcagttggccttaattctcccactgcagcattcctttagttgtatgtatttgaaattcaaggcctgttctggtttcaagtacacttctttaaaagtctaaaacagaaatgtattattggactgataatgccttatggaggccaataatggttttatgtacaagccacagtactttttttgttagtagtttaagtgcctttgactgttccttctccaccctccctcctcctccctcagatttcactaatcatgttaagtaacttgatattgctcttgtcctgcataatgtaagctaacattggcaaaattgatgggggaatgcttcaaggaaagaatttcgtttaacaaacagtagtataattttrtggagactgcaaatgattcttaaactggagtgctatcaaggagcctgaatgcctcccctctaaatgtagtatatcatgcaacaatataattttttaaatatttggagagaaaagatcacctaccatcccactactctaacccaactatttttagttattattttttagtttttgttgcttgtatacattgttttaaccgttaccatcttcaaatacatgccatgttgaattttgcgtttttttctttaaaatagtacaaatattgctctatagttacacagttgtgtgtgtgtgtgtgtgtgtgtgtgtgtgtgtgtgtgtgtgtgttttaagacgggatcttactctgtcacccaggctggagtataatggcatgatcccagctcactacaaacttctgcctcctgggctcaagtgattctcccacctcagtctcccaagtagctgggactacaggtgcacactatcacacctggctaattttttaatatttttgtagaggcaaagtcttgctgtgtttcccaggctggtctcgagctcctgggctcaagtgctctacctgcctcagtctccctaagtgctgggattacaggcatgagctaccgtgccaggcctatacagtcttattttgagggccacataataatatcatcatatagagatgttccttaatttactaaatcatttctgtgttactggatctgcagagattgtgtctgtattttggctgataccatcagatctgtaatcaactttgagttattagccacttttctcctagtgaccaatttccttggggtgtatggaagtgagatgcttggacagagggaatggagcaccacctttatggaacttgtgctgccatgttgctttgtgtaacaccactagccacaaagaaggttcatggttttaggaaagactactttttcagctgctcctaccagttctgggctggacacttcctgagtttctctctagagagagggcctcacccaacatccccttgtatagactacttacgggaagattttytcaaggagaaaatatatcagtcacaactaagttccctactcttgtgaaggaaaatattctacccaatgggcaaaggatattccaccctgaccacaatgcttttataagcatagggtagaggagttccttcaacacgtaatttatttattaattacaaagtagatttttatcaagggagaggggttctgctgagataccagaatggttaagagcctagctgtagagatgacttccagcccctccatttacctgctgtgtgactgcaggcaaggtacttaacattccttatctgtaaaatcatcatcatattcttattcccatctcattgggtttttgggaggatctaatgtgattcttcatctaaagagcttactacagtgtttgcacaggctaagtactcagtaagtcttagctgtcagtattatatcacaacataccatttattcccctattcttcaaggtccatgaattgcttgactactatagctcttgttactcttgttttccttgaacttcattagatctaggagctgtcgctagggttaactgtaggcttgagttgagcaatagattcttttttacaaggatttccccaactggagtgtatgaaaaggggctgtactagtttttttttgttttgttttttgttttgttttttttttgtttgtttgtttgtttgttttgagacagagtctcactctgggctgtactacttctttgtcctcttaatgactactttttttttgagggggtgggtggcggcggtacctgtaggtttaggttaatattaagctttctcattctatcttctatgtctcttatcctcacttattatcctactttttctttctctgtgcttcattttaaggataatttcatcagatatatcttccagttaactaattctctcatcagctattttaatggttcctttgatacatattttttatattttagacctgcttaatgtgtatttatatctgtctatcgttcatagtgtcttgttcttttctcatttttattctcattttattttactatttaggtctttatttttacaaattgtgtcatgtattcagtaactgtattaaatcaaattattggggaaattagttctgttttttataactgttggttctctcccatggtagattgtattctttcatgtttttatatttttggaaggtaatctcgttatcaggagggctttctctgtgggaaatttatatggcctgatgtgagtcattaccttccagagtggttttgcatttgattctcctggggtgcttccagctccaaactgcttatttaattcatttaaaaatattttttaaaagattttaaactttctgaaaaatggcaagtacagtacacagaaccctcccccctacaaccacttatttgagattaagtmactgatatgattcccctcatccctgaatgtctagacccctgttgtatacaatcactttgcagcttgagagtggattccactcaggtggaatcactgaccactagttatgtaatctcaggtcagactcctccagccgcaccttcactcctacccccaccttagagacagaccagctttcttgcatctctctgtgctggtgggtggatttttctcttccctagttcacctttcattgagattgtagtccctcaagaggtccaactttgggagggaatctaagtttcaaccccgcacctgtgggtcattttttgctgtctctgcaagagtgttgaaacctaagctcccttaggttaccaaaacaatggaaaagggctgtggcaaaatcacctcacatgcttactgcttactcactatggatgttagccatactttatccagaacttctgtgtgctttatgctgtaacactggaagtccttctttgcttttttcgggggagacagtttcactttcgcccaggcttgagacttgagtacagtggcgcagtcttggctcttcagcctcgacctcccaggcccagatgatatccccacctcagtctcctaagtacttgggaccacaggcttgtgccacctcacctggctactttttgtttagcgagacagggttttgccatgatgcccaagctggtcgctggtcttgaactcctgggctctagcagtctgcccacctcaatcttccaaagtgctgggattacaagtgtgagctgccaaacctgacctttttttttttttttttttaaagacagggtttcactctgttacccaggctggagtgcagtggcaccatcatagctcactgcagccttgaactcctagactcaaacaaacctcctgcttcagcctcatgagtcactgggactgtaggtgtgtaccaccacaccctgttacttttttaaaaattttagttgagatgaggtcttgctatgttacccagactggtctcaagctcctgggctcaagcagtcctcccatctcagcttcccaaagtgccaggattacaggggtgagccaccacacccggccaatctttgcttctttatcttgttttggggaaagtatgatgggacaccctcccaaatcctgattgcttatttaatcattcacttctagaaacatttatgagcatctcctgttattctgcctgctctaggtgctctggggaactgaagggaacaagctcccccatcacagttcctatttaaagctgccagcagccctttgttgccatgagwaaagggccacatccttggctcagttcacaatattctttgaaagatctttttcttttttaccacttccttgtacmccagtaattttagtcttcatagcttctcctcccatactttgcctgtgttcctccctctttcttaagatgtttttcttttcctttgattcttgggggtcatttactcttcaaagatggtgaaatgccaccttctccaggacattctccctgactcacccaagtagggcttctggaacccctttgcgtacatartgatcatcgtgtgttgacattgtggtttacttgtgatgcaccagcactgtcacccggcatgtttctagaagggaaggattcaccctttctcatgttcatattcatgggttgaggatgaggagcaaacacattatttattagcacatagtgaagtgaattgaaacaaaatgaaatatgttgtgcgtgaatatctggtaacatttcaagaatacagttatagttccaaaaaaagcttagataaccattgcttgctagtattgatcaagaaaggagagacaaagtaggcttccacagtcagaggtgttgcttgggccacttttccttccaagcactattggtatctaagcaggcagaggaaagggaggataagtcctgctagccaagtcagctgcctggcacgcacgactgcctttgctgactgagaggacttggctggcctgagagtcgtgtccatctggacagagtgctggtgaccacaggatcctatatagatcccagcagcgttttctgacaggtcaaccatggaaggaccaggtgaaatgaaacatcagcacttttctctctccatttccaatcctatttaggagcctccgttgtttagctagcattcttgatttgatttgcctttaggttaagcccatctctgatgttctgaaatttcattctcttctccttatctggaggtagcactcaagaaagacatgtgtgttgtgtctctctgttgacctccacaccatgtcctgtccatcatatttaggaatcctctgccttttccagttgtggttttttcctcctcactagttttaacaggggctaraacctaagttgtcagtgtgtgcaccacagaggtctgtggcaagaagaatgtgtgtgagtcattggcctgtcattattgtctaygttactttagacacactgaactgctctgaacctcggtttcctcatctgtgaaatatgcccacttttcaaggcaaatttgttgtaaaacagatgtaaagtgtccctctgtgcatagttggtagaaggcrctggaagttgttattgtggaatgcatatagcatggtgaataagccctaggatgtagagcaagacattgctgagcttgattccctgatcttgctacttaatagctctgtggcctgcagaggttaataatactcacttcatagggtttttaggcttaaataaaataacagagagaaccatttcagttaggctccctaagtgagcaaaggctcatttaaacttactcaaaagtggtggttggtgggggattaattccagccacctcctggtgtctctcaaggatgtcttcttttttgtatttatgttttgttctcttcacactcatgctgtacccagacttgcctttgcttgttgcatcttttttctacacctagttgtagtttgtgttccttcagtaaaatttgtgcatggcccatcatggtctcttctctgtcaaattctcttctctagttcaaattcctgasagggtgggatctgactggcccagctcatctttttttcctccagccacatcttgggttgctgggaagcctttgggtcatgctaccttccctggttcagttagctatagctaggagaaaagtgtggccctttggtccagaacctggccacctgatctctgaatttgggcattttgaaggtaagttttgtgatcaacacacgtaatcagacactatatgccaagtcaaagggagctattcatattagtaaattcataytcgtattagtaaaaatcaggtatttctggggatggatctttttctgtttccatgttgtacaaaagcagaaatattctcaacgtaaggggttaagggtaacttttgatttgaggagtgatttctctcttggtccagggcagatctttggttggaatgttgcagaccctggtgcaatgagtcaaaacttccactggtttgcatttttcattagcgcgtcattcaaggaaatcctgtctttagggtcatggaacaggcttttgtgtttatgcttctgctgaagtaaaaaatgtgaagcatttaataatgcatctgaaaataaacttgtatttgaggtctgctctcttagagcttttggggggaattttcaatggagcctattttataaatattttcaaaattctgttataccctttatcccaacatggatcatggaaagtaaggggttyttttagtctaaatattagttaaagacatttgaggagctaggaattccagttaacattcaaaggctactttcttcatacttgataattattttctacctcaagcattcacttgaggagagagtagtgaataaaccttctgtytaacctatctgaaattccacaggttctctctctctctctctctctctctctctctctctctctctttttttttttttttttttttttttgagatggagtctcactgttgcccaggctggagtgcagtggcacaatctcggctcactgcaacctccatcccccgagttcaagctattgtcctgcctcagcctcccaagtagctgggattacaggctcctgccaccgtgcccggctagtttttgtatttttagtagagacagggtttcatgatcttggccaggctggtcttgaactcctgacctcgtgatccacccactttggcctcctaaagtgctgggattacaggtgtgagccaccgcgcccagccggtactcccttttttaatagcactggaaacatgaagacaatgtataaaatacattttttccctcatatgctggttgttagcaagtgaaaaaagtattcatagtttgtattctccatatatttatatattgtctagcagttaagttttatacctgtttaccatattccttttgttcattctgtttattatatatatatgatatgtaggaattgtgaagtagcttggggagaggttcaactgtcagtagtcatagaactaagaacaaaaactaacatagggagggagggagatcccttgactataatcctaactccttcagaatctctccgccccaggtcccttgcccccctccacacaggcttccatgtaggcactcacactatttgcatgaactctcaagattgtattgtgtatcagagttcttactctctgttgactatatgattgcctcagggtacttccacctgaggagttatcagcctctaatttagatgggccagagtgtgtgttaggtatctcttgtatgaggtcttcctggtcatctttactcacaatcaaagatgccctgggtttccctaagcctaccccaagccacttgctcactcatcaccccattcccgtattttccgagcctcccaccaccctacatctcccttctagtccttttcaaacctaccccctggaagtagagttggaatttattgggtggttaagtcatcacattaggtgcaagtagcatataggcagaaatgcccttgaaagttgcttaggaagattccatgatggaggcttacatatctgggtgcttttcccttcagaacattatttattcatttgagcaccaaagtaactggcctgtgtttaggggctatgatgtcatgtgtacacatacatcgccatacacacatatatttaaactggaatcactttcagagtagtgggatccttggaatatgagagagcatgcaggagctgaggggccagcagattccttaatcatctttcacagtctcactggcatggcttcctcacagtggggtctgtgactagtaattgacctctccccacagacgttttttgagaatatataattgaataaatgtggactgcatctctgcgtaaagttgattgaggaatgaaagaccctgggagactttgaaatttcctggaaatacagtgttttatcttgagggggggaaaagcaaatttggttttatgcaccacaatatagtttatgtctgttttaatataaaacttctttctcccaaaaatcttcagtgcctgtgttcatcccgtggctggatgtgccctggtattcctttgtttatactgtagtgtactggctggagagcgcaagtggttcggcacatagagacagaccctggggatcccttcagaggccaaattgatccatgcttttgaggctcatccaccaagtatctgagctgagggacttacttgctagcctgggccagtgctccccacagtctgaaattccagttacatctcaatagagggagaagccacaggagtgggagccacacccagatttagtcctggtgctaacccgtccaagttatgtgaacttaggcaagtcattgaacctctcaggatttcaggttttgcttttttattatttttaatatggcaattagaatatgttacctctaaggtcttaccagctctgttagtcagtaagatgggatgagcttttggctgttaagagaaaagtggctaaaacattgttagcatggaggctgaactgcagtgagtataagagaagagaatggcacagagctcatttatggtctagtagcccaacaatcagagtgcacagtgatttgattggaagagactgtgatggtatagaatacacccctgttgtgaatactctctcaggttttactcagatctattagttcattattatacaccttacattgtaaagatcttatactgtcacagaaataacaagaaacattgggaataactactgaatggaaagaaaaacatagattcttaatgggttttttcccataactggacaatgtataaatgaacaacattgtccttttttgttcttttcaaaaagaataggaagttaacatattctttatccattttccctaaagtttttggaagagagaagagtcacttggcaaggaattttaaaataattttcggtgctgcctatgactgatagataaatgcacttaatttgaaagccttagtatttatttatcctcatgagcattatccacaaaggtacagtttgcttgtcttagaactcttggcctgtatgtgtgaagttcattgaattaaaatctaaccttttatactttctttctcaagtgaagacattgtagaattgcacacactgtcgccccttcctgtccattataagcaactaaaatgtttggaagtcatgtgaggcagtggggcatagctaattagtcagctagcatgacaagataatgatggttcattaggttgggttttaaagaacagcatttctaatttatgccaattttacttgaaatttttgtacagtcataaccagcccacaaagggcacttgttggatcagagccctgctttttttgttgttttgttttgtccatctacaaacttcaaagtcagcaggagagaccttgcatccagggtgatttcagtgtagtctcacaaaagaggcctggcaagggtttaaagtgaattttaagcattttagcatccactttgaggttttcttttcatagaaggaactcgtgagaaataacttgttattagctaaaataaaagrggacagatttaaaaggagtagaaaatagaagattgtttaaagcttgttgggagcaaataaagattttggggaaaatcccaagggaaattctctgatatttagaaatcccaaagcacagaggaagaaaattcagcccatcttagtgagtgagtcatcactttattttctgaaatagaggcagattgttatttctcaaatcagctcaggtcatgaattttgtgaaccgtactctgtggggagattttttttttctttaaagagttctcttcttacccccagccatcaaaaaattaaaataccataagcaaatggacacatgctcctctggaatttatttttggaatcratggggcaaatagggaaaaggccttcctaccacttgccccaaaattggggaggagaggagtagggaaggcataagaaacatgggaatcgaaacaaggacatttccagttttgcagggaagaaatcagcaaatcagtcaaccaccacgtatgttatctatttactgtaagaacccaaaaccattccatttggagtataagagatgtgtgagagacagtcataatttcatggagatacagtctcagaactgataagtactatttgttgagcacctactatgtaccaagcacttgctccatctttgaacctcccattcaccctgtaaaatagtgggatgaagatcctcaatcccaaagggagtaggagacatacccaactcacagagcccttccgaggtagagcctgaatgcagaccaagttatctgggctctcgtctctgttgtttccactacacttacatgaaacaactggaaagtaatgaaggatacactcagtgttttaaaacatccgtgggacttaagggtggaggaagtttagtgaattatcagggtggtctgtgacagcttcacagctagagtgtacatttaacttcttcaaaagaaggcaagggtgaaggtggctgtgttaaatatgccagggcaatgggtgtaaacagggactgtccttgacaaaccatcctgggtcacgtgcagaattcttggaggaggtagactgcaggggatgggctggttgacgattgacttttctcctcaagcatctaaacgtgccctaacgtcttccattatggagctggggccaggtgtcagcaaactggttcagtggcagctggagaacctaaaaaggcattgtgggcctctgtaggcccactgactgttgttgctggaaaaaggtgagttcagatcaaccagggccttctataggaaaagctgatcttttaaatttttattttaaatatcccaagttttgaaatgtttgtacactaatacacaaatttacaaaagatattatacaggccatgtaaaacacccatggcaggttgaatttggatttggggccccacatttgcaatctcttctttaacagatttgctagaatattgtggttcaagtgcatataactaacatgttacatggagaactacttctgagattagtaggcacttctaaaaaataatggggggggggtgctcttgagtccaaatcagtttagaaaatattgtgttaaagaaacattttttaaaaaacagaaatgtaatgaattttagtatattaatgctttttgaattttcgaaaggagatacagcttggagtatttcccaaatttaccgactrtagatccctttttttcgcaacagcattaattgggctagttgggcacagattttgagaaatactgatctcaatgaatattactcaaatttaagtattttctaaatatgtcaaaatttctaaatcctgttttttttaaccagacctataaaacagaagcttatgaagtgaaatattctttatgaagtactgtgcctaataccagatcctccagagtagtgctttgtgaaacattagccaaactatgtaaataaatgtagttggattgtgactggttttgaactacttgtttgttcttagtggaccttgtcattggatattgggggaactgcttgctcatttttgagaagtagagtaatttggtgaatctctgggttgtgtagatagtaaaatgttgcttgacattctattaagtagtaccataatgactggattgtatttttaaagaaataaaagatttacttgggggtgtatattatagttactgctctgggcccacacaggctccaaagacataccctctaaatatgtgactttactgtattatcagcgtggacatttggaaaacagttayattagtttttataaaattatgggttataagaaggtacattgatatagtgtgggaaattttaaaaaagggaagaaatgatgcttctttaccacctttagcactccagctccattttttaaatgttgggattggaaatggaaacacacttcttaaatcatcgatatccctttaattttactcccagcggtatattaaataaaactttcaaaggaaatttgtcccctccctttatagtataactcaatccacaaaatgtaatttaataaaagcttatatatatataaggatatatatatatatatatatatatatatatatatatatatatawgaatgtgtatattcaggaagaagattttgaattttctttatccttcctgacttcaagctatatttttctttaaatatgttctaaaatttactacatacttagcttctaagtgaatacatttttgccctggaaattttatctccaaggcaaaaatactagagggaagcattcgtgttttaaaatattttgtatctagccacctaataagtgggattgaggtaacctatcacagtccccaaggtcaagattatctctgtatttctcaactcttgaatattgtgccaaatgaatgaattcagagtggtgatggaagttcccccaccgccccccaccccccagatcctctgcagatgtattccccgttcaagtaagcttggtataccagaagtctgaatgtatgagctagggacaagggagactgaccatttgctttacaaaagtactcattctcctaaaacaaaaaacctgaggaaaacatctctgaagtgttagtgtgcatcttcaaggaaaaaggtttaatttatagaaaacttcatcaactcttgcgaacaggaagatttatgtttacggaaacaatacctagtggaacataatgttcattagtgcttcagggcaaaggttggtacctcatccctgtcttcctcaagttaatattgaatcgttaggtccctgggtctgtgaacattctctcactctcttcctaataagatattctgtctgaattggccgtcctgagggagctttgtttgaaagggtgcatgttaagaaccagctgttctgtgtgtgtgggaggagtgggtgttgggagcaggggtccatattagccattggacccttttaagataccttcactttgagttaaccatatcctaaattgcactcacatgtaatttgcaagaggattagttagatttttgtgacatttctggtatgtgaccatctttttagaagtcaaaaacttaagcaagactttttgtcagtgttgcgacttagggacataaattattagtatctgaaaaaatactattcgtgtttgctgataattcataatcatatttttaaacacacacaacttaaaattatttttcataaaagcaactttttgttatttgacattcatcctgaaaattaggcttttataatcagtaccattaatgaaagtggaaaaactgaccattaagctaatttttgacaggagtgaataggagacagatgatctatcagagtgatacaatgctatgcaactgctgaagtagccatgcacatgcaggaaaaaaaatatgcaaaggttatttgcagtttaatattaagtgaaaaaagcagaatacaggttgcacataaaacatttattaggtacrtagagaaaatgtacatgaacaagttaggaagccaacaaaaaagaaaatagcgttttagagtggtagagttctggctaaagtttaagctttttgtctttagtttgctgggtattgtgttcaaaacaaaaaggaacttgtcttggagtttttctttttgccagtaccaggtgtcctaagtgccttgtgataagtaggaaacagacttaggggtgaaatatatatatttttatttgcttttagcaatataaatatctttaagattatgggagatctgtgaacagaataattttttaaaaactgaattttgatttgggagatgactttcgagacatttattacttatgtggaaagtcacttagtctctctagagagccttaattttcccagaaagggaagatggggataatattttggcagttggggaaatcagaagcacagtggtaaaaatggcaagatataaggtattattttgtttttgaataatggtaatatcatttgatgccatcctgtgttctaagtttaaagttgttagattggttkttgctacttaagaaaaactcattcagagagttaggaaggaaaaaccaatagcttgaaaacctgtgtaccattttaagagttacttgatgtttggtaacttctctttacaaattgaagccttagataaaagtactgatttagctaaaaagtccttgatttagcactgtttacataagggtcataatttacagactatttgctgaaaggggaccttttgagttgaattttattatttttattttgtttaatgtctggtgctttttatcttctaatcttttaatgtatttgtttgcaattttggggtaaaacttttttatcagtactttttctttgaagttttaactataaatttgcctttttaatgaatgtgtgaagttatactgtggttcatgccgcagctatcatttatgcaagtcttactttgaattagtaccataacagaccactgtatgattacttctcaccatttgagtttcccttcttgttttatactagtcacattcttgttttaagtgccgtgaattttaacaatgcactttttacaatgctctttcctgaatttattaattaaataaaagcatctaaaatatatttaaaaagaaaaacccactggaatccttggcagtggcctttaaacatcaggcagtgttgttgctgtctctttgtacagacaatagatagctcctgcgctgcatttttgtcacattttactccacctttcctgtaatgcttataagcatggatggcagtcagtaaatacatgttgaattattctgtatgtataggaccaagacgttttattgtcataggttttttttggagatgaagtttcactcttgttgcccaaactggagtgcaatggtgtgacctcagctcaccgaaagctccacctcctgggttcaagcgattctcatggctcagcctcctgagtagctgggattacaggctcccaccgccacggctggctaatttttatatttttagtagagacggggtttcaccatgttggccaggctcgtcattgtcataattttttaccagaaatatttaagaaaaagtaaaatcttaacttccttaatagcagtggtgcccaaacttttgtacatctcatttgtaaagctttttgagcgtgcatttcgtcttcatctatatacatgtacatacatacctattttctgttctaatgccatataattatacaaaataaaaatggcagacggaagttacagtatttttcttcccacaccacagtagaccgacttgtgtgctgtcttctaggagatcactaatctaaagagcttgttcaatggaaggctttgtatctacatctcccttttcttttccttctatagtagcaccaccattcacataaaatttgttcttgctaactatgtatctgttgggaactttggggaaaaaaatcaaagcgtatgcatctgcaaattctagctaacatttattgagggtttgctctcttccaagtaccattctaaggcactttatatggatttcttcacttaatccttataactctatgagattaattactataaatttccctgttttatagagggaggaaactgaggcacagccsggttaagtttctggcccaggtcatgtaagtagtggagctaggatttgaccacaggcggtttggctctagattttgtgttccaaaccatgttatttaaattccagcatctrgttggtagctatgtgattctccatctcagacaaaaattgtgtaactaagcctgaatgactgtgagccatgcatagcatattttgaatcatttaggtcaagacccagacaaataggtttattaggacattataggatcttagaactggtgggaagctaaaaggctyggtggtttccaaactgttccaatctgttgtcttttgaagtaggatcctgtaagttcttactgtcctgaaaagatgtgactcaggaaacttctttccagtctgggttttaattcttttaaggaactctcactgtgttgtaacatggaagtggtgttttcatgagtatttttttggtctttaaataccttgttgtacctrtaattattattttcccaagaatgggactgaaattgcatcaagatgaacaagccatggtgcttgtgggtgggtgtgctaactccgaactttaaaactacaacagaaattagaggttcacaaggtaattgctgtgattacagttttcttttgggccccagacaggagctcttgaaacacaatattctactaattttttaaatgtacagttcacaaggcaacatggagattactgagagtatgtaccatttctgccttgttttctatgaaagttaacatattgttgggtcctttgaaattgctcaggaaaaagcaggcattgcatgtattataagacactgttaagaggattaaaaatattttaagtactgaatcaatcttttaatattgtataaggaaattattttaaaagaaaaaattttcttaattacaacatagcacagctgttaaacatctgtaggtacctctctgcactttacagttctagataatttacattattataatacatgtaacttgatgttctaaattatgatattttatgatatctgcacatatgtattagacaataaatgatagacctttgtccattctaatttgttccatacataatttttagtaaccatagagtccttcctatttctattttattttagtttaccattttactgttgttggatttaggttacttctaactttctataaaacactgctaatgatgatttagaacatttgataatacacatcctttattattgaggaaatggcaacagttgttttgaaaggaattatcaggactggatttactatgtcaaatgtaagggtggttttgtgacttgaaatataatttgtcttctgtatggtttgtggccatttctccaaagcctctccattcaccaaatttcttttttctatttcttacagctttagaaggataaaaaatgcattttattattgttccatgtggaattttaaacttatcagtgcaaytgaaattacttgcatatgtttgctattttcggtttcttgtgttaatgttttttgtccctctgttcttctgggtctttatagcagcaacataagaattctacatcctaagtatgtattagagatgtcaacttcgatatgtctaatgcatgatttttgttgtatttttccctcttagttcttttgtcttggttttgtttgttctataaaaattgattacaattatttatctttttgctgatagtatctgttgttgacatcagaaaattgtcagacctctttagctgatgtacatagtatatttttttgaggcctaactttgttcagttttttaaaattaatttattatttatgtatttatttatttattttaagacagagtctcactctatcgcccaggcttgagagcagtggctctacctcatctcacttcagcctcctccccccaggttcaagcacttctcctgcctcagcctcccgactagctgggattacaagtgcccatcaccacatcgggctaatttttgtatttttagtagaaatgcggtttcgctatgttggccaggctggtcttgaactcctgacctcaagtgatccacctacctcagcctcccagagagctgagattataggcgtgagccatcacgcctggcccattttaaaaaatttagtgttctatattggtgttccaaaaaacattgttctgcaggtgtgcaaaaataaaaacaaaactaggtattctgattgtaattagttatttaattatttactttatctttgttgggaattgttggagtatagagttaaacatgtttctttaaaacattccagtctttgatagcctgacgtgcattcagtatctccaggaaaaagatatcgttagaatgtagtattttccaaatttaccattttacaaatggtaaacagattaattgttttctccagaatactttccagcatctctcagaaacagttttctacaaatcacagggtaggaactgctggtttaattcatttggatttttttttaactccatcagttttttttatgagaagcaattcttcagttttagtaatcatctttatgcaaatgtatagcccgggcttcttggtctcctctgccaaattaggtctttctctccttattaaaaaataaaacaaaacaaaacccacaatgaccagatctgtggttggcagctctgaggtttgttttgatgaataaacaattgggtctaaactcataattgaagtggagaagtcaccaatggcttaccacttgtattcccttcaaacttctgttctcagaaactaggaacatgaagcaactatagtaagcttagcatgcgccatacttggacgtgacaaaaagtagaataaaacatgttttttagttggagaagcagtcagacatggcagaaagcacagactttggagttaagctttccagggttaaaatcctgatttttccrtttactagttttttggccctggatccctactttctgacttaatttcttcatctccaaaaaggcattattaatgcatgtcttcttagattgatgaagtctttgagtagtaaattcaaggtagacttttcagaatatctcttggaggtcagaggatgcaaaatagggacaccgaaatggctggaattagaatctgagcctgacactatggcctatctttttaattgcatggaaatcttgaatatcagatactttcccaaatatatttccatgttgatgctatttgtgttacttttttttaaattaaaatttctttcatttaaaaggaaatctagcatgctaagagagaagaataatgttcctaggatttgaaaatacgtgattttcagaaatcagagccagaagagactgcagattggtgtagtcttgcacatttgcaggtcaggaagctgagaaccagagacatctgaggggcagtcaaatttagatggtaggttccagtttctgtacactgggcacatctagatcttctcctacaccctggggtgcagggccagcaagatggctctacaactgggaggaartaatatataaataaacacatacatatgtgtgtctggtatcttaaaagattaataactgttctttgtcaagataaaaatgtgaggaaaatgtcattataacctggcaggtgctctcatagcactagtgaatgaagagagattatttcttaattggggaaggggggcagtgaaactttcttattgggtgataaaacccaatctgaaaggttgaacaagagtttgtaaaattgttaagaagatgatggaraaaatggtgagaggcagaagtattgttcagaaaagagaaaattttagctactagaattagcatctccagagtcataaaggccagaaaggagcctggcrtgttaggacatcatgaacttggagaaccaggaatataaagtggacagtcacagtgacaagggtgggttggctgcaaaggcgagtctgtgaaagtagattgaggtgaggcagagaagggctttatgagccatggttgggggttccacttgattctgttttaaagtcagagrgtggcatgactagacatatttaraaacactctgcaatggtgcggaagatggatgggtggaggatgaactgctagaggctgtggaagtacctggctggggcatgattaagtcctaaagtaagacaggagcccttggaatgggtttcagtaatgctgcagaataacctgacatagaggcacacacttgtagtcccagctgctctggaagctgaggcaggaggatcccttgagcccaagggttcgaatctagcctattaacatagtgagacccctgtttctaaaaaatagaaagcaacaaaaaagaaatgctgctgagattgaattggcagaattttgtggcctcttgggaaaagggttaaacaagaggaatgtgactttggtgtccgggtgaacatctttgtgccatcactgtggtactaaatagacatggaggaggaagagaagatttggaggaagccttgagtttggggtgtggtcccagaggaggaagtggattgaaccacaacagaaatacttcagataagtgttgtgatgtaatacccagcttgtctcctccctttccagtcttgcccctttaccttccatttccaccacaacagccagagtcatttttctcaaggtcagagctaatcacgtctttgttctaaaaccctagaggctccatcttggccaaactacggcctccagaatacaatccagtctccttaccatggccctttcctccctgtgtgatgggtcccagtgtatctcttcatccctcctgtggccacttgtttcaggcatctgatctccctgatgcttcttaacaacaagggcctgttttctcagaatgttggcatgcacgtggttgttctctgtctactccaccttgaagaagagaacattcttgtcttcaccaggtatccccacacctagaacagacttgatgcctggaggtacaggtctttgtagatgtaggagccgtatctgcctgttcattccgcactcccccctccaacccccccggcacccgccacattcctcagcacagactgaatgcttgagtgacctctcaatgggccagagttaggattagaaataccaggtagataaactattcctctttgataagtaagctcctattttctttcctgatgccacagataggcccactaattcttttcaaggatttttctaccaatcagtcactctcagtggtgtttttcagtaagtcaccagtattttaaagggcacctggaagctttcacaagcctgtgcatctccacgtggtgttgtggttggttatttatattaagcctattttctgtrtgcaggtacacatgccagcgatcagttttagtgaaaatgatgctcattgtcaagactagttttcaatttgtgaagtccacaaaagctgtggttcccagggtgtgcctgaagctaagtggaaagcccctctgtggttttaactgacactcactatgctgagcaaagtatttagcagatagacctatgtgaaatggctgatgtgcagctcacgtctgacctgcttgggtggcacaaccccagtgacctgcaagttgactccttcccactttgctttttatctcaactactctttagctgttttacatagagcctsctggaatgggaagaaaaaggtctttgaaactgattgtctagtggcctgatgactgaatccttgttgttgtttttttttaagggtcctccatcttttgaaccccattgtgtcaggttgaagggttggagwgcaacatggttatgaatatagaccttgagatcaggaagacctgctttggaatcctggctctcttattagctgcatatcttagggccatkctgatgttcaattttcttatctgtcaaacataggtaatagaaaccttcttataagttactgtgttgattatataagatgatataagattaatggcaatgtcacattgtcattttatcatcatcaatactggggagaaaagagacaagaatgaaccaaaatcagactctgaggmccattggggaaaggaggaaaagaagcaaacacatgtctgtgccaggtattatatgagaaaggtgttaacagtacctttagtatcagagagagtgactaacttgaccagggtcacacagtcagtgtgtggtagccaagcagtgacacaggtctctatgacctcaaagcttgtgtttgtagccgtggctttacacctctcaagatggtagcttgccgcgtgataggctatgtttcttccaagaggcaaaggttggacctcttaacaaatggtagttgatttctggaacattaatggtcacttagaactgtgggtactcataktaacttagtgccagatggtgtgggaccatcaaggattctactgattaggtgcagagaatgagcatcccagagaaaagcaaaacttagcttagccctcagaggtgggttgagttctctttacagaatgtatggaatggctgtagttgtttaggatgacaggtttgattttaagggttgtattagtttgttttcacactggtataaagaactacctgatattgggtaatttataaagaaaagacgtttaattgactcacagttccgcgtggctggggaagcctcaggaaacttactgtcatggcagaaggcaaagacgaagcaagcaccttcttcacaaggccgctggagagagagagagtggaagcaccgtactttttaaccatcagatcttgtgagaactcactcactattatgataacagaatgggggaaaccacccccatgatccagtcacctcccaccaggccccttccctgacatgtggggattacagttcaacatgagatttgagtggggacacagagccaaaccatatcaagggttttgaaggggatctgttttcctttctctgtacacattgctgaattctgccattggtacaaaagrcagagtggtttaatgaaaaggttgttgatatgataggaggcccatacttcactcatctcccttcactcatctagtctctctcggagtctgcttttcccatgggggggcgaaggggagggaggtaggcaggcccttcaccgcaaatggcttccttttgcccgtgttacatgtaggactttgtaagacttcctttacaactckcagtgattaattgagaggagtgtgcttcatccaggtcgtaagccctcataaatgattataaaatgatttcattattgatacgtgatgtgactgacttttgaaaggcaagatgaggcttgggaaccactgtarcctccaagagtcccggggcgattagatagtgaatatttttacgtgtgctacccaaacaaaaaatatgtgttgcaatatttaccttagttaagatggtgcttcctttaagtgattgtaataaacactaaggcattaaaacaaatagtacatgagaaatagcagcattattgagttccagttttcttctgtacagctttaattcttgatgcttttaatatagaggcagatttatttgacagatatttattgagccctactctgggcctaacataggccctgccctcaaaacgtatacacacctaacagataatttatgcctacgtaggagagcagacttttgcgagctagttttatgcagtaccttttctttggcttgggaagttgatagcttggtggtgttttcttgsatggactaaatccttagaattgtttaggagatattggtcgaaggtggtatgttaaatttttgccaaggatctgaactgtgaagtaacttgtcaagtggggcccaaacctttcaaagtttaggatttacagatctttcctgttctttggtcaaattccagctgagaaccatgcagccattaagctgtaggcaccgtagaagacgttaaatgtttctgacagaaatctttataagcacaggagaatcttaaggacactttttatagtctaaaacagcacagataaacatcttaaaacctttatttgcagataacataccaactttcaattttggggctgtgttatgcaaatcaaattttattttaggttggtcatttccccttcatggcagcctcaatcaactcatattaatcttgaaactaacatgataacatctttacctcttcctttcatataagctgcggctgccaggtccctcttcctctgttggcaagtattctgcactgctgcttcctggttgaaccccactaactgtgggtgttgttacacaggatgattcttagcactccacacctcaactcctcaaactgctgtaattggagttcctatttctgttctgcttctctctgcctcaacttgtctttcctgtctgcacccttactcccattccttcctggcttgttccaagaggagtgtcagatagaatgccatgggcgtcttctcctccaggattgcagggrttaaagatggagatgacctaggacagcacctggcccacaggggacactcttagttagctcccttcttctctgcttaattactttccaaccttctttttgttatccctggaaccccgtgaaacttaactttgctcttccaaaggtgtgccatacagacaggctatgtttcactcgcttctgtatctttatagcctaacccctagccattgcttagtaaatgtttgctgggtggatgagtgcatagaaagataattctagtgaggggaaatgatgagacatattttcagactagttaggttttaatttcatttgtggccactccacttaccctttcagatgaggagatagagctgctttggaagggtttattgtacccacrtggtcattttggattcttgcacagtctccaggaatgggcattcttgttttaatttcaagtaatcaggagattccgggaccatctgttcactagtataggagagggcaaggcaacaaggagttcatattcacatagtactcaggccagtttaactgaaaccaccaacaggtcctcaaatgtcagacacagacataagagagatattcattctttcaccttccatttgtttgcttgttcattcagtcagcttccactgagtgctctaataggtctgataccrtgctacctgttggggccttttagtctggatctgaagattacaacagggtgatctatacacccttgattcggccctccagccagatcagtgactaacacaagtctttaaaatgaatttaataggtcatcacctgtgaaaagaagggaaagtaaaaaaaataatagatatttactgcacatctcctattgttttcagtgctggtgacattgccatgaacaggatagcaccaccttctttgagagattacattctattgggacagatcataaacgcaggagcataacaataagatcatttcagagagtgttagttcttcctaggaagtaagagagggtaatgaatggacagtgactgggagttggaccatcagaatgtccttgtgagatggcatttgacctgaatggcagaaaaaaagagagaaggtacaagctaggcccgtttagatttaggcgaagagagttttaagaaaaagatttcaggagagaggtcagcaattctaaaagctttaaggcaggactagctcattggggttagaaagactgtaggtgtggctggaacataatragtagtggagggtgtgggaacagaggggagagggcagaaggctgggtcacgtagggccttgcaggcagtagcgaggacttagttttattggaagaacagtgaattctttcatctttcctttcttcctccaaagagagagagagtgtgtatgtgttcattcctttcattcatgtcagtgaatccttacaaagcatcttctatgtgaagaaataaacatgaatattatcctggtattattcttacggagtttttagttgatggagtacagggagagacgcaggtacttaaacatctaaaaaataaggtagagtggaatgatgtgagaagtatggataaagcaagccccaggttagcaataatgaatgttttatgaacaacttactttatcaatcttatcagaagccttaccaggcttcccatttcttctagcaaagggttttgctgctgctgctttgctgtggcaagaagtgaggaggcctgcagctggttaaggagaggtagatgcacaatttggttttcacactttggctggtgcctgttgaagcgtctagcacactgagtggatgaataagtgcctaaatgatgtaaaaacccaagtttgatgatcrtcagaaaaaatctcagagaaattggttccaggatccccacagataccaaaatctatgcacatgcaagtcccacagttggcctgtggaacccacaggtatggaaggtcaacagcacacatttgcgtggtttgcctatatctttcccctttttgaggaggagacagtgacaattcttcattgtcaattctttcttctggcacctttatccacaactctactcatgatcacattggacagtgtgaatgaatgcatagaaagagcttatgccttcacattatgattattcacgtatatgttctagcatatggagatttacaatgggtaaataatttactgatttggctgtgaggctgcatgagaacttatgtcactttttcatcctcttatgcaagtgttaattaggcatccctaaacacattgctcttcaatcctcactcctcccatcaaggtagcatgattgcccaacaagctcaaggctgaagtaatcagagtctaaaccaaaattaggccaaagtagcattcccttgcttcccctattaaaggaataacacatataagaacatttgccttgtggcgattatgggacaaatgcatccattaaaaagcattttttaaatgacctctctgaatatactataaagcaatacaatggaagccctttttttttccaagtgagttaaaaaaaaaaaaaagttgttttttttttttttttttttttaaggaaatcactttggtataggagtatttgtttcagaggtgttttgctgtcactgctccaagtgtttcactggcaactgccttctgaggtgagagtaatgatagctggtcatttttgagcacctgctccattcaagactttgtgctagccacttctaggcacattaatgtattgaatgctcagagcactcctagatggtaggtataattccctgctaccttggcatatctctaggaagttctatgctaatattttattgttatgtactatttcctgcctctgtaaacataaaatttagctccaaagagttgtggttattgtctaaaatctaatctacccaaaataaaagcaattttcccacttgagtatatagaaagtgccatagatttagaaagtaattctaaaatagaaagtcttaatgaatagtggcaacagtattgccattgctcagttagcataaatatatttcaataaaatatttttaaagaaagttcacagaataactatttgaaggcaatgtcctgttaagacattattctcatgactgtatagtcatatctcttctacatatatggctatacatattagatatgtatacctttaaactttattcaaaaccattaggggaagaattacagaggaccatgttttctgaatctagaactattttgtcaaccattttcaaagcaagtcttatgttgcctacttctctgttttgtggagatgattatactgatgagtttatgtattcagtcatttgtcgcttcatttcataagcatttttgagcatctactgtgtgctagacactaggactaggaactcagccatgaacaggttatacaagcccctgctttcatagaacttccattcttctagtagagagaaaaataccgtaaaagcaaacaaatcatgaacaggatcatttcaggatgtggtaacactatggaaaaactggcatgacgtgcatttgagagtaacccttgggtgggccgagggtatacactgctgtagggtatccttagaaggcttttgtggggaaaggactcttaatccgaggcttgtgtaagaagaaagagccagtcatccagagagctttggggaagagttctaggcagagcaatcaactagttcaaatgtcctgagcaggcatggtcagattcatacgcgtctctgagaacatctgctcttacactctgctgtgactgagggataccactcggcctggagaggtatgctaccctccttgtcctcaaagtctcaaggacttttctgtccttatggtctggtttgtataatttttctacatccttttggctgtcagctctcatgtagtgcctctgtcagtatggcttcctagcagcctctctctgatttgcagcagcctgcatcttctctgggcctagattcaaatgacaaaacttgttaggactatgtgtgaaataaaagtaaaaagtcttcgtatcaaggttggaagtgctctcctagactaccatccctgatccttagttatgtaatgttaaagagaatgtaataatgccgtatggcacaactttacattctcctgtattcatttatttgttaattcattctttccccctcaccccactcttttgagttgtccaactgcggatacatacttagaaatgcccgcacacgttttatcatacttctaatgatttgggaaagataatcttatagcctatattatctaccatttttctcttagcccttatttaattttacatataygacatttcagaggatgtcactgcagttgttgtttggcatttatgggaataaaactttgtagcacayttagacttgtattatttctagagggagccttgtttgattgaaggacagtatcccctgtctctctaaaacatgaggctcttaaaagtgcattttatttagcttatttttgccagtggccaaacactcaagcttaaaaaaaaagaagtgtcacctagacttacctgactgtagctgtcaaatgaggatgctttcaataaactttaaaagtaagtagatgaactttacaccctaccagttcataggcaagttggtaaacattgaacagaaattctgagactgtacccgctcccccccacaaaaggaagtaggtagatggtctcaaaaaatgttatggctgaaatctttcacattcatttgctcatttggagttaactgtaaagtccacttagtaatttctgttagactacagccatccttttttagtcattattcccccaaagataaccgataggttattctcctccagaagcagatctttgtttctttcttgaaaataattaagaaatgttgattcaggggaaacttggacttgccttccacaacagattagatggcatggttgaaaaagcataggctggctcttctcttacttagtatgtgacacttggcaagctaactaatttctctaaggcccaaggtttttcatcagggaaaaagggcaatcataagtatggaaaaaaattaatgactatttttagcattttaaaacaatgacatcacaaaaacagttcatctaagaataaacccattggattcagtcttttaagtaaatgcttatttgcatcatgttctttccctcctgctcttagcaatctaaatgtcttatatatttttaaaactcaggtttatctcaaaactggtatatagtcgtcacctcccccatatgatgagactgtttttagtttcagcctatcgcggatatcattagaatgcagaattaggtagtggttagaagataaggctctgtgttgtcaaagacctgggttcaaattccagctcagccaccctggacaagttaacctttctaagccaagcctctgtttcctcatccataaaatggatataataagaatatttatttcacaggacttttgtgagaattaagtgagataatctctgtaaacctcttagcatgctttctggtttataccaagtatatgttaaatattagttatcttccctctttcctctacaatgcaaatcttaaatcttttcagtaatacaaaatttatctcttccctgaaatgtctcataaaacattcccttaagcatgacatgcagcatgacaggtatgtgagatgacttgagatcctaagcggaggagcattttgtataggtagaggtacattgtaattttcaaagtgtcttctatcaatggtaagtgatcctggtttttcatttattgtaactctttacaatacagttatttaaatttttttaaaaagatacaagagtatttaaaggaagatattgaacagaagtacaggtaggcagtggatgtgataagatatggagttagaatgtaggtgatgggtatggtggaaatcgtgttagacttgcagtctggaaaccctgttttttgtctcagcatcccagtaaagaaagcatacactttgggatttggtagatataagtgtagaatgtgacattagcattttctggctctgtgaccttgggaaagttacttaacctttctcaccttgcctttctataaatatttattgaaggtctactacatttccttatctgaaaaatgaagatgatccttaacaggtttctgtaaagatgcaatgcaaagagataaaatatttgaaagtgtatatatcttatataattgatatgttttataaatataataagttttatacctgatgtctagtaagtgctcagtaaatgttagttctagtgttacttaggacctgtggttgcaagtgacagaattccaagctcaactggcttgggacagaaggaatttgttgtctcgtgtactcagactgtaggaaggttaacagtgacatatgccttgggaacagctggaagcaaaaactcagatgccagaggagtgtctctacctcttttctctgttactgtgtctctgttaatgtcattttgtctggccagatttttcctcacatcaagaaacagaaccactggcagtcttaagctgatgtgaccagaaagcgactgagcattgtggtccttgtttccaagcccagaaatccgaggaatgacgttgagtccagtatgagtctggtgctcacctggccagacactggggtctagagaacaagaggtgaaggaaggtggtaggaaagaccattttccataaggggaattgtaggtgcctgctaccattgcatttatccctttcggcttcttcagggaagtacttagcctctgtgggcttcagttttctggtctgaagttctgaggtttagatgatgtaatggatgtgagtgtacatttaatgttttaaatttttatttatgcagtttattactgttattgctcatgccttccaaatcttgacatatcatctaggggttcccaagcagaccagaggcccttgaagtagcagaaaggggcctaaaattgttttaacaagttagtccagtgtgccaagtatattgactatgccccattttaaacttgtttttggagtgtgatacacatacagaaaggagtacatagcctaaacgcacaatttgctgaattttaacaaactaaacacaatggtatatcctgtacctggattaagaatcaacaacaatagactcctagaagcccccctgcttataccacaggtagattaatgtgttgattcatcatccaagaaatcatttaaaagcattaccagcatcatgatggcattttccaacctgtttttttaaattaaaagattgccaaaattcaactgccrtatgtcataactaatttttttttttaacactaaaagaaatckcaaaacttaaaagcactgtgaaaagctcttcaggtcattcctactcattataccccttgaaatgtttttctggctaaaattaccatttaggtgataaagtgtgtcctgttgcctgggtattgtgccattcatgtctatgcttgccttttctccttaccagattgtaartgcatgaaagaatccaagccttaagatttcttcagtgtcttgtactgtctttcttgtgcatagcttagcatgataattgactgactaaaatgctatccatttcacacactgagctttgtggaatgactgcacttctccggaaaatataactactcagatcccagggacttccagtctgatatgattcattgttaatgaatatgtcagtttgctgttgctttggtactcaggaaaacaaatgcaattacaaatgaatttttcttattatttttttaatttaccaaatcttctaatatcttttcccccttttttctcttttaggctctagaccaagatagaacagcccttcagaaagtgaagaagtctgtaaaagcaatatataattctggtcaaggtaagcacttactaaaaatgaggtaacatgaattataaataatgtctacagagttttgttagttatttaaaagatgttaagtttataggaaacttgacacaaatggaaaagtaagtaggtaaaagaaatttctctttttttctcttatctcgactgtcagcccaaacctattagtgtttccaaaacagaaagaagaaaagcattagtcacagtggattttactgtacacttaagtgcttaatagagttatgagtaaatttgtcacaagtaacatgagatagataaaatctctgtgtgaatttggtcaacctgtaactcagtggcttcagttaaacacatcagaatcttttcccttcttcagtgtacctgtacacatttgaaaatcaatattggcgatggttgtggaaaaagttagagaggagggggcaaagttaaattcagacctcaacagacctgtgaactatcatcttttcttttgttggaaggtgtgccagataacctgtgtaactaaatgttttaactgtctagtgactttgtcaccttggaggcaaaagtatgtcatcagtgaataagaggaaacaaactaaattaaaaaaaaaaaaatgagtaaccacaaaaaatggtaggctccagcactgtagaagagaagcttggaaacataaaatggatttcagagtttctcactcacatcttttgttactattgcagtaccagctcacctaccaataggttacttctctaggaaatcagtggtctgtaacttaacagaaaacctggaagggaaggcagcagactataatagaaagagcrcaggccgtgaagttggacagatrtgggctttcgtccttgctaatccacttcttattagcaaggtgaccttgagctggttatttctccttcttgagcctccatttttcttctgtaacgtgaggatagtggtattwaaaaaagttgttgaagggatttaatgatctcatatctgtaaagggtctgccaggttatgggagttcagtaaatgcatgttcctcttaattttatcatcatgaaattattgagctgaatggaacctgaacaagccaaaaccctcaggtactttatggccttcccgtctcatcagagctgggaatccctagccaaatgaaactggaaacctaatattctcttgttttttaaacccccctaggccttgagacattctgtaatattaattgttaacacattttgcaccctggtgccttcattttgctccctaatttctttatatccactaacttctcattaaggtagataactaatagtcatgtagttatgaccaaatgttgttttaggtcttggcctaagttatatacctaatttataactcctgccctttcgcttttatttcaatgaactcccacactgtggtaggcccttatgtttgatactagctctttggggaggtgagtgaaataaataactaggagatgccacaaagtgggcttctaaggtgctgatattgttgtttcttgatgttagtggtggttacatggtaaagttcactttttgataattcatcagatgctgaacttaggatttatgtacttttctgtaggtatgtatattatataccaataaaaatatatttaaagtattatatacaaggaggttcactgaagccttgattgygatttggaagagcagaaaataaaagggatttattaaataaaccatagtatacatataatagactactacacacccctttgaaaaagagagaaactcaagtagtctaggtctgagtttgaatcctagctttgttatacttgttcaagtcaagtatattatttaacttccaggagtcttacatttccttaccataaatttaaaaaataatatctaatgtgcaggggattgtatggacaaaaggagagaccatctaaggcccctaatacactgcctgccacatagtaggtgcytaacaaatggtagatgggggaaaaggacagctagatgaattcttgagtgccttctctattttaattcagtgattccacatacaacatttgaccagcctgattttataaagagcttaatgagaaccattgtttgtctcaggaagaatggtcagttctctgtaatgtgatgatggtttgtacctgaggctctatgcttgtgagctgcaaaagggagacccttgctttacagccacgaggtgctgctgtatttaccgtgctgagggctccctccatgtgactcttttccaaatgttccccctcaagatgcatttcatcccttggccacaatgaccacatcactcagcagctcatacaaaggctcctctactgggggatatgcttcttcctgttctttaaaggatttccttgatcacagctgccatgggtatgacagaagggagagattgttcctgtatggatgtaaagaggtgagagttcaagggctgtatgcagagtttgggtgcagcctcctccagtagactgcaccctctttgtggatgggggtggtacagcttattgaacattgaatctctccagtctggattaggggttctgtgtgccctcctcctaggtttgtactattagagtagcctctggtgagatatggttttaaattttaaatgaattaaaataaaatttaaaattcagttcctcagttttagccacatttcaagaacttaacagccgtatatgactagtgggtgccatattggatagtgcagaaatagaaacttctccatcatcacaggaagtcctgttagactgatactgtaggagaacatgtatcccattgtattgcaattactaaccatctctcttggagtagataatgattcttacctttgttgattaggatcacctgaagaactcttaaaaacaaaaacaggaatctctcagacccttaccctcgaattgttccagagtagagcctagctattgagattaaaaaaatattattccccagctgattctaacttgcagccaaaattaagaactgttgcactggcctatgagttttttgataagactagtactatgtttttcgtttttgtagtttatgcatttgtcaatgtaatttgtttgtttgaaaagatatttattgagcacctattatattctcctgttctgggtgttaggtgtttggcacatcaaagtctctgccttcatgaattttacaatccagtaggggagagataaatgttaatcagatcatcaaactgggaagtatttataactagaaactaggaagcgctataaaagaaagcttacaaagtgcaaagggtgaaataggaagaaggatctgaggtagcgtgaggaaggtgctaagggagtaccacttggaggaaatgatattcattttgtatttatactgtactaggctaagccaaacaagccaataaggtaagtaccattgttctcattttatagatgatgaaactgaagcttagagagacagaataacttgttcagggtaccatacctagcaaataatggaaagagagcccagctgaccccagctttgctctttacaggtactctgtatttgtcttctacctaacacatggtaggggctcaacaagggttgartgaatcgctacatgttggctggatgtgttactacctgggaagctctctgagaccagctattaatattcactaatcatgaatattcatgaatggatccatcaaatggaaaatcccagcattrtaacctgtgggatgactttggtgtttcccagatgagaccaccaatagtagtttccatggtcatgtctcakaaatatagggacaaactcagatccctctgggttcctcacagactattgaggcctgatagggtttctgcagtcacgaacaagtatagtatagctgggtttgtgggcagcactatgacatttaattctttaaaaatgactaaatgagtaaaacagtggtgttgcatagctttccatgatacatgctcagtggaatccaagctgttcccctccaagggcttttggcctcatccagagaaaccacaagaagctgaaccctgctatctgtttcccaatgcattttcataattttcttgttttctcacaawgcttaagtgatacaaaacccatgtgatattttttaaacatttaaaaaggatttctatatttctggttggagattaccaatcactcagcttcccaaagtgatttgaaaaatggctaaacattgtgaagcttcttactcttaaaatgtattatttttacacataaacttttatcagtactagtaaacattataaaaatgagggttttttggttttttttttttaaacaaattgtctccatgcaagccctttggtttcaagattgttctaggaatttgtgtctcacttttccttgttgtgtatgaggacattttaaaaaacaacacaaaactcaattctgtgaactacttagaccaatggaaaattctccaagccattcagttttcctgtgttgttctctaagttttgaagttttaacattattaatctgtgaaacacattgtcgttaaggaagtctgccttagtggtccctctccctttcccattttctccctccttcgcccttttgctaatatatgattaaaatgactagtagtttcttgggcactgtggaggttttaatttattgtaattcttgggcaattttctttagaaagatagagcctaatcccctttccccttgaatgtacaccagagttactaactcccttctaatgaatagaatgtagtagaggtgatgccatgtgatttccaaggccagtccatagacaagatagcttcaacctcgtccttctgttctttttctgatcattttctttggaggaagccagctaccatattgaggatactcaagcagtcctatggagaactaccactcacttactagccatgcaagtgagacgtagaagcaaatctaaccccagtcaaactttcaggtgactgcagccctggcagacatcttgatcttgatctttgtgagagaccctgggtcagtacagtaggagtggggctggctttcccttggaagcatgggcatgtgaatgcacgtaagtcaggtgtggcttgagaaaagagcttactgcttgcttctcagtattgtttaaaaaacacagtgagacatactgcacttttagaaatggaagcatgtggttcataataagcgtgggtatactgagttggctattctaccaaatgaattaggttgraaatgttaatctttttgagcagatacattctcacacaacacaggtacaggtatacacttctttctgggactaggaactcaggatattcctgctactaggtctttttctgtgttaaagtgttggctttttttttctttgctcaaattaaatgaacatattattatatggctggttccttagaatttatgccaggatatattcagaataaatgttagcttattggtaacacatggtgccccttagaatctataacattgttggtctgaaagttgaggcttgtaaatcctttaatatttctgggcargaaaaaaatgacagtggtatataattttattaccagcatatgatgtggaagtcatattttcaaaacacagctaaattgttataaacagttttgcagctttttcattacaaggaagacagccattgattttctcatttcsttacatttttgtctcccattccttttcagttagaattaagtagtagatagttttataacacagggtttgtgttttttaaggcaaaaaatgtgtggtgttctctccactttttcattttgttaaattatctattttaagaaaaagctcatagtgcacaaggaaatctaggattttaaaggtaaagtactaaatttatcagtggataggaagcaaatgtttttgtaaccaaacaacttcatttgagctattttttagttaagtatttcctcaaacttgaaggtatagtgtgaattcagttgtaactagagttggtaattaggttcggtgtcttaccatggtgtcatgtaatgcttattttaatcctgcggttttcagtggggagaaaagttttcttaacaagcatatgtaagagayataatagattagaataaaatgtcacaaggtgtacaaaagcagcttgtctctaggaaattttacctttttttgctgtttttcaagtttgtggatagccagattttttaaaaaatctttttgaattacagtaaattgattagtaaaaataataacaattcttaagctctcaaaaggctttagatagaaatactgggattgagcaaaatctaaacagatttctttgggccttcaaggcattttgcattcttgtgggtccacctccttgggaggtgaaaacaaattaaaataatgagttccttcattattttaataatgaagggtcaaggaagggrtttttttcccccaaagggaatatacttacccaggagagcattactccttaaattatgtggggataaactagagggattcaaaagaatgctgtttaaaaatcagtgtctctttccagaataatattaaaacccgaggcttcttaggaagtttcaatttttggatcctagttattggctcacatattcttttacttgaaattagaagctattcactgtgtgtatgagcctgtgtatgcacttcctccgttttgctggttgtagaatgagtgctctcattttacttaaaatgagttaattttttaatgatgtgtgcttcttctatctttggggaatgtacatcatgataaattaagtagtttaaaataaatttgtgagtactcatcccacgaccgctagtttggggttggtgtttgtttgtttgtttgtttgtttgtttgttttggagacaggatctcactgtgttgcccaggctggagagcagtaacgcagtctcactcacggcatccttgacctcccaggctcaggtgatcctccctcctcagcctcccgagtagcagctgggaccacagttgcatgccaccatgcccagctaatttttgttttgtgtgtgggagggaggtggtgtttggtagagatggggcttcaccatgttgcccaggctagtcttgaactcctgggcccaagccatccacccacctctgcctactaaagcgttgggatttacaggtgtgagccagcacgcccagcctattttggggttttttaaagccttaggatgaacaacaaatttgctctgttaaaggtgaatataaaaatgtatttctctgctttaatgatttattttggtaaaaataaatatagctgccatttgttgaatacctactctgtgccaggtagagtccattgtgcttttcagtcttcaattagttattttcactgtttacataaagattcagattaatractgttaaggaccacctttgagccttaaacagacccttcttgacaactacagtcaaaagattctatggctttacctatatcttgctgcctcctatttcaaaatgcattttcctcattcttaaatggtttatgtctcatcaaagtaggattgtattttcctgtataaagctgttgcacttaaactgtagcaaagaatctgccctctgaaaacaaccatgccatgacaacytctaacaagcagtcatatgtgtgtgtttagttttatttctagttcacatgtcaatgtgaatttttaagtgtatttttatgactggagaggtttctccaattaagcgtttagcaagaaagaataactatttactgattctgtgatgcctcatttgggtatgcaagtcaagcagattgttgctrattctgaactggttttcattgataatcagtgccataagacagaacatttagaggttgatagaggatgactttgctcggctagtttgtctgttgcattcacagacaacagaaggatattctcagatcttccatgtcttgggtaattgatcagacatgtacttgtttcattgtggagagctgtatgggtgctggggggactggaacaccccgtgctgatttttctcactggtgttttctggtttctttccccattgtgaaagtgcagtgatattaatgtgtttactatagaaaattcagatgagctaaaagaaaaaaaaataatagccactggtctttttaaaggttttttcccattgtttatatatttttcaagttaaaggtttttttggtttttttcattatttagattctttttctttttttttttttttaagacagggtctcactctgttgcccaggctggagtgcgatggcatgatcttggctcacttcagcctcgccatcctggactcaggtggtcctcccacctcagccttctgagtagctaggaccacaggcacttgctaccatgcctggctaatttttgtggtttttgtagggacgtggttttgccgtgtttcccaggctggtcttgaccgcctgggctcaagctattcacccaccttcgcttcccaaagctctgattaccagcgtaagccactgctcctggcccattgtgtatattctgaatcacaaacacacatacttttggagcacccagcacatctgtgttctctgtggccctcattatcttgtccacatttgagggtgatgctttttcccagagttctgaagtggagaagcctagttgaggtcatgttttggggggtgttctatgccacctgtacagtgaggagctaggatgctcctaggtagagagctgggatgtgatctctactctgacaggaagtaactgagtatttcttaacaagtccttcgtttctcaggaccttggtttttctaccagtgaaacagagatgattttttttcttgtctgtttatgaaatgagatgaagatacttttgtagcctctaaaatgcactgtttatacccaaaggggagttgatagtgtctaacaatactgcatttccctagcaactgatccaaagagacctgccccttttgatctcacatgtgctgttgcccttccctcagactcgccaactgtgcacccagaaagggcaagaagctttgtcttcagatacagctaacatttcttctaattctgaacattttggggtcatagaccccttagtaagcctcagaacgacgacacacgttatctgaacttaaaacaaaaaatcttacaaagcagaatatttcagtcaatttcaggggtttttggaacccctgacattgagatcagaaccattgatttatataaacaatatgttatctatactatatactgtgttatatatagtataatatatataataatttataattgattaaataaacatataagcattgattggaaatgctttgaaatgttttactgacacggattgatgattaaaaatagtttggagagtccaggtgcagtgtggctcatgcctgtagttccagcactttgggaggccaagggaggcgaatcacttgagcccaggaattcgagaccagcctgggcaacatggcaaaaccccatctctgcaaaaaatacaaaaaaaaaattagctgggcatggtggcatgcacctgtggttccagctactcaggagtctgaggtgggagaattgccagaaccagtgaggtcaagtgtgcagtgagctgtaattgcgccagtgtgctccaacctgcgcaacagagtgagatcctgtctcaaaaaaaaaccacaaaaaaatagtgttcagagggtagctgctcaggctgagtcctatcgtaggctaccacctcattagcagaacaagaacccaatgaggttttattatctcgattttacatataatttataagccaagaagctaaagctcagaaggacttaaaggtggtacccaaggccataattctaaacactaaataacctttgtatcccattgtaggtgcttgatgaaagtttgtgaattagtagttaaatatggggtcctatttttaaacacctatttatttagaagggttgactccattgggtagtcatactgtggaggctgaagtaggggaggaattggttgtgtctttgctacctattttaggaccacatctcaaagcattgcaattacctacagagccatcagtaaaccaaagtgtattgtgtatttcttctggcaggtaggaaggctgtatgatgaagccagaagagagaacatttctgcttctgctataggagagtgatgttcaggtgctgtttaaatgctgagtaatagccctgtggaactctttgagtatcttttcttggggctctgttatttaatggatttgtcagtgctgcagaaatgagaatatgcatgctgagtttccagataacaccccagaggctggggccagactcttgctgaggcttggttaggactttgaaagaacaactccaaagtcaaaatgaccttgagaaattatagaaatgaatcatccaaagtggcatggaggaaagcagttttaaaaaatgtccacagggctttctgcctccaaggattttgtctttaatcttaacaatagactaatacagttagtggtgggaaaatgtaaggaaactgaggctcagggaagtgaaataatttgctcataatcagcagttgtttccaaattagtgttatagataagaaaataaagagtttagaccccaaatccagccctcattccccaataatatggtgtctgtaaagttaaaacaaattattttccgggtcacaggacaggtggcactaagtttttggattggtggcaaaaaggatctgagccactatctgatgatgaacaggaacagagggcagtgcttttaaaacgttaatcacagcactttgggaggctgaggcgagagaattgcctgagggctggattttgagactagcctgggcagcatagtagggccccatctcttaaaaaaaaaaaaaaaagccaagcatggtagtgcattcctatagtcccagctactagggagagactgaagtgggaatatcacttgagccaggagatcgaggctacagcaagctatgaccatgccgcggcattacagcctgggcaacagagcaagaccctgtctcaaaacaaaacaaaatcttaatctacctagctctagattgaaggtggtaagctctggagcaaccaaaggctccatattagtttctgtgtatctcagcccacctaagcaaacactgacttccttattgctgagtactttatggtgcctgtatggtatgctgctacctcttgccttgaatgtccacaccccaagtctacttgttaaacaactattcatttttcaagtttctgctcaattatcttctcttatgaaacctaacccactccatccaagtgttgtctgtgtgttctttttttatcaaatattaaatagttgccttctataggccatctgaaatagcagtatgttttcatacagaagaaagaaaaaaaagttagaactcctcctcatgccatatagataatttcattgcagatgtattacgtatttaaatattgaagtgaataaaactttaaaaagtttaataacttactttaacgaaccctttcctgtgctatataaacaaatacattgttttgggttaaaggttaagggtttttaaaaatactaaatattagaaggcttaggaacataaggccggaaacccaaaaaagtcttttgcatacagattgatatatatgactacatgacatttttaaatttctccatggcaaaggacaccactaacaagttacaagacaagtggaagaaatatttgcaacacatattataaaagtttctatcccttgtacaagacattcttacaaactgataggaaaaatactagcattggaaaacagggctaaatatgtaaacaggcagaaaaggaaatgttaatggacaataaaatgcaaaaagataggcttactataggcagttttttatacacatgtggccagaattaaaaaagaacagtaacatctatgtgctgatatggttgaagagaattagccccttttatatgtgcattgctgttgggaatgtgaattgctttaaccagcttctctggaaagaatgtggcaatattaactaaaacttgaaatgtacacactatcccccagcagtcctgcttttgtgaagatatttttccagagataaagtaacagcgtgtaagagcttgtgtataagagtatttattgtagcattgtgttttgatggcaaaagctgcagaaaacctagtatcctttcagcaggcgtatttattatggaacatatcccagttaaaataattagatttacttatattaaatttcatgatttttattccataggaaaaaagcaagccatggtggtcgtatgtaatatcccatttattttttttaaaagggagaaaggggtgaaaacacctatatttgtgtgtctgtatgtgtgtgtatatcttttttaatcctaaggtttcactgagatacactccagattattaactttgcttatcttaaggaggtgggattggaaaaagggaaaggaaattataattttatctttatatttctctgtaatagcatatgaattacttatataattttaaaaacaaatagaattaaatattttataagtgtgattartgctacaaagtatgcataggataatataaaaagaatttgtcacttccccttttatggcagtgctatgatttatgtcacatattacatggctttattattacattatagctcactgtattttatatggctggcacatggctgctggtaagtattttttgaaagaaggaaaaagacttgttctaggagaatccactacatgcagtgagcattttactgagcattcactatgtgccaggctcagcactgggaactgggcgtataacaaagtatgtaaagctgggacccccaccttggcaagaggctaagaagagagtgaaaaacaggatgcttggtaggttacacttacattgaaagagtcagggtgaatcctgaaattgtgatggaacttacagacaggagaactttggataggttttatgactggagtgtaataatgcgtgtatcccagctatcctctggaagatttttcttcgttcatgaagataagatgataaacaaatgtttatcatgtgttcctctggactcttgacacagaaggagaacttgcataaagaccttggaagagaggctaggctcccaggaaagagtatgggaaattaaggaagtgagactctggagtgtgggatggtacttagcattttataaacacccactgtataccagatactagatgaggcacttcatagtctttctcatctatttccyttaataaccccatcaagtaggtattactatggctaagaagacaagagtctgagatgatgtataaattgccctagatcacagtttataaacagaaaacctggaatttgatccacagtcatcttatatatcctggaatcctccaaaaaataccatgtttaaattagcatccattagcatcagaacttcagctctgaattttggagtaaatgaaattaatagaagtaaaggtatttttagactcattccatgttccttataggcattgtcccatttcacgtatgaagttgaggcccacataagttaagtgccatttccaaggttatatatgcccagttagaaccagagtggggattcagacccaagtctctgtgtcactgaggcctgtgttctgtgtgatctttcaccaaatgttgtctaggttgtgcttggttgtggtttggaatgctcctcaggatggatttatgagagtgttctcaaggccttattatacccattaagtagaaataatcctttgtggttttataatttttttgcatttttccaaaagagcttttatattaattatgacacctttacctcttagtggccaatcagcagggcagatgttattagacctgttttatatatgaagaaattaaggcccctaggagcttcagtctcctgacatggtagagtctggagctaagacctggattttcaggtttctcaatcacttggcatctggctaaagttaaaagacttctagaggctcctgcacttwaccaagtacactagttaggagcacaggctttggggtcagtgcctgtcactactgcttcttagctgtatgacattgagcaacttgcttaactactctaaaccagtttctaaattgtgaacactgaacgagataatgcaggagaaatacttagcacagttcttggcacattaatcaaaacttgtgattgcaaattattattattattactttgtcaatattattacaggacaggaagtcttgtcttattcacctttttgttcctggtatttgtcatcaagtctttcacatagtggattctgaatagatattgtggcacacaatattctagtatccacgatagtctttcctgagtgtrtcagtggagaaggataggatttggaatcaaatgaagtgggatctaatcctttcttcaccactgagtttcatttttcttatctataaagcaactgccttgagggagtatcrcatgagtttcaggatattcactgtgattgaatccctctacttagtcagtgcttaataagtmgcagccataattagagtcgctgagaatcaaaggttaggttggcaggcagtccagtccagaggttttgtgaatattgcccagtttggtaaggtataacacatagtgtcagttagataaacccctcagggagagacctatttaataattgctgtggttctgaaagttttgaggaaggcctcattggatgaatatacaaagtatgtttaaagagtattgaattttaatgtattcctaaggtacttgttattgccaacgcctagggatataaactcttcagcgttgtctgaagcttctgcttcctgtccacggggtaaaaggctggctccaatgcagtggccaaggatggatagttggtatggttgtcatcattgtgtcattgccattataaatatttattgagctcatcgtgtacgaggcacttggcatgcagtatcttgcttaaatttaataacatctctgtgaggtaaatgccattataatttccattttccakatggggaggatgaggtttagaaagataaagctgcttgaccaaggtaccacacagacagtaaatgatagacttgagatttgaacctaggcctgtcctactttaggatatggagtatagaggagggtaccctgtaaggttcagtggctgacatctgcaaattatatggacaaaagacaaattaacaggagaaaaggcttatttagtatggacataaggggcctcacggaaaagaaatgaaaaaccccaaagaagcagctaggcctaggagcttatataccattttagcaaagagcagaaaattgtggagaagtgacaagacagagaaaaggagacttctaggaattatagggcagtaaattatagggaagataaatataagggggaaacaaatagatgatagggattattttaacaaggtttatttatgcagactcatcttggtactgacatttcatctcttgtgacaacagtttttctcctcttcctagaaaggaggtaggggaaacactttcacaaagggagatttatgccttgcttttaggcagaaaatgttcttcctttcctttacttccatcctcctctcccttcttccttccttctctttctttcttttctttcctttcttcctcttttctttgttcaaggtctcactctgtcacccaggctggagagtagcggcactatcaccactcactgcagcctcaacttcccaggctccagcaagcctcctgcctcagcctcacaagtagctgggaccacaggctcataccacagtgcctggctaattttcgtatttttggtagagaccggtgatatggtctggctctgtgttcccacccaaatctcatcttgaattgtaatctgaattgtaatccccacatgttgggggagggacctcataggaagttattgaatcatgggggtggttcccccatgctgttctcatcatagtgactgagttctcacaagatctgatggttttgtggggagtttttccttccttcactctgcactttactcatacttctccttgccgttaccatgtgaagaaggatgtgtttgcttccccttccaccatgactctaagtttcctgaggccctcctcagccatggctgaactgagtcaattaaacctcttttttaaataaattacccagcctcaggtatgtcttttattagcagtgtgagaacggactaatacagtggggttttaccatgttgcccacgctggtctcaaactcctaggctcaagccatctgcccacctcagcctcccaaagtactgggattacaggtatgaaccactgcacccagccaccttgctgtttcttaattgctttaagctcaaaataattgttatgccgaagtggcttgttttggggtggcatattctaatttaaatttccttatttatgagttgtatgatcaagggtaagtgtttatatctacacagtgaggatggtaatagtacttatctcatggactgttagtaagagtgaatgaagtaatgtactgtatgtaaagtgcttaatacaataacatttagtcaatacccaacaaactagctattgtaacgattattactggaatagtaatactagagtagtaaatcagtgattagtttatattagtcatttccccacagaaatgctggcagttgaaatcgtgatgaagtggccttttctggtctagtttttaaaactagaccagatttcattctcatattatttcattcttgtttgaactgaaaggattcacctagctgttagaattatcttgcaggccaggcgtggtggcttacacctgtaaatcctagcactttgggtggccaatgtgggaggaacacatgagcccaggagttggagacgagcctgggcaacatggcaagaccccatctctacaaaaaattaaaaattagccggtcatgatggcatgtgcctgtagtcccagctacttcagaggctgagttgggaggattacttgagcccagtaggttgaggctgcagtgagccatgttcatgccactgcactccacgcaggtctacaatagcaagaccttgtctcaacatcagcaacaaaacaattatcttgccttctgcaacaatgtcgtggatgccagaagtttcttaggaatattgggaaagaatgtgtcttcttaacggatggatcacatttctctgttcttttcttttatccagtcttcttttctcacctacttaccctaactcccactgtactatgtgcccaaaagtcttctagcactcgcatgtagtaaagatcttaaaacagagctgcatcctgctctctgaaacctcttgaagtgagtgggccattttctgccttatcagtccgtctccttcagaaacactcattcctgtggcagtgtcccaccaccgcagccttctttccctcctcttccctatacctctgaactgacattcccctcagatggcttactgtactctgcagtgtgttcctcccttctgccgttgcccttgctatttcctccaccagaatcatggttctttgctgtctcactctctgtgcctgttgaaagtctgctgggtaaacccttaattttgtacacaagtgtgtgtgtgttaggggacatgtgtgtgatctttctagtattgactttactaactttataatacagtatgttaaaaaaaaaaaagacatgtgagacctgtgtttttattctgtttgatattacagacatcgctctgtattgtaagtagtcatggatatatagcggtaacagtagctgacattttggggcacatgccacatgccagacactattttaagcaccttacatttaattttctatcattctattttcataggattatgattattattgttattattaccccaagatatatcttactaaactgttatatttttatgctaggaaattatatatatacacatatatatgtgagacatgtatatatatgtgagacatatatgccagtatatacacacatacatacatacatatgcatatatatatatatatggaaagagactacatggttattcagctgtggaattagcaaaacatacaggacccatgacctagcctatacttatctagtcttctgcctcactcacgtcacatttcatgtttcatctacctaataagcataattcttcccttgcagaactagtgggggtgaaatatgagattgtagaaagcataaggatttgggtcacagaaggttctgagcttctcccaacaccttcttcctatggcctgtctctgccttagcctttagccaactccatcttattctttaatgagtctgtcatcacagatagatggagagcttcttgtaattctttctaacctttgcatgaaatttcaattcaggataatggctgtgtctagggagggaaggaaggagatcggaattgggtagagggacaggagtaggggaatagggaatcattctttaatattttatttattaagctgggtggcgcatacatgtatattcgattaactaattatatttttcacttgaaatatttgatagtctcaagaaagcagcctatatacctatttttactactgaggtgcttcccttgggagcaggtaaaatgaacacacagctgaattcttttttcataggtctccaaaatcagaaaaggatatcagatgaggtaggagtcttggtggtaaggtgggacctctttggcctcagacagaaggtmtcaggagtagctccagcacatgagggagatgaaacctgtgtgtcttctcggttgagctcgtgtggcctttcttttctgtttttctgagccgctcctctgagtgaacttggatagtaaccagagctgcattttttaatatctcagcctgagatgctgacaaccactgcaggcaccatgaatttttaatgtggtggtgattagaaggctggctagggcctcatttcgtttcattggactgctgtgacacttgtttccttcatggtatttagacttcctgggttatttcccartccagactcatgttctgtttcatgagtgcccattgcacccatgcacttattgaggtgtgtttgaaagcagaatttaaaaatttgatctcagttattgaacatcctacgctatttcagaaagggatgcttcttaaattcctgaaaaggaattcaataaatccaggtcaacaaatattaaccaagccgcagctttgaaagtccagctcactgaaagaactacagcagtgtccattgggtagggatgcagaagtgaaccataggtaatccctgcctyttgcggtctggtggtaggaaaagatctgtgtgtgtgtgtgtgtgtgtgtgtgtgtgtacatatatacacacatatatacacatatatacacatataatatacatatatacgtgtgtatatatacgtgtatatatacatatatacacatataggatgtggtagaaaatactgcagtagaggtacagagaattgtgggcaaggaaggattgtttccaactaaaggaagactttataaagaaaagtaatttattgtaaagcctttaaaaatatgaccaaaaaaaaccaaaaaaaaagatatgactttgataaatatctatttattcatttattcattatgtaaatactatgcatctactgtgggcctccctacaaattcatgcttctctgtgcgccacaacagaggagggaggtggagagttgagtacaggcatctgaaatgcttccaagagaacgtggtatgcatcacttccactcacatggccttggatggtgcatgccatatttcctgccttactttgagagtatggggaaatgcagtactcctttctgtaaccctgcaaggattgggaacttggatatccatggcaagtggtaatgtctgccacaagagtcacaagatctgatgcacagtataacagtgttgcattggatgctgtgttgrtaccagactgctgggaggcaaaagtagcaacagagagaccatttcagaagcagagtgtatttgccattgccacagataggggactgtgagaaaaagaatgggaagaagatcaagagtttggttttagacatgttaagattcaacatagttagtggagatactgaataggtagttgaatatatgtctgtattacagagggtgggtttttctgggctggggatatcaatttaggagttatcagctgatagaaagtatttaaagccgtaagactgagatcccaagagagtaagcaaaaatagagaagaaaggtccaagactgaggggcctcaacatgatgaggtcagagagatgaagaaccagcaaagacaatggagaggaccagtcgtgaggcaagaggacactcaagaaagtgtgatatcctggaagccagacaaagaacatgtttcaaggcagtgggggttattgtttatgcagtatttgctctactgagaaacttttatatactttatgtcagctcatcaataccacaattctgtaagttagatattggactcattttatggattggaaaacaaaagctcagggaggagaaattttcacaaattaatgtttctcatgtgcacctaattcatctgatccaattctgaacattttgcagcaagagctggactgtgaaaagcattttacaaatactattcctcagacctggaacttagacaaaattaaaggaaatgaagattagttgcagggaaagaaacctgttaggacacatgaatttttcttttgcaatccaagattgtttttccaaggagaattttctactttttcaggtaatcatagtttctttcttccttttccctttcytttttccttttctttcytttcctttcctttttcctttcctttcctttttcctttcctttcctttcctttcctttcctttcctttcctttttctttttctttttctttcccctttcccctttcctttctttctttttttttggagatagggtctcattctatcacccaggctgggtgcagtggcacaagcacagctcactgtagcctcgacttcccagtctccagcagtcctcctgcctcagcctcccaagtagctgagaccacaggtgcatgccacaatacccagctaattgttttttgttgttgttgttgttgttgttttgagacagagtctcactctgttgctcaggctggagtgcagtgacgcggtctcggctcactgcaagctccgcctcccaggttcacaccattctcctgcctccgcctcccgagtagctgggattacaggcacccgctactacacctggctaacttttttgtatttttagtagagatggggtttcaccgtgttagtcaggatggtctcgatctcctgacctcgtgatcggcccgccttggcctcccaaagtgctgggattataggcgtgagccaccgctcccggccctacacccagctaattgttaattttttgtagagacggggtctcgccatgttgcccaggctggtcttgaactcctgggctcaagcgacctgcctacgttagcctcccaaagttctaggattacaggcgtgagccaccatacccagtcaatcatagtttcttaattgcttgaaaatgtgatgtaatttgacccctcagcctatgaggaattagtggattaactggactataaatgagctaaattctatgaaagaaaaagggaaaggcgaggtgcggtggctcacacctgtaatcccagcacttttggaggccgaggtgggcggatcacaaggtcaggagtttgagaccagcctcaccaacttggtgaaaccctgtctctactaaaaatacaaaaaattagccgggcatggtggcatgcatctttaatcccagctactcaagaggctgaggcaggagaatcacttgatcctgggaggcggagggtgcagtgagccgagattgtgccattgcactccagcctgggagacagagtgagactctgtctcaaaaaaaaagaaaaaaagataaaagggaaaatcttccttagtagagtgagttagaatatttagtgtactcctaacctaacctttgggacatgtgcaataaataattgatacagtttatgcttccattttgagaattcgtagtgatyggtgttcaaagtaacttttcattgtggcaaataatagttcagactcctttcttcttcttttttgtttttagatcatgtacaaaatgaagaaaactatgcacaagttcttgataagtttgggagtaattttttaagtcgagacaaccccgaccttggcacygcgtttgtcaagttttctactcttacaaaggaactgtccacactgctgaaaaatctggtaagacatttcatatgtgagtaaaaagaattacagcctttccaaaataytaygtcatatagagaacatttcaataatccttccccctcaatccttggtcctaggggtgagaaagaaaaaacaaaaagctttttagtcmtaggtaacttycacacctcaactaaaaagctttttagtcgcctaggatttgcttaaagaaaatcccattgtgaaattcctggaatttgtacctttggcccagctgatagagtagatttatcgaagctgagagagaaactgcttaacctgaattctcttccacatctctaccattgatttttttttaaagataacctttagcaacttttgctttttaattggctaaaagaatgatgatttctgtgtcgaacatacattggaaatacacattgaaagtattatatctcacttgtgtgaaggtgatcatgcattttggtttctgatatataaataatgaacctccctcaactccccacatccttttaacccccaaccaagaaaagggttttgagatttaaggaatctctggtttccaaagtaaatgacaggaagaatccctaacgatctgagacactagaggtgctggccccgggaggcagacccagggatgggggtggtggaggaaactgtttgccaggcagtcgtgtgtgggcatccccatgttgtgctgcaaccccctccccagccctcayaccatgtgcacacttagaaaggttctgggtaacaccacctggacggatcatttggattttgttggttttgggggatgaaattatttctctaagagccacccagtgaaataatttaatcctcctaagtccccagagaaaggagtacaatgaggttgaaaggtgccaaaggaaaactatttatatcatgcttttccaagttagccctgccctggagaagaggagctgttccctcttctctcccagtctcttggtattgtgcttttacctcctttaaggatccagaactcattctcaagatgtccttaacctaggtcagttattcatgtatcacataggcttctgtggccttaggtgataatttgtcataatccattagatrcaaaaggttagtttacagatgaagataacctatttgaaaaatgaaaactacctttctacactccattaacctatttggccagttacaatattctttttctctgtcacaataaataaacgtgtgtatgtgtctgtcttcctgacagtttttctaattggcgatgtatgccattgaattaatcttacacagcgaataagcaaatctgaaagaaaataaatatcgaacatagaattatttattattttcaaaaacttcggaaaggataattttgaactttggctctaatgtttctgtgcttttggatttaacaaatccatgtttttgtaaatcttagattatataaacctcatttattcagaagagcaccctcggttttccttcactctgagcattgcctgcactttcactggaggycttgctcaaagtgtggtgtggtagaaagagaggaagcaaaacaagactgacagttcactttggtaatagctggtaaaggacttgcttgggcaggaagatctgttttctctgagatgggtgttttcgcattgatgtcttgctttagtttccaaggaccaaatgtattggcttaagtcaagagtcatcacctccaaggttcctggaccaatctcatctctacggtttgctacgctgcaggttcctttcaactgtgtgtatatgtgccatacacacagctcagtggccattcaggccaacattcatcatctgcgtttgctcacctaatacatttgtttgtctccatacaaaaccatctgagatttattgaatgtttttgatgaacctggcagtttggtgggtgtgttatgtagattatttcattgaagacattacaacaatcctgtggttactgtacctttaatccagatgaggaaactgaggcaaattgagatatataacttgttcatttaccctattagtatgtgttacagacttgaacccaaacattctgtctctgaacccgttgcctttgctcttctacaatatcctgcctctgtcacctcatgctctggttgtgctgtttccctcagcagaagtactgatcaagctactcccatatacatacctcaagctacagccctttttccacacccactcccctttaaggagtagaagtctaagaaaaatctaaaggaaattgctggaaaacctaattcatttagtaaaggaaaacaaattttgcctttgaaagtggtggtggcattcctggtgagggagccaagtagaagaatcagtttctactgtagtttggttactaagaaaacattattctgattgaataaaaggcagtcccaggagtttacacaacttgacaacagccagcaactttctgcttccctttttatgcttttcctggaaagggaagagcaaactagacagattgatagggccacaccttggattagagggctcccagaaagccaactcaccccgagggggtcagggttctggatcttcgtgcagcacctgcagcccccagctgagcagcactcaacaccctcctggggctcaggagtacccccgtgggaacccatacttctcagaagattcccaaaaatcctgttctcttaggctagtgaaggccagaaacgttaagcaaactgatacagtagaaattaaagagaaggtgctttggtactttatagactttgtaaattgtattcccagttcaaccagcaagtaccaaaagtctattatgttcgaaggtctatgctaaatactaaaaaatgtcattttctaattaagtattgcctttgaagagtattttaatagtttatactaaatcattacttatttttatggagaaaaaggaaaggatagatttgcgggccaggtctcatactagctttcagcttttgactaactctggatgagaaaaacatttgttatttgttcgatgtaagaaatcactattgcaggtgtattgtgtttatcagtttctggggcagtggtcttaaaaaatatcagtgcactaaatgatggtaactatctcaaccatcattgagatgcttcgggtttttttcctttttctgaactgtctgtgattatagaaagtacgatcaagtgagatgttatgtgaaaactcccaagggctacctacaaagatgttggcattaacagtgcatagggctgaggctgtttttaattaaccatacgtctgaggactgcgaaaaggattgcacttacagctgattactctgtgagcccataccgcagttgatgcaccaagtcagttttaaagtaacttgcttttcttactcccccctcctccacattatagaaaattgttcctataaaaagtttttctaccttgtaacataggattcgagaggctatgaagcataggtggttggaggatcatgggttttggtcccaatcacacctggaatcctagtttccgcctcaccagctttatagcctttggcaattcacttaacttttctaatgctagtttccttgtctctaaaaataaataagagtgactgtttcttggtagtggcagggtttcattgaggtcagagaagcaagtcactaagcataatacctgacaaaaaatttgtttcacaaatacaaaccttaattgttatttacatcttctcattttatttttaaggtaactcagtgtaaagacagctatcagtcatatcccattttagagatagatgcaccaaatcttcaaaaaatatatacctgcaaaatggtgcaattagggattgagctcaagccctgtggctacagattatgccttgtttcagtgatgctgccccacgaattacattgccttgatggattatgtggatggtaaaggcccacctgacacaatgaccagggcctgtcctggtgataattaaactaatgtgtgtgtttagcgtgcaaggtactttcttggttgtttttgtcctttgatttctctcattggtgagttatagcatattggaaagagtgagagtgttagatggtagttctcaaactttttggttttaggacctcagtcttaaaaatgactaaggacactatgtggtttctgtttatgtggactacttctattcatatttactgtcttagaaattaaaactgagacgttttccatgtgtattatgtattttaaaataaacccactttaaaaatctatttttatggaaaaataactattttctcaaaccaaaaaacattagaagggtggcattgtttaacatttttgtaaatccctttaaagccaacttaatagacggtagctatattttcatgtctacttctgtattcattttgttgcaatttattgttttagttgaggtagatgggaaataaggcctcatacagatctgtattgggaaaagagaagagtattttaagagccatttcaggtaatctttgatactacataaaaacttcataagtagtccttccttaaatgttattaacggtgtgaatctgaaaccatgcaaatgaacattatttggaaactgtcagctcgtggcaaattcaagttttccaaaattttagcttccactgaaagctctgtttttatcattagcaataaatgctatcagttgtttacctcgaggtgataagctcacttcattcattttcaagaaaatgtttggcaaatactggagtccgaataaccatagtttgctagtctttctttcaaaaaaaaaggtgttccactaaaaaaacaatgccagttagttcaacttgcaactcaaaaaattacataagtacttttcctcaaaacaaccatcatattttggtatgcctaaaaagggctttatgcatacttcctatttcatcaaacagaacattgaaaagatgcatttgagggtcaagatgtgataaaaatccatttttactttttcattatgggtattcttaaatgaaaatagcctttcttttttttttttttactgtaagagcaagaccatgaagaatacagtaactttagtttgtagcagtgccttgatttatgcttaagacaacagctgttttactcactgttgcttttacactgtcagtgcaaatgtcaacacagtgaaagattcagataacctcttagtattattgtgaaaatagtttggaccttgggaacctctaggggcctaggcgccatactttgagaaccactggtgtcagaaattgaaggctttgttatgattccaaccctaccgttaagtaggttaatgttgcctaacttacagacgtaaatttcctcactagtagaatggggaaagtactttttctgcatactttattggttgtgtagggatcaaatcataccattcatgtgaaaaatattgtaacctgcaaagtcctttgtacacactggattattatagtattaataggctacattaatattagtattactatggtattaatagccactataggggactttgtattataaaaagaacacatgcytacaggggaattgcaatttctctttcatattccccctaatcaaagataactataattgacacttggagtttatctttctagtccttttgtctgtacctctttttttttagggggatggcaaatagatgaaatgacatgttctaagcaattttgaatttgctagatttcatgtagtactggaactagagcagacacactttcccaagttgagtcaagtcatagattcagaagttcaaaagaatatgacttatccgagagccccatgtaatgaattcctcatcattggcagatcagccttcatcctcattgcagcctcatccccttctagttgtgagagccaatgcggtgacatctgcggaatggcaatccaactactggggcaggaagatgatcgaagatgacccaagtacgtgcaagatcttttgtcttttacatccacgttctttatacccctgtaagcttttattgccttaaagtgaaaaaaaaaaagttccctaaaagagtgactttaaataagataaccttgccatctgtgtatttttatgactaaagtcaaagtcatccaaaattacaaagatggagagcagatcagtagttaccagcggttaggaaagggagcagcagtgtaacctgagggagttgctttgtattgatggaacagtttgataacttggtggtggtgattgttgtagttatctatacatgtgacagaatgccatagaactatacacaaagacataccaaaacaatgaatgcatgcaaaaatggggggaattctagtaaagtctgtggcctagttgtcttgcaccagtgtctgttttttcgttttgataatgtactgtttaacatatataagatgttactattgggggaagctggttgatgggtacaagggacctctctactagttttacaattttttggtgagtctataattttttcaaaataagtttaaataaaagtataacctatcaaattattatcaaggagagaaaagtaggggaaagtgtttagtatacattgttacataaaaatttcagcataaaacaaatgtgcagaacacaaatcaaactcacttcctgatactctttgagccaactgatctgcagtcctcagtcctgcttccttcgcactttaataggttttctaatttcttcctctaattgaagtcctatatgtggttgctattccataaaagtaggaatgattagctatttcctcccagaagtgagtctagttgtcatgattgaatatatctagggaatgctgcctcttagtggtgagaagccagagaaatgtggacaagatctattctattgctgttgtttttactatatttgtggcatacttacaagtgcatgggttttgatttttaatgaggcctgtattaaaatactcagcatcttacttgtgtgggcttgttgagttctttgagtcttggtttcttcatttttgtaaaaagggtttagtaatccctccttgtgttcatttatgattcattctgttacttattagggttctacataagcactgtgggtaggctgtagggatgcagcagtaagaagaacacagacaagggccgtatcctcttggagttgccattctggtggcatttttagaaataatttatgtgaaatacctatgaaagcattcagttcgtagcatgtacttaacagataatgacatttttaaaaacattttttaaatatttatttagttgccttgcaatctctctaaacttatccttcctctcattaaagatgccttcctaatcaaagccaactccagacataacaaacgatttgttgttcatggaatatataccatttcacgcttccatgcctttatagattccattccttccactttgagtgccccttagtagttagtgtattaataataaagactttctttgcaatgcagctttcttgtttaaaaaaagaaaaaggaagcagaatgctcttgagttttagctgtttctaagtggttttgttatatgtttgattaaatgtatagtactgaaaaattacgttcaaccttttttttttaaccatgaaaaggaaaccaataaaatcattacttgctaagcaatgctgggtctgctctactcctggcatcaggcatcattcctgtgatcctagcaaagaagttaaggagtcagcagagatttgcatccatttaataccaaaaccgcaaaatgggtcaggaaaggaataactggtggattgaaatagattctcaatggacagaggaaaaccatttaaatgccataccctttgaaagtcccaaggcagcaatggttttagaaaatgtatataaattattttttaaatagtgggagtcacccggaagtattctaggtcagccaggactcaccatgcatctggtttcttctctccggaggcctttggacaattctatagcttgcataagagcttgagtctcattaaacagttggagggcagttattgcttcagagctgttgaagcaaagcaaagatttctccatctgcatagcatttcctgtttgcaatctctgactgtagggtattgtggtttgtgttaaagwtgtttttttttttatttttcttcttttctttcccctcaaataagaatatctgataatgtacaggttggatctagatttgtagccagcagattatttctcaagttcttctttgaaatgttaaaaagtatggagagcatggatgtgcctaatggtaaaattggtagcttctgggtgccctgaactatataatgcatttttaaaaccttatcttttaaaaaaatggtcatcaatcattggcagttttcagcgtttgatctaccaggtatccccttatttcctgacatgcctcactgcctcactaccaattaatactgtgggacattttgtgaaatgtgatctatccatgtgggttggtgggtgggtaagagggaaaggtttatttttaactccttctatttaaaaaatcatacatatttattataaaaatttgagatatatggaaaattttaaaataaaaattataattctagcttctgttaatatttaagagtagtatttgaaacaattttatggatttgtacacagagatactgctgatttgcatagatatctgcaggtataggtatatatctcattcaggtccaaaatccttggggttagatttgtttcaaaattcagagttttaccgatttcagaagggtgacagggtgtacatgccttatattatgcagcacaccccctagtgacttcttgggaagatgcttataattaaacacagttttgtgtctgcagtgaaacttgaatattcacatgaagtctgatatataaagactattaggtgccccacctcaagtctagtcaagagattaccaaccaaatggagtcagaacaggttttgctattaagtgagtttaagctaaaaaaaaaaaaaaaaaaagccgtgtattttatatatatatatgcaaatttgctctaacaggctgcatactgtttcattgtatatctgtaccataactgattatttgaattttctgtttgtcaatacaggtataccttgtcttaaatacatccaataaacaggtatcctagtgtatatatacctcaggctgaatttgaatatggtttttgttttttttttttttttttcttataaggattcacattcagtgtttcaaggtaggatttcaaataatacattttaaataggattgcattttcagcttgtggcttttgcatgttgttcatagcacttgtctaaagggtgtatgcacgcgatatgtgtacgtgattgtctagtattatttcacttacatttggtatagagttttggttctatgtgagaggaaggaagaaggaaaagggagagtggagaagggagaagaaaaaccatcgcttattggagcaaagtttcattgaccataagaaaagattgaactttaagaatgattggtactggaatgctttatgctgtctctaacattttgctaatcaatatctctttgataaaagagctggtctcaccctcacagccttaaggcaggtgaagttttcattatttttatttttatggttaacttttrctatacaagtaattctgataacaggagcttgtctttatactgtggtgactgtatgccaggcactggcactttgagtactttacatgttttattggttaagataggctaggatatactgcagtaatacatgaacccccaaatctccatggcttaacatggtttattttcttctcgtgtgacatgtctactgaagggatctgttctgcttagcaacagcaactcagagacttagacgcatggaagctcccccttctctacaggggaagagagagactagagaagcgtatgcatacttttcacagctttcctaggtgttgtagttcattggtttgaactgtgatcttggccccacctacctagctgcaggagacctggaaatgggagggagcaggagctgcaggagacctggaaaggggagtatttggtgagcattatcctctgcctcatctgtatgtagcctcatttactcctcacagcagccctaccaggtagtaaccatagttacccttatttaagagctcacaaactgagtcacagagcattaagtagatctcagattcagcattcaaacccaggtggtctgctctagggcatcggtccccaacctttttggcaccagggaccggttttgtggatgacagtttttccacatacaagagggtagccgggaggatggtttcgggatgatttgagcacattacatttatcattagattctcataagtagcgtgcaacctagatcccttgcatatgcagttcacagtagggttccgtctcctatgagagtctgatgctgcccttgatctaacaggaggcggaactcagcttcgctcaatagcccgcaactcactcctgctgtgtggcctggttcctaacaagccacagacctgtaccggttcgtggcctggggactggggacccgtgctctagagtatgctgtacctcctcgcaaaagatatggacatcctgttttggacataatgtaaaatttacttttaaattaatttaagttaaaagttgtattgatttaaaaaacagcaattaaaacatagacaatgatgttacaaagataaggcaaacactgattggagagaattaacagccttctgtctgcatgatctttgtcccagaagcctccagagctctttctttaggcccagatctggaagtacattgcaaacagcaaatgcaagtctttttctcttttcctttcttaacagaaaattctgtcaaactctgccccacattcacttcttccacttctttccactccacattcccttccactattccttgatttcccattttccatcccaggcataaccttttatctggatctcccactcttcctagccgattcagattaaatgttctgtcttgagctgactttggattcctctgcacaatgttgcctgagtctctcctcacctccacataccatggccctcagacaaggccaccactccagatctggactgttgggaggtcctacagcccagcctggtgcttttttcagggctgatgttagccagcaccgggaaacaygggttagtgaggggagcatggctggacttcaggcttcccttgtacaagccaggtgggtgctttgagccatgtacaccctgcacagccgtacacagtggccatactgtgtccagtgcatctggcatcttcttgcctgggagcaagagtataaagaaacttgtccaatgcagtgctttctaatttatttgagcatggactttgttgttgtataagaaacattgacttttcatggaaccacttcagaaaatgctgatttagatgttttgctggaccaggtgatccatttcatttgttgttgtgtgtgttttttttttaattcaaattcacttctgccctccaacaatttatttctaatttatatttcagtatgtaatttctcattgtttttaagctggttgccacttccccttttcttttcattttagattatactgtatggtaaccccttagggttaaacatgaagaaatggcccgctgatgcagtcttgaactagtatctgactacatctttcagtaaaaatgagtggatcttttcattgacatattgccacagataygttaagcaactgaaaattcagaaaattggcagaaatagcttgactttgaagttggatataattgagttctatctctgctccaccacctcccaagctaggtcacctgaggcagattcattcattcactcattcattcctctagaaagcaagagtatctaagaaggctttacagaggaggtaccctttatctgagccgtaaattatcaagagatattcatgaaacgctgttctcttaagctagcagagactgttttcataagtagaaacattaaataatattaagcaatggttgatatacttgataaagggtgaggtgaaagtctatactttagtagtaagaaagaaacttcctatgaagtgtgttcttatctctgccagcagttaccaagtgcccactctgttccagaatctgtgctaagactgtcattttctatgtgagagattgcttatacataatattttaatagtttaccctaaagcactacttaattttacaaggaaagatggacaaaggtataggaccagacttttaaaacattgtgcttttggtttcccacaagtggggtttcctggcagcagctggcatcacaaatgtaatatctaagaagattccttttctgcaagggaagctttgaaatatatcaaacaactgcctatcacagttaccatttaggtggattctttgacttctgaaaaatttaatgaggattaagtgaaataagtcttaaaacatgaagatgtagaccaagcagacagggcagggctttccaagcaaagggagcagagatggctttgacctcctgtcagttaaatgaagacaataatgtctactatgagacattactrtgtcaccctagtacgtggtaagccctgtgtgcttgcatatgtttgttgaattttttaaattgtgttaagaaggtgtgtcctgagtaaaagatattgcaaaacatttatcataatctgtgataaagatgttgagtgaaagcaaggaaaatgtgatccgatgttacagtgtggttttattctagggaaaaagaacaaattgtagatgccatgcgtggaaatgaaattaaaggtctgaaagttgatcatgaactaactgattatcattttaagtacaacaaagaaatccttaggatagggatatctttctcaaaccaaggcctagccatatagcacaccccctccttttactttctcctttgtcttggtcttataaatcctagctacttcccctttccatataattatcgtcaaatgaaatcagrtgctgcagataatgcacagggaaatggtactttcattttcacttgatgtaggagatgatgttaaatctaacccaccatttactaaattgaattagataaaatataattgcattattttaagttaaggaattctcatattccctggtactcttagacctacccatttttctttctagcatttccagtaaaatgtactttatgagtaaattcagtcttgtcagtcccgagtgcctttagcacatggtgtaatttgtyttgcatttttccttgggcctttcccagatcttccagagcagtacctctgttcttcattgtaattatgccttagaccataggcaagtgatttctgctctctggctgtaagtctttccttctctaaaggaactttggtttttcttccacttggacagcctttagtctaaggcagtggttctcacacttgatcttgcatccatttcaccttgagagcttgttaaaacttaggttgctgggacccactcttggagtttctgattaattaggtctgggatttcataaccaacaagyttccaggtgatattgacactactgatttgaggaccacacttttgagaaccactaggaaggattgtcactctggacagagatccagaatttcctagtgttacggagaagctgcaactgtttttctctccagattcacttttatattaattgtttttacttttatacatgacatctgatttacatctttatcactgaataaagaacaagttgaatgagaaataggctgctggttaattatatcaccctcttgtgattttgcatcatgtttctttttaataactttgtacgtacaaaaataataccacttcattgttgaaaactcagaaaatgtagggagaaaaagactaaaataaaaatcaacagtaatcttatctgttatggagtgtgtgtatgtgtgtttgtgtgtacaccctctgtctttctaaactttttgctgtttaaacatcttttttctcgtatttttaaagtcatataatttttttaacattgggttcatactgcagtgctattttatactgtggttttccaccgataacattttgaaaatgttttcctgttttgtaaaatactgcagcctaagaacctttgcttagttggaagccatacaacctcttaaatcaaggcttgtttgtgcagggtttggagaaaggatcctctcccccattacccctggcagtctccgaagaggggtctgcagaacccagaggcacattctaaaaactgtatagaatgcccatcttatatttgcactataatttatttacccaacttcctgttttgaatatttctattgtttccatttaccactgtccaaaatgtaatagtttgaaatctctacacatctcatgattatatattatttagttactggttgtcattactccattaattcagtttgtaatgcttttgcttctcctccttccctgtcatttaagagtcaagaagtgggggaaaactgccagtagcccaaggccctggtaggtcatagttggtgccttgctctgatcaaattaagatgctcactttgttgaaatatttcagactttttcaaaaagttatgtttatactgtgccagaagtttcatagtgaacattgtggatggactatactaaaaaattgagaattgttataagaattatgaatggacttttctaactctccggctttaccacagaactgtttgtttgtttgtttttgttactttgttgagttggggaccagggctgccctgtctctgaggcagtttgagcatctccctatagttctcacccatttgaggtggaattttttctgctttattcagttgtatctcagtagctcattttaagctgtaagagtgttacaactggaaggtaccttagaggtctttttagagacctcacactttattgatgccagaaacaaaaagtgacctgcctaaacatccacagctggttggagacaggttcaagtctagaacaggtctcctgaccttcattctttcttctcttcttgccagacaaagcctaacagctgcaggatgggaggggtacccttggtttgtcactcccaaccatatcctgggagcagttctaactcttctgtccctctcctgaatctwgccccttcccccattctggtgctgagcactccaggacgaccaaaactggttcaggttctataacacttgatgtttcagagcagtccttctgatttggagaggaattcattcatccatttacttaatcagtaagcatttttatttggtgtatagaacaagtcaacactttgctctaggagtttgatgtagctcaatggtgggcaaagcagtcatagcctctgcctccaagaagctttgctctagacagtaaaggaacacacggataattgtaaagtgcagtactctgtgaaagtgagcctattctgccactggtccagagtaacaggaggttagggagaagggacttatttattatttagaatggtcaaggcctcactgagaaagtgacatggagacagaggaagagtgttccagacagagtaaagcacgtgcaaagtgggagagatctctgtgggttgagaagccaaaaggagttgtagygcagtgagaatgggtagagggactcaaaacaggttggcagggccagagctaaattgggagcttggatatgagtgtagttcagtgggaagccaatgatgggttttaagcaggagagtgatataatctggtaatcactttaaaagatcgctgtaacagcagagcacagasgaaatgagagtggcctttggagtcagtaaaaaccttaattaataacctgatcatctgctttactcactgtttgaccttgggcgagttacttaacctctctaagcctgtttcctcgttaacctagtgagactaagacccatcttacagaggtgttgtgagcaatatctttagataatataygttagatacagtaccctctgtcatttaaataaaattcatgctgttctgcctagattagaacacagtataatgggctgcattatcttacagtttatggagactgccttgcagacgaggcagggaggcaggaactgtgagatggagagaatgtggtgcaataaaaaggaaattttggagctccccatcccagccttaaaagtacctgaaatgccagctcattatcattttttcaccactactgctgagcttttcaagtgtaaagaatcttatgattcaacatgacgaaaccctgtctctactaaaaatacaaaaatcagctgggtgtggtggcaggtgcctgtagtcccagctactcaggaggctgaaacaggagaatcgcttgaacccaggaggcagaggttgcagtgagcaaggctgcactccagcctggatgacagagtaagactctgtctcaaaaaaaaaaaaaaaaatcttatgaaaataaacctagttaaatttgattaaggggtattatgtagttgttgtgccaaacccctagcctcagtagggaaggcaccaggttcaagaggccgaagaaaagacccagagccagcaaatgagacatggggtgtattaggggcttacatacaggggagagagtccagtggcagcaggctgaacaagaaaacttcacccactagtgaacagcacgtagcttatataggattttcacttaacactccccttaatgacttccatctggcaaccttcatggaacccaaaactcagggcctcaatcttctgtatggcctgtgttccacagttcgggccggggacttggacgtttctcatagacaaggaactaatttctgtgattactactcctgggattccctaactcagaacacacattcaggtgcatctgccacagggtcattctaagggtgtgcttaagttactgctatcagggcacttgccctacagtagtgtcaggcattttgcctgtatttgcatccactgtgtctcagctaactgcgtgtgtttggccaagttatttagtaataccttgtagggttaccaggagcagctaatgagactgtgtgtaaaacgagccacctctgtggcctggaataaagtggagcttcattggtgtcagttcttttcttttctyttttcttttgagacagtctgttctgtctcaaaaggtctcattctgttgcccaggctggagcgcaatggcatgatctcagctcactgcagcctcaacctcctgggctcaggcaatcctcccacctcagccttctgagcagctgaggtttaggcatgcactaccaagcccagctaatgtttgtatttttttgtagagatgagggtttcaccatgtcgcctaggcgggtctcgaactcctgaactcaagcaaaccacctgcctcagcctcccaaagtgctggaattacagatgtgccactgcacctggcccgttggtgtcagttctgtctcgatccactgacactggcatgggctagttcaggaaggtgctgggacaccagcaaggttaaacggttttcccagttcacgcaggccgggagtgatgagtggccacatgcctctgggattctttgctctgtatcacagtaccttggaaagcagcctaatgacgaggcatcagttttatttttatttagttttattttttgacctgccacttcaggaggcaccagttttaaatagcttcaaggtattataactctgtagggcatgaaggagttaatatactagacagaatacccagtttataccagggaatcgcagacttaactactgggagctggctcattattttaattggattttccaatgcgttgagcaagtcagcagatttgcattagccttactttcagagaaactgtttcagttatggagagagagagaaccaatgggcagtggagagggaatgtcaagattaatgcaagatgacaaagcaagcaaattatgtcctcattaattaatacagtcttgtgtgcatgtaggtgtcctggaagtaccatttgtagagctgtgctctgctcttctgtcagaggcaagaaaaaacgaggccctgctgactgactgtctttctgccagttggctgctccagcaggacagggtggcttgttggggtgagccctcccttaagggcactccacctgcaggcccatagaggggcttggagctgagttgggcagtattcaggcaagccagaaatgatagtacagtgtgacctacaacttttttttttttttttgagatggagtttcactcttgtcacccaggctggagcacagtggcgtgatctcagctcactgcatcctccacctcccaggttcaagcgattctcctgcttcagcctcctgagtagctgggattacaggtgcctgccaacacacctggctaatttttgtatttttagtagagatggggtttcaccacattggctaggctggtctcgaactcctgacctcaggtgatccgcctgcctcggccttccagcgtgctcggattacaggcgtgagccactgtgcccgacctacaactgcttcttgattccttctttgggatctgatcagttagtaaacaaaatagatacagggcctccccttaagaagcaaaccttctagtgaagaaagatgataaatcagtaaacaataagtgagatcatttcttttagtggtaaagcataaagacattttaaaaatcagagcagaagatgtatgtttatatatacagagggaaaactgtttatgaagtcatctccagtgactaggataacgggctatttgtatactgctggcagtgttgaagcaattgtaaggaataaacggctatttttgtccagtttaatattaattacagtyacttgcttccttaagccccttttgcataatgaaagatagacctcggcctccctctgtttgatttactccaaatttctggttaggcttgatgtatgtactagcagggggaatacctcttctttgaggaaagaaatttagaagcaatttgtgcagaaagcaaaaatatttaccatacctaaatatcattctggaattttttttttaagagacagggtcacactctatcactcaggcagtggcaggatcatagctcactgtaatcttgcagtccttgcctcagcctcctgagtagctgaaactacaggcrtgcgccatcatgcccagctcatctttttttttttttttttttttttcctaaagagatggtggagtcttgctatacttcccaggctgttcttgaactcmtgggctcaagcagttcccacaccttggccccccccaattgcttggattacaggcatgagccaccattcctcgtcctgaaatgattttaaatgtgttgtttgcttaataaaatgaaaaaaatgcactttaaaaaacatacccttcgacttcttatagacttgaatcatgtaaagaacttatgttaattcaacttaatgaataaaggaaaggaaatgatttggaagttgagtaaatggagatagagtaatcaatagaattttagtaaaatcaatgggaaataattatataatggatttgaaaagcttttttaaaaatttattgaagataatgaaggtcatacaggaagtttactgatactgttattgtattatgtcggctgtattgtaagtgccttggagatgactgttacacatcagtttgcaaaactcttgctcaggtcatataaaggaggggcccccaacccctgctgactcattgtctttgttaggaaccttgctgcatagcaggaggtgagcggtgggtgagcaagcattacctcctgagctccacctcctgtcacatcagcggtgacattagattctcaaagcagcgcaaaccctgttgtgaactgtgaatgtgagggacttaggttgaacactctttatgagaatctaatgcctggtgatctgaggtggaagagtttcatcctgaaaacagctcccccaacccctgccatctgtagaaaaactgtcttccacaaaaccagcctctggtgccagaaaggttggggactgctaatataaaggattcctgaaagaactatagaagtgaaaacacaggaaatttgtagaatcccatgactgtgaagtcatatactccatcttcgtggcacaataatcacctaaaataactgagagaataggttttctgttctttgagatctccaagaaaggatttttttttttttgctccccccagtgaatatttcctaaaatttcctcctcttgagattggtttgctttctctttaacctttctttgtgcctttataatgacaaaggtaattactattcacttgtcacttaaaattttcgttgctggtttttttaattaacctacgttttcctgggaagttagttggaaagactttgtaaatttaaattttatttttcctgtagccttttcattgactagtcactgggaacattctgaattcataataacatgttttgcgttcatgatttcttatcagccctcaagaatgtgtgtagataaccacggagaaattcttaattcttggggttttctatcttcccctcatgcctaaccacaatgatgacattaaaaagttactatgtgtggcggagcatggttgctcacgcctgtaatcccagcactttgggaggcagaggcgggcagatcacatgaggccaggagttggaaaccagcctgaccaacaagggaagaccccatatctgctttttaaaaaaaaggatttactgtttgtgtttggtgtgtggtcagtacatgatttgaggcactttttgtttggaacaacctgcacattcagtactaaccacagagtttcataattctttaattgttattttataatacagcctttcagatcaaggtactaataacattaatgtattttttttaatttgctgcttcatttcacaaaggatttgaggcattgatgcaaaccgtaatttggaacaaagagttgaaaaggggttatttataatcactgtcttttcatattttgttttaaatttttgactttttaaataaacaacatattacatattacaatttttttaaaatgcaaaaatctcctctcccaccctatttctttgcccagtttccaaccctggaggaaattggtatcaacagatttctgtgtattatttcagaaataattaaagcagagagttttttgggggttttttttgtcttttgttttttggggttttttttttagatggagtcttgctctgtcacccaggctggagtgcagtggcacaatcttggctcactgcaacctccacctcccaggttcaggcgattctcctgtctcagcctcccaagtagctgggattatagatgtgtgccaccatgcctggctaatttttgtatttttagtagaggcagggtttcatcttgttggccaggctggtctcaaactcctgacctcaagtgattcgcccgcctcggcctcccaaaatgctgggattggaggtgtgagcctggccttttttcctccttgttatgcaaattcttgcataccataagtaatgttttataccttgcttttatcacataaatatttatcttggagatattttcaaagtgaagcataaagagctttctcgttttttttggctgttgtttagaaactctgtaatttatttagccagtgccctattgataggcacgtaactttccatcagttatagatagccctgtagagaagaactttgtacacaaatgattctgtatttcatttcttctgcaagtattttttgagcaccctctctgtgctaggcagtgttctgggaatatagcagtgagcatattgacccctctctcaaactggcaaccaggctggggagacagcaacaaatagggaaacaaacatatatacaaatgggtagggatggtaagtgctttgaagaaaaataaggcaaggatctccgtgaacagaggaaaagtaggcaatggcttggctagtgaaggcaggtcaggccccccaaccttacttacccaccatccatccaaacttctaaggcccataggataggaggatgctagggaattgtactccaagaatgaaattgaggactcagagcaaattatttcagctatctgtgtagaatagagggtgagtcctattaatcttcatattttcagtctcagacccagttagtgttgctcaaccttttttttcctcattatgatccaaagccttcctccttttccccaagagcctttttagacatagtcccccatcgctcccccccgtgaaattttaatacagctaatagacatagttgatatcagttatatactgtggccctttggagggccacagacagttataacagctaagattttttggttttttattttttgccccactccccaagaaccagtgtcttagagcctcacagaatgtagactctcagactatagctctctggtatgccagccagtctgttggtgtgtgattgttggcaaaatcacagacagaattgtcttggtagaaatccctttgtctttgaaataagaaagaagtgattgtttcttagatgtgtgtcaccagagaagccctctggtgacacacattgggaaaccttccgctgtgtaaaattagttgttgttcagggagagtaaagaggtagaatgactgagaatttcaagaagcctaagatgaaaacaacaggaaagggttaggaagaagttaagagcaaaaaggggaaaacctgttccccgcccctctctgctccctcattatcttatccatatttagcatgccatagcatttaaaatataaacatgtattcaacacttcctaggtatcagggagtaagctagcactttttacacatattaattcattccatcctcacaacagctgcttgcagtaggttataatattctactttacagatgtggttaagagggtcatgcacaaagccctttcaagtcagcgttggtccttctcacaccactctctccctctgccactaacacataatacataatagcataatgtagtagagttggctgtgtagtgactgcctctgttcctagaatatgagctctccacaggtaggaacagtgtttattcatctttgcctatcaagcttctagtgtagtgtgtggcacagagtagatatcttattaatgatggatggatggacaggctgacagttgaatacacttatgtgtgagtaaaatcatttcttgagtgaggggacccacaaacctttccatctataatctgctcctgcaggtctctgcagtcttgggttccacacctactaaaacttgattttaccaagattacttggggtctccttgaagacaagtaggtaaaaactcttctcagtccttgttttggttactcctttcacacctgactctgcctcccttggttccctcctgccattcttctctgcagctgggtagcatctccatctccatttccttctcctttgtagattcctctttgtgccatcttaaaatcaaggagactcaggccactgccgcagagcagtggaaaaaaaaaaaaaactatttcccggttatagattgcacttcctaaatatctcatctttttaatggaatctaggcattaaggatatagctgtgaacagaaaagtcaaagtccctgtccccatcgaggttatgtactagtgagggagacagaatacacaagctggaggcatcacattacctgacttcaaattatactactaagctgtagtaatcaaaccagcatgatgctggcataaaaacagatgcataggccaggtgcggtggctcacgtctgtaatcccagcactttgggaggccaaggagggtggatcacaaggtcaggagtttgagaccagcatgactaatatggtgaaaccccatctctactaaaaatacaagaattggccggacgtagtgatgcatgcctgtgatcccagctattcaggaggctgagacaggagaatcgcttgaacctaagaggtggagattgcagtgagcagagatcatgccactgcactccagcctgggcgacagagtgagactctgtctcaaaaaataaaaataaaaataaatgcataaatcagtggaaccaaatagagaacccagagataaattcacatgctcacagtcaacttatttttgacaaaggcaccaagaacatacattggggaaagaatatcctcttcaataaatggtgctgggaaaattggatatccatatttagaagaataaaactagaccctatctctcaccatatacaaaaatcaaatccaaatggattaaagacttaaatctaagacctgaaactgtgaacctaccagaagaaaactttgggggaaactctccagcacattgctctcagcaaagatgtcttgagaaagacctcaaaagcacagwcaaccaaagcaaaaatgagcaaacgcaagtgggatcatatgaagttaaaaagcttctgcaccacaaaggaaacaatcaacaaagtgaagagacaacccacagaataggagaaaatatttgcaaattacccatctgacaagggactaataaccagaatatataaggatctcaaataactcataggaaaaaaatcyagttttaaactgggcaaaagatctgaatatatatttctcaaaagaagacctacaaatggcccacaggtttattaaaaaatgctcaacatcactaatcatcagaggaatgcgaatcaaaacttcagtgaaatatcatctcaagccagctaaaatggcttttataaaaaaaacagtaatggatgctagcaaggatgcagagaaaggggaactctcatacgcwgttggtggtaatataaattagtacaaccactatggagaatggtatagaggctcctcagaaaactaaaaagagaactaccataagatccaggaatcccagtgctgggtatatacctaaaagaaaagaaatcagtgtatcaacaagataacccgtactctcatgttcatcggagcactattcacagtagccaagatacggaatcaacctaagtgtccatcaacagttgagtagataaagaaaatacrgtatatatacacaatggaatattattcagccataaaaaacaaagtcatgccacttgccacaaaatggatccaacattatgttaggtgaaataagccaagtacagaaagataagtattgcatgttctgtctcatgtgggagctaaaaaaggaaattgatctcatagagatagagaatagaatgatggttaccagaggctgggaaggatagtggggaggagggaataaagagggattggttattaggtacaaaaatacagttagatagaagtaacacagtctagtgttaggtagcacagcagagtgactgtagttaatgatttttattatatatttcaaaataactagagtggaattgaaatgttctagcacaaagaaatgataaatgcttgaggtgatggaaaccccaattccctgattcgatcattatacattgtacgcttgtatcaaatttcacatgtacttcataaatacaactattatgtatccataaaaactaaaaattaaaagataaatctgagcaaaaaaaaatccaaacacagtaatttcagataatgatacatgctataaaaaaatgtgaaaaggaaatgagaaaagccctccttactctgacagaagcagttgaagaaaattcaccgtaagagctacaattttggcagaggtgttaatggaagtgctaaaatgatttgaggaattatttgtacacatatacgtgtactgtagtatagtgtttaagaacacaagctctggagctacaccacctaaattcaattttcttttcttttcttttytttttttttttttttttgagagagtctctcactcaggctggaatgcagtgtggtgatctcggctcactgcaacctccgcctcccaggtttaaatgattctcctgcctcagcctcccaggtagctggaactacagttgtacaccaccatacctggctaatttttgtatttttagcagagacggtgtctccccatgttggccaggctggtctcgaactcctgacctccagtgatcctcctgcctcrgcctcccaaagtgctgggattacaggcgtaagccaccatgcccagcctacactgcctaaattcaaatcttagctcctcactcacatgctttatggttctgcacaaatgactccacctctgttccctcagctgcaaagtagtgataattgtgtcgcctaacctacagaggtgtcatgtaggttcaatgaaataatgcatggaaagcccttcaacagagcctggtgtgtggaaaatgctcagtcaatagtagctggttttattgttcatgtggactttattttttaaccatctcccatcttccctttgctttttcagctccagggtttgagccacaatgtgatcttcaccttggattctttgttaaaaggagacctaaagggagtcaaaggagtaagtgttcagaaatttgattttcactttaacttgaaaggattaattttttttttcctctttcaagatcatagtagtacttgtatttgaaagactcyttgaacattttcagcgttaaaaatgctcttggaaaatgatcattggaaaaaatgtgcctcttcacataatggtattgacagaggaatgagattaggcactttcaagaagattgggaaggtcctccatgggtgggagagagaagctaagcccgagtcttggctcccacagtgtgaccactggggacccagcccttctgaacctcgggctcctgcttcatcagcatgaccagggcgcttacccttctttcctctctcaggcttcttgtgtatataacacatggtttgatgttggccaggcacagtggtcatgcctataatctgagcactttgggagaccatggcggcgggtaaattgcttgagcccaggagttcaagaccagcctgggcaacataataagacccccatgtctacagaagaagtacaagaattagccaggggtggtggtgagtgcctgtagttctagctactcaggaagctgaggtgggaagatcaattgagcctgggagttcaaggctacagtgagctgtgattgtggcactgcactccattctaggcaacagagtgagaccctgtcaaaaaaaaaaaaaaatggtgtaacgtgcataaagtgaagttcccagtgtcctataaaggaaacaattcttgctaagatgtcatttcaaaactatttattaattttcagcaaaagtagttgcaattttaatctcattttctcgtttctaaggatctcaagaagccatttgacaaagcctggaaagattatgagacaaagttgtaagtggttttttgtttagagtttttgtttgttttttaatattgttgtgaattttggacaacaaaaaaaaaaacttaactggaaaaaggacagagcccttaactaataacttctcaacaaaaacctgtttagtatatcctctagcatatccttattagggctaagaggttgggtacactgacctaaagtggttgcatgtcctgtgctatttgtctgaagggagaggtacttttactatcagttgttctcgcatttatggctgctagtactatcaagttatagggctatgactctcattatagatagcatgtaattatggaccatttatgtttctgtatagtataaaaattgggaaataatagaagtaacagctaatactgtgacatcttggtgcctgccaggacgtgcactaagtgttttttgcatgtatgacctcttcacaggaaactatctgtacagctttactctctgtttatatacatcagggaaactgaaacctggagaggctaaggggctcatgaaaggctagaaagctagttatgtgtccagctagcattcactccaggtctgtcttgaccacagagcctcagcatagcatgggcactgaagtcagaccaccaacctcgtggagttcttgttagggattaggacaataagcactttgcagggtgctcggcccatctcgatactgtgtgtatcataccacattcctttattattattaccctgagacatttgtaacaccaagcagtagggtggggtgggaggagatatgtatttttaaagcttttaataaaagtcttggacaactataaacataagagaataaaacatttctgtaggcagcaatagcagcaggataaaaacaagcaaaagaaaaacaaattcaggattaaaaaaagtagtttttcccaaactacttttgtaattatgtgaaaagtgcattgttagggacttgctgtcttaggaatatatccgtacattgacagttctaaatgcagcagagaacaaaaacgttcttaaaatggtcaactgataaatgaatgctgtgggctatgagtctttctgtatgaaaagtgggtcatgagtactcaacttgtaagcgaagtactgccgctgcccagagacaacagtgcatgaacttggaatggaatagaattaagtacttagaaaatggaaggacaaagggggaagaaaaaaaccttgttctacacttgtagaatatgtcttctttgtaggatataggaacaacgaaacatgatgtaatatgtgctttgtcaactaaagtactaccaatattaggtagtacaactttatttatattttttaaatctctgttggctgaagacctagaagtatctggtgcttagtattataaatgacttagaatataaagcattctaagatggtacaggtgctcttccttgtacttctcactcaacatatgaacttgtctggcttttctttttttttctttttctttttctttttttttttttttttttgaggcggagtttcactcttgttgcccaggctagagttcagtggctcaatctcgtctcactgcagcctctgcctcctgggttcaagcgattctcctgcctcagcctcccgagtaattgggattacaggtgcctgccaccaacacccagctaattttttgtatttttagtagagacggagtttcaccattttggccaggctggtctctaactcctggcctcaggtatccacctgcctcagccaaagtgctgggattacaggcgtgagccaccatgcccggcctggctgttcatttttctgtattgtcctctacaatctaaatttggtgaagaccacaaccacattattcttatatatggtgttattctaccagtgcctaatgactcatagtttatgtactatttcattgaagaaataaaagaattattcagacctggaaatgtataacaggaatagcaagttgagtgcctcctgaatttaagaccttatgaaggcaggttttgtttgtttgcttagtaaatccctgtcaacaattttcctgagatagacttctttgtcactaaagtatagtggtgcaggaaagaaagaaaacaagcatttgtctctttgatgtactgggacttatgctgttataagttagagaaaacaaaatgactccacacaaaaaagttcatttattagttttgataatggagaaggctggacattttctgtggtcttctatttggaactctggaggcagtgaagtttgtaatgatttagatcacagacttagaaatcattaccagttttgtgacattgagccaaaatacttaattttgatgatccttacttgtaaaataatataaaaattacctacttctcagggtttttgtgaggacgagataaggtagtgtgttgaagcagttgtcacagtgtttagcatagggaagtcacacaataaatagtttctactaagttctctttaagaatcaaatttcatttggtcaaagtgataaatgtacgtaaactaaaacatcagatagtgcttttactagttaagacttactctgtcagcatgtaatggaaaccccaaataacagtggcttcaacattgttaaagtttatcatagaacagagcattctaggatggaccaggtaccctttgtagcacttctcacttatctgtattgtcctccacaatctaaactcagtgattttatgtcatacctaatggtacagggttctttacaaatcatgacagggaaaatattaagtaggcaacaaatgtgcttctaatggaaacacagtggccktctgcctgcccctcttgatcctgttagtccctcccctttttccaactcttttacctgcttcctgacttatctacacgttcctcagtattttcttgctctttctagctttagctgtgatgtattgctgtggtagacgaggattacattcccttgcatagacaccccatcactttcgcacccttgttcatccattgtggttaatagaacaatttttattaaactagtttcagtgtttacatttttataggtataagcattcattgctaatctgaatggtagaataggattgaatttctgttcttagagtacagttgtttactttttcttaatgacataatggcctcatttcttcatttgcttagttctgtgtgaatcttctgtgaattcttatctgctctagcagatgtcagacacctgtcaataatatttctgtttataaagtacattatgtattttattagcatgattatatatctattagtattaaattgtgtcagcttcttctttcctggagacatccctttgcagagctctttagatcagcagtacagctgccatcctgggatggcgtttgactctctttagttttaaatctaattcctcttgactagtatagttccatattttggtggcccattacctccagtagttttcagagaacagctctaaaggaggcaaagagtttaggttttgtgtttccaaaactatcttcattctgccaccacaaaaagtgatagttataaatcatttttataaaagtggtaaatcagtataaaatactgattttataataattttcaggcacggtggctcatgcctgtggtcccagcactttgggaaaccaaggtgggcaaatcgcttgaggtcgaaagtttgagaccagcctgaccaacgtggcaaaaccttgtctctactaaaaaatacaaaaattagctgggcgtggtggcgggttcctgtagtcccagctactcaggaggctgaggcaggagaatcgcttgaacccaggaggcagaggttgtagtgagccgagatcggaccactgcactccagcctgggcaagaaagcgagactttgtctcaaaaataataacaataataataataattttatctctaaatgttgaaggcattgttccattgttttctactttccagtattgctaataaaaaaaaaaatctgatacctttctgattcccatttatttgtatgtgatatgtggttgttgtttgttgcatttatttttggttagagaatgtaaggtcttgtctctgtaaaaggttttacgaagagtcttcaagtgccacggtatgtgcattctgtttgcaatctttctgtttacaagtttgagttcatcactcctggaaacttcttgtaattcttcctgttttttcttttattcctctttcgggaattttcattatataatatttgacttcctagacagttcttaaaattttcttctcttttctgttctatttatattatattttaggttattttttcagtgttttttccccactgtttcagttagcttttttattttggctgtcattttaaatttctaagagctcttttgctcagttgggtttttttttttttttttttgcctttttatagtttctatttcttgtttcatagatgcaatattttagctgaagatttaatgacattttgtaaaatgttttatctgcttccttagtgcctctggttccttcccaaccctcccccttttgttattaatactttcactctcactttcattttggagacttataatctttgggtgcattcatatttcagagcaaggtacccaaagactaaaagtttatatgcatcattagagatctgctttctccaagaaagcagaaagccttctttttaggtttcaagttttaggatgtgaaggcagctcttttattaggggttttccaaatgtcagtgtctgaggtttgtctcagaaccttgcagttctttcacgctcctgcttagtaatcacatatggtggcattttggaagctatgtaagtgagggagacagagaaccctatagtttgaggtgctctccttctctcttcagccttgctcttccaaatatttattgaattccgtcatccttttttgtcttcaattctttctttgggagattatctgttcttatgcctttactctcattttagtgggatcactggaggaagaagaaataaagacatgtatgtttaagtcaccatggtaaattgaaaggcttattattaagttatgcctgtccctccatatttcttctcttcccacccacatcagtggagaaagagctgagatttattctttctgttaaaatccctgttatgcctcttcgactgccaaggtggcatgattaaagagtttcttaaatataatagcattagggtattagagtcaatcccgactgggtttataagtagatttttcattggcttgatcggtggattttccactatgtctgtgtataggtaaggatgttggctttcttcagagttggtttcccctaccaccaccataacttaaagaagacttgacggataaatcagttagtctttgcattcacagctagaaattacaggttgtttctgaaattagaagtccattttcaggttaatgatttttggaaagcaggctataatctttggtattattaccagagtatcatctatcagagccgagcactagcgtcagctactgtatgtttaatgtgggcctttcttctttatcacctcgtttcccctggccccctccccacacacagaagaacattgtgataggattccaaattaggatttcttctgaattttgtacattccagtgacaagtggttgactgattaaaatgtattcttggaatgtggaaatagctcaagtttagaggaatgttggaaattacctttgactaaattttgtgcatacccacaaagacccattatatactttaattatttgaaataattgaagtcttgcaagctgtcgatattcaaggaaagcctcatgtctccaactttctgattctttttttattataaagtgctttacccaatagtaggtaaactatcaaaatttcttcatgcctaccaaaatttaagagaatgtatatgaatctgtcatgtgtaagatcaaaggaaaaatgtaagaggtttccccatatgaaaatccatacagtgtttgtgttctgtttgattgtaggcttttacttctgattgattctaccaacttaagaattcttgccttttaactttaggaattaataatcagtggcttttgttaacgggaagacatgagtgtggtttgtttttagtagacttccttcttgagcagaagatacaagagagttcccatatgctccctccccccacacatgcacagcctcccccgttatcactgacccccaccagagtggtacaattgatacaactgatgaacctacatagacacatcgtcaccccaaatccatagtttgtattaggatctgctgttggtattgtacatgagtgtatttttttttttttaaataatgacattggctttaattacagtacaaaaattgagaaagagaaaagagagcacgcaaaacaacatgggatgatccgcacagagataacaggagctgagattgcggaagaaatggagaaggaaaggcgcctctttcagctccaaatgtgtgaagtaagaatggacttttccaccatttgcctagaattataacaactgtgatcttttcctgctagtcagcagtctttatgcttaaaggcagactgtgtttgattattagagaggaaactgtttcttaaggattctaatctccatttttctccaagccttttgggaacctgccattgcactgttgtctcatattttgagccttggccctatggggctgtttaagccaaaacaggattctttggtgagaaccttaatgttgcttgtgagtggttgtgggaggaaaacattggtgagaggtaacactggtgaatattaagttttattggtgtatgtttagagcatgtttttttaaccatatgtccagtttgaatgaaaactcaaatgaagttgtcattaagaaagtcgatttcacgaaaaatgcaacaaaaagcatgctgccttaaacttagagcagtggttctcaaactgaattccaattgaacatgaacacttcttgacctagaaaccaacctgttctgacacggctgttgagtaagagtttcttttgcagttttcagaaaatattaaagtggagaactttgtcaaatttttttccttccctagatttttttctcctttccttttccttcttcctcgctttctctctctattccctccttctctttctctttcccccttccccttccccttctcctccctccctcccttccttccttccctccctctcctttctttctctctctctctttctcacctctctctctctcattctctttctctttctctttctctcttttttctgtttcataaccctttggctccttgagtttgtgtgctcatgaacctttttacagaataaaacaagtgagcaaacagtgtcaatagaaaatcttgaccagtgcacagtacaagtacactactgtgtttagttacctcaataaattagtgggttattcttacttttattctttaatttttgagtagtaaaaattctttctgattcacctctttttcctaaagtttcaatatcctatggtatattctttgatgagaatgctattctgcgtactttctgcaaaaaacaatcaatctttccagtttttgaccacataaactatacgtttgagatccactgcaccaaggggaaataataattctagaatgttttgctgtgttttatttctgcttgtcgagtaaactaatcataaaataatttataaaatgctaacactctagtcaatttgttttgaacactttgtgactgcgaaatcagcattctctaaactgtctaaaggacaccaaggcttggtaacttgtgcagattcaggggtgatgttcagccacctgaacccatggctgaagagccccatctggaattaatcaacgcaaaaccctgttttattttcacagtatctcattaaagttaatgaaatcaagaccaaaaagggtgtggatctgctgcagaatcttataaagtattaccatgcacagtgcaagtgagtagaatattgcaagcattgttattagcccaattactgccccctgtacttcattatttgtcttaatcctcttcatatcttttcttcatctcgtgactaaataaagtgatataatgacctttttcagctaaatggataagaaatagtgtcttccatcttcagtgttttatacaaatcagtagctcaaattagggcttaaaaatattgtcttccttacaagaagacaaatacttacaaatacttcttcctaaatttgatcgcctgtggagctcttattacagatgcatgatcccctgtcactgaagagtcctttctgatgaccccctaccctgactctcttacttggcattttgcctttttttttttttcctttgagacggagtctcactctgttgcctggctggagtgcagtggtgcagtctcggctcactctaatctccgcctcctgggttcaggcaattcttctgcctcagcctccccagtagttgggatgacaggcgcacgccaccacacccagttaattttttttttgtattgttagtagagactgggtctcaccgtgttggccaggatggccttgatctcctgacctcgcgatccaccttggccttggcctattattgcaccatttgcaccatgtatttccacctggagtcttcagttttgttttgtttcatctaaaataagtgaatttaaatagttggggcattaagaatactttgcatttgtacatggattcctatataatttgtgttacattttgagaaataccattgttctacactggcaccatttttgtttgcctatattgcagggctatctttttgttatgtttgtgattctgtggtgccacatttgcttgtttacttattgggttaactttcatgggttttctggtagagtctgtgtgtgaaaatgtgccagctacacatggagactctaccagaaaagtaaagtctgtattagtaaagtctgtattcgttgatggaagttataccgaaaataatggaaggaccttccagaaatggaatggacagctctcataagcaaaataatgtaaaggtcgtttggactagataaaatactctcaaaaaagttaaattcataatttcctttgatctttcttattcttttcaatagttatatttagaaagatacctgtattcaactraaacatttaaggaggtyagcattaatattatgtcaaaagcacaaagcttgggttagacaaattagatgagtcaacattttggctctgcagctrgttaactgtattcttaatcaggtacttcactaaacctcagtatactcactcgtcaagctgggttacgattctgtagcaaccaccttagggtttttgtaaggctgtaaaaagtgaaaaagaatgcatgtggagtgcttagcccagtgcctgcgaccttgtatgtgttgacagctgtgatgattctaagtggcatttaaaattatttatttatatattttattgtctaggatatttctcttaaggaaaacctttttgatgatcaaattgttgtttacataaatttgatgataactttttttcaaagtaaattgtaccttatataagtgtctttcaaaaataaaaataatatattgaagtagaaagttttcaccttcttaagattaagtttgtttattgaagacctggattaactaacttacttttggctttgtagtgtggttgggcagttatgaaactttggcctgtgttctaatggtccctgattttagtattgggtggaattttttatctttcatcaaatttagttttcctggaaacatttaattcctttgaaagttttaaagaaataagtgaatctctcagtctcctgaattctgcagtactttggcagcaaaactgatttcacctgactttagaaatctattttcacgttaaattctctaagtttataaggaagagtttggcctacacaaacaagagtttttcaaaatagaagatgctttgtaaagtatacatatattagccttcgctagtaatggtgatkctaacttgtatagctaatgcatcctccctttattctcttattctttgctttttccctttccacaaatatgtattagtcttttaccaaagatcagctactgtgcccagttctgggacagagataaagcaaggcttttccgctcaggagttaattgtccaggtataggaagtaagtcagatccrttattaatcataatggggctggacagtgacgggtaccatggagcatcaagaggaagagagacggctgggcgcggtggctcacgcctgtaatccccgcactttgggaggctgaggcaggtggattattagattacaggagttcaacaccagcctgaccaacatggcaaaaccccgtttctactaaaagtacaaaattagccaggtgtggttgcgcatacctgtaatcccagctacttgggaggctgaggcaggagaatcgcttgaatccaggaggcagaggttgcagtgagccgagatcacgccattgcactccagcctggacaacaagagcaaaactctgtctcaaaagaaaaaaaaaaaaaacaggaagagagacatctgaccaggaggactgaggagaaggtattagcaccttgaaggaggtggtgggacttgtcattgaacttggaggatagctaggattttgttaccagattgcaatctggtagacgaatgtcccctaggtcagagagagatcatcagaagaaaaccctacacagtaaaaaccttgtagggagagagatgttctgagacatcaagtagtagaaccatgttataaggggattcaactaaaagttactccatggtggaaccccaagaactctatcatagcaagaagccagagtagtttcctttattcttttctacttctgtcagttcctcaaaactcttaataggcatattgtatggacctgttaagcattctctacgtaggtgttttttgttttgttttgtttttaagatttattcttctcagtacttacttcagttcccaaagtgattttcagtacaaagtcagctggtattcaacagtgaatttgcctaggtagtaatagtcacgacacttccgtgtggatgaagctactacactggagaaataaataaagggaacagaaaagaagggcttttaactgtttccaactcatttcagctcactcactaattactgctcaatttcagacatgaacattgtcgggaacatgctgctttccaracagacatatcctccagttcacctgctccttttacctcctcacaagtgtcattatgacctgcagagttaacagcatttataaacattgctttattatctgtcattttacagataataagaataatagctaacatttaccgagagcttattttctgggacgaattatataggccctgcctctaagttccttacatgtgttttctcatttaatattcccaacactcaagaagttgtagctcagaaaggatcagtattttgctcaaagtcatgttcattcatttaataaacgcttagtaaatgtgtcaaagcagacaaagtaagcacaggaaaccaaataaaaatataaattggacttcaaaattaaaaacttttgttcatggaagtatattatcaagaaagtaaaagacaacccacagaataggagaaaatatttacaaaatatttttctgataagagtctgatatccagaatatatwaaaaaaactcaacaacagtccaggtgtrctggctcacacctataatcctagcactttaggaggccgatgcaggaggatcacttgagcccaggagttcgagaccagcctgggcaacacagggagactctgtctctacaaaaaataaaaataaaaaattaccctggtgtggtggcacacgcctattttcccagctacttgggaggccaaggtgggaggatcgcttgagcctgggagatcaaggctgcagtgagccataatgacttactccagcctaggcaacaaagcaagactctgtatattaaaaaaattgtacacacacacacacaaatggccagaaaaacacgtgaaaaggtgctcaacatcattagtcggtgttaagtacaaatcaaaacctcaatgaaatagcacttcacacccactgggattgttgtaattaaaacaaaaaaagtcttggtgaggatgtgggaagattgcaacctatgcattgccagtaggaatgtaaatggtgcaacttctttggaaaacagtttgggaatttctcacaaagttaagcatagaattatttaaataaaatgtgtacatgaatatttataacagcgttatttacaataaacaaaacacggaaacacccagatatccatcagttgataaaaggttaaacaaaatgtggtatatcaaaatggaacattgttcagccacaatgctgaatgtgaatgaaatattgatacatgttacatatgggtgaacatttaaaacattaatgctaagtgaaagaagccagacacaaaagatggcatatgttcactaactcagcagctctctaaacccctttgtttagaagattttatagaggttttattacataggcatgattgattaaatcattggctgttggttattggcccaatctccagcccctctgccctccccagaggtgggaggaggggtggggctgaaagttctgaacctagttgcatggttggttctgtaacgagactaaaaagagattccatgaattgtgtataatagtgcggtgactggtacagagtaaatactcagttacatgttagctgccattactgttactgttactggtttttgaagatcttgttatgttacagtaatttatagagaaagtggctaagagatraatgagacatcctcgaggtaattttcccttctatttggaagatttatgtgttaagtgtagtgataggtagtcagaactcacacatrtgcttcactttccagctaacaacacttttatctgtagtagctcatctgatgctccttgaaactagaaaatgtccactttggagatgagcattctgttattcagacagggtgaataactgcccaaggttaccacgtatagtaaggtttagagccaaaatataaaatatgatatggttttgactcctaagcctttttttttttttttttttttttttggagacggagtcttgccactctgtcacccaggtgggagtacagtggcgtgatttctgctcactgcaccctccacctactgggttcaaacatcaagcagtcctcctgcctcagcctcccaagtagctgggactacaggcgcatgctgccacgccaagctaattttttttttcttttttttttagtagagacaaggttttaccttgttgcccaggctggtctcgaactcctgagctcaggcaatctacccatctcggcctcccaaagtgttaggattacaggcgtgagccaccacacccggcctttttatttttttttttctttttgagtcagagtctcactctgtcacccagcctggagtgcagtggtacaatcctagctcactgcagcttcaacctcctgggttcaagcgatccacccacctcagtctcccaagtagcagggactacaggcatgtaccaccacgcccggctaatgtttgtattttttttgtagagacagggcttcaccatgttgtccaggctggtctcaaactcctgggctcaagcaatcgtcctgccttggccccccaaagtgctggtattacaggcatgagccatgtgtgcagtagcccttgcatgtccactgaactaggaygagctaaaacagagagaagagagaaaggaggaacagagaagccactgccctctgtgaaatgttttggcaggtcgtggtggctctctgtctaccctgtccacagctggaactgtgaccctcaaggagaagagaatgaagctcagagggacagtgcagatgacagcatgtcaccctttgctttttatggtgtcactgatacattgctaatgactgccatggttattttattcttctacaactcgtcctcctttcctgctcctatttcttaccaaaactagaacttggccctccctgaaattactttctgcaaggggcttgcctccaaattgttcatcccagagaaaatgttgactctttaattttgttttaactgattaatacgtgatatccttaagaaaaaaattagaaactgaagttaaggaagaatgaaaaaaccctgtaatctcctcacttagatgattactagattcatgtatctggtttgttttgtttacaaaaatgggattatgctacagattaaagcaattattacattgatttttcttagaatctgggtatgtaacagtctgaataattgaagcagaaggaaagtaaatttgtttggagtcttcagccttgtaattggcaggaattttcatttttatcagtgccatttcaaactaaaacagttccgtctttctccctaaaatttataatgtgttcttcagtatttcttttgtgctgttcaaatatttgcttattctttttctagagtgttgtccagtagaactttctgctatggtggaaatgttcatactctttaccatctacatggtacccattggccacacgtggctaccaagcacttgaaatatggcttatgagtcttcaggaacagaatttttcatttaatttttaatagccagatgtgactagtggctaccatattggaaaacacagatgtagagcattctcattgaaactcacctttaaaaaaaaaaattgggaagagatttaattagtgttctcttatttttaaaaaawgtttatttcagtagtttctggagtacaggtggtttttggttacatggataagttatttagtggtgatttctgggatcttggtgtacctgtcacccgagcaaaactcacatttttttaaagcataaagattaaattccctttatgttaaaagtgaaaatgaaataccttttcaaaaatatctacaaagaatctgtatccctctgcaaaggaaacagttccttatatgataaagttatgcagctccggggaagagaatgatttcttgagcacatgctaactgccccacactttgctgggtagtttcacatgtcctatctgtattatttgcccatttacacatgagcaaactgaggccaagagaagttaaatgacttgccagaacacagattcttggtcataatcatctgaccccaaagccattgcttcttctgttgtaagaagtcctgacaacatccatcttaaatttaaatgctctaccttcaaaacttttctccagaaatcacttaagtgcagtatcagagaccaaaacagattttgctatgattaactttgtacccatacttttaactcctgggcatatatcccttccttgatgtagaggatgctggtttcaggttaacacttatagatggcctgctctgtgcagaacattgccaacctctccaggtctggcacttaggcctgggcccacatgctcaatgaagccgctgctttgactatcaggtctagagaatactgcttatggggtagcagccgagctgagtcttgataaaagagagtttggcaggcaggttgatagggtttggctccatgtccccacccaaatctcaccttgaattgtaatttccataatccccacatgtcaagggcaggaccaggtggagttaattgagtcatgggggcagtttcccccatgctgttctcttgataatgagtgagtctcaaggaatctgatggttttttaagtgtctagcatttctcctgctggcattattctctctcctgccgccctgtgaagaggtgccttctgccatggttgtaagtttcctgaggtctccctagccatgtggaactgtgagtcaattaaacctcttttctttataaattactccgtcttgggtgttccttcatagcaacatgggaacgtactactacacaggtatagaggggaagggcattccaggcagagggaatagcatatgcaaaggctgaagtggggaaggatggattgaaaaagaacaggcaactagaaataatgtagcatggctagaccttggagtttttaagggaaaatggtaagagataaaacagaagtattcaagggtcagaacgtaaacttttaaaattctatactgagaagttttacttgcatcgctataggcagtgccgaaaacccaaatgctagaaaataagggtttaggccaggcacggtggctcacacctttaatctcagcacttcgggagaccaaggagagcagattacttgagtccaggagttggagaccagcccaagcaatgtggcaaaaccttatctttacaaaaataaaaatgagccaggcatggtggggtgcctctgtagtcccggctactcagaaggctgagatgggaggatcacttgagcccaggaagtctaggcttcattgagccactgcactccagtgtgggtgacagagtgagaccctgccgagagagagagagagagatgaggctttacatgtgttcatgtatttttcagttaaatggttaactaaaaggccatttttatctctcatccctgttgctgaaaaactttctaaaggtagtatttttcttctttatttcaataaggtttctttgccaaagatgtcagccttaaaaaatgttggaacttgtaggatttcagtaatcattctgaaggccacttctaatagcctgtgttattgccactgaacactgaatatacatattaagcttaaaatatgtctcttaagatatgccttaagctgggcgcagtggctcacacctgtaatcccagcattttgggaggccgaggtgggcagatcacttgaggtcaggagttcaagacgagcctgatcaacttggtgaaaccctgtctctactgaaaatacaaaaattagcctggtgtggtggcaggcacctgtagtcccagctacctgggaggcagaggtttcagtgagctgagatcacgccgctgcactccagcctgggcaacgaagagagactccatctcaaaaaaaaaaagatattccttaaaatgtcttgatattgcttcattcagtctgctttgtgttgggcccactgtgatagggagatgagacagtcctcatgctcaaggtcctcgttgtttgtagggagacagcaaaacagrtagtgttttgagaaatagtctgctgtagggacatggttagagaagcttccaatagggcagagaaaattctaaacacgttttctgaggcatattgtttatttttctaaactgatatcagagactgggttcctgagtggaagtgtgccacctgagacaagaaatcttcacttgctggtaaagagcgtggatcagaatctggcagacctggatctgaattccaccagctytgctgcttactagctgcaacttaaccaagttttatacatactctgtacctcagttttacaaatggagatgagattgaagtgctttaattcattagagttgtgtacatgaaatcacttgtgtaaagtgttcagtgcagtactgggcatgtgctaaatgctccacagatattaattcttgttatttttcaggtgaagtcatgcaaccatgtgttgtaggataaagctttccaaacccgttggtattattgctttgaattcttgtgtttcaaatatatgttggaacacagggatctttgaggaactgaatgaattttgacttttctcctgcctttatctgtagttccatcatatttctctttatagtgtccagatcaacctcatgatattccactggttaatgtgtccttctctctccttcaaattcaaatatggtttaactgggaagaactgttctatgtatagatgcatatgtacgttatgaaatcactgttttgggactgcaactgtaatttccagtgtccttgtgatatcttctatcaaatgtcaactgacagccataatttatttgttggtacatctttataaaaatgccgtaattagttttataactgtcttgtatagataaatccatagagaatgagtatatatatacagataagtgtattttcagattttgtaggttattatagttcctttttttatttccacataaggaaacaaatactcttttttttttaatactggtggtaaatctctgatttttttaattgtagtttctttcaagatggcttgaaaacagctgataagttgaaacagtacattgaaaaactggctgctgatttatataatgtaagttctttataaaatacatgcagtttaacttgctttcatggataagtttcagtaaatttgaaatctgtattagaaaggtgttaaaagcagaaaagattaaatgatatgtctgtacaaacctaggacagataacccttcagtttaagtcagagaagtcatcgatggtcaaatgctccagagtccttctggggccataagaggagcagggaggggagtatacagccatcagttccagatggttctgcatttacgattcagttagcatcacatttgagtgttccttggtcagcagttgcagaaagaatgcatgattgtggaaggataaaaattgactctgaataggcaggtttatagagttttttggggtttttgtttgtttgtttctgtttttgtttttgtttttcagagtctcactctgtcgcccaggctggagtacagtggcacgatcttggctcactgcaatgtccgccttctgggctcaagcaattctcgtgcctcagccttttggtacagatggggtttcactgtgttgcccagactagtcttgaactcctgagctcaagtgatccacccgccttggcctcccaaagtgctgggattacaagcgtgagccaccacgcctttgatttataagggtttttgttttgttttgttttgttttttgcatgttttatattatctctctttttttagtgtctaggtctaaatgtatatattagaaatggtaaagttgttgcccaaaaatcatttgggggtaaataaaagcgtatatattatgagtatgagtaaatatcctcaaataaagttttataattacaaagaatgccttttatataactttaaaaatgcatagctatgtattttttctgattttcttttagtagttaacatggttcaggttacagttaagtcccaagtggttaaaaaaagcagcactgatcccttgtccccatttcatgctatgtaaactttgatgtatgcattggcccattagactcctggtcattcttaggattctctcctggaccatttaatcacattatggtattttcattaccaccctttgaaaaaccagaagcaaataatctcaatgatataagctgtttagaatagtacttcagagttaactatctagcttagataggttatttaataagaatgcatgttgcattattcactaatttcaaaacccactgctgcttttataagatgagaaatatcatatcaaaaatgagacagtataaaggacttttagtaagaaaaccaaatatataatagaattttgatgagtggtatttttggataaattaaactctgcctgtgaaagtgtaaatggtaagtaatagaagtaatttttttttcatagataaaacagacccaggatgaagaaaagaaacagctaactgcactccgagacttaataaaatcctctcttcaactggatcagaaagaagtaagtggtttacatgtttacaacagggctaacagtgtaggtaaggctgcttgtaataccctttgtgtttcctgatctgcaagacaggcacagtgatatataatatgcaagtatgtacctaccataagccccatgtagaaactgtattttagttccttttccttgcttataggaaagatgttctgggtatccaattccatgactctggattttttttttttcttttttctttacttttttgagacagggtctcactctgtcacccaggctagagtgaggcggcaggcacacttatggctcatcgcagccttgacctcaaccattccacctcagcctcccagggtagctgggactacaggcacatgccaccatgcctggataatttttgtattttttgtagagatggagtttgaccatgttgccctggctggtcttgaactgctggactcaagcaattctcccacctcggcctcccaaaattctgggattacagacatgagccactgtgcccagccccatgactatagattttcaatcctagttttgargacatgcacttcaggagcatatgctgaaacatagtacattctacaactttcctctttagaccacttctgtctttctgggcagccaaaacaggcatgtctcatttgccagggaaatattttgatgcagaatcctacagaagctttgccccacaattaggaaatttgaggtgagttggtccttggatattgaaagagcatagaatgcatggtagaggctggatgaatgcagtacagatccttagttataaatgtcatttgttcaaacatttcattaacacctgctgtgtgccaggcacagttctaggtactaagctttagtccctttcatctagtagctcattatctagtcagccatatgaacaatccatcatgcctaaagtggtatggatactattagagatacrttggaagatgactgcagccagacagaaacctacaagacccagagatggaaaactccccagcatattcaaggggctgcagacattttggggcaggatgggtggaggagtcagaaatgcagtttctgaggtaaaaactcagamctgactacggaggaccttgggtgttgtactaagggacgtagacttcatgataaggataaattaaacagtaagcaccatttgttttctgggagaaattaaaaacgtgcctgtttttgttatgaaattatgggttaaatttaagagcagtggctcatgcctgtaatccaaacattttgggaggccaaggtgggaggatcacttgggcccaggagtttgagaccagcctaggcaacaaagtaagagcctgtgtctacaaaaaattttgaaaaattagccacgcatggtggcatgtgcctgtagtcccagctactagggaagctgaggagcccaggaagtggaggctgtagtaagctgtatttgtgtcactgtactccagcctgggcaatggaggaagaccctgcctcaaacaaacaaacaaacaaaaaatgaagagcaatatttaataataataacatgaaatacagcatttttatagtcagtttttaaatactatcacacaacaatagcaagttcacttattttaatttctaaaatttctgaaaggggtttatgagtctaaaacaaaacaactcccataaaacatgggaagccctgcactagtgacactaatcttttaaagcaaccctgaaggttttctttattgagtgaatataagcctctatttttctggttctccaaatccaggtatatgcactggggattggtcaagtgagagaagtctatagcactgtaacactaggcatctgctaacctgtggagtaggcagagtggccaggaacatctgtgtacactaaggcagtttctgcatccatgtcattcagtctcaggcagtgactgcacctgtggtttgaggcctctgactgtgatttacaagaatttccaagtattagacccccagtagacttcagactgaagcacagatatgccatgcatgccctttgaaggtgcttattactgacacataaatcctaggagaaatgtggtctctttgaatgatttctcagtgtaagagcattaaaaagacccaggtagaagggagtacggggtggtagatttcagtcttgggagaatattgtgaggttttttggggtttttttgtttattgttgttttacttactgtatgtacttaaccactccctacctttgttttgtcacacagtattacctctttcctacatatggaagctttcttgaaaaataaagaggaggactgttacaacccctttttgttttgcatggagacttaagtgttccgctcatgctagctaaagaacaaagttgcatataagccaaaggaatgtgtacatgatgaaatgcacatgatttgatttaaccccaccccagattaataaatgatgagttttcattagtaccttgcatcacagagttttacaagtaatacattgatctttcacaacatgcctgttcctttctcatgctgtttatcatcactcattgcagaatatgtttagaagatagtgatttttcatgactgagattaaatgtgagaggagaccatccacagagagttctgaccatggtactatttgaaaagaatgtcaagtaatcttaaagattaactgaggaatcaaaagcacccaacaaatcatttagcctactcatccccaccgggttctaacttggctccattaaaggaagttccaagaattttagttgtgaataggatccctggaatttcagtaaactcattttttttctattaagtttttattgtcttagcaaataaatgttctatgaaattatattaagcttttgtaatagcttaatctacaaaagaactatttgctatataactgtttttagagttggaagtaggtttttgttttggtttttttgagacggagtctctgtcgcccagactggagtgcagtggtacaaatctcgctcactgcagcctctgcctcccaggttcaagtgattctcgtgcctcagcctcccaagtagctgggactacaggcatgtaccaccaygcctggctaatttttatgtttttagtagagaccggggtttcaccatgttggccaggctggtctcgaactcctcaagtgacctcaagtgatctgcccgcctcagcctcccaaagtgctgggattacaggcatgagctactgcgcctggcctgaaagtattttaaatggtgataagtcatatttaggatatacagaattattccaaaaattacacctgttttgtttgaattcacttatggactcttttaaaaccccatcacattatcgtttgcaggtttgacagattctttgtttctgttttactcatgtcacagtatctgtcctgtagcctggtcccagaaaactattcaaatatttagaaaaatgaaacagaaggaatcttttgcccactccattgataccttgcattagaaattttaggcttctgtagtagaggtttagttttaaattggataccagaaacatttatagccccattaaatcaatgaatgtataattgcttgcacttttaaaagatttgagactctacctcttaataatacattttatacattaataagattttcaaataagaaagtgatttgtctatactaatagagaataggaaattaaaaagattttaagttcattgtttatgttttatgtttttgcccaaatgagtttttctgtttcctgaatacataatttccgttaacactatcaaaggattcagaacctatttcattccttcagtgtgtcagtttttaaattgttgttaatgttattaaatgtccagtatctactttctcaggaaagaaaatcctctttgcatttgtctagagtgccctgcttagcaagctgaatggccatcatttctcaaagagcacaagtaataatcggtgtgactttattaagccatgaaactcattcatagttaatttaggattgttgatactaaacttctgaaacatactgcttcctttctgctcagtttaatgaggtcaaaccctggagtttagccactttattcatctttaaaagcatattagtttgatgtaaagcaagcacattcactccgaggagtttgttattcagaatttaaggtttacttaagctagtaataaatatataaggaacgtcttaatgatacatttacagaatataatcgtttttataagttgttagtgtctgaatccttgtttaaaagaagtatttttattttttaaacttagtgttttattttaaaggttagcaaaggttaagattagagatacacagttgcttgtttttgattgagtgcctagtagtgagacatccatttttgtttttgtttttgttttcctgccacatgtgggagccattctctgatagaggaaaggcgtgaaaggcttgagagatatctcattgtcacaggcctttgccaactccagtataatacatgtggcagtgttaggcccatttgaaaacttaacaaatgtgccaaaaagaaaactaccacgagagatacatagttttaaagcatttggacagacctaggaattatgtgggcagatgaagagaagtctagttccgtaacaagggttccaaggaagagggttatgagtgagcaccagtgtacagggaaattttagattttgtttgtttttttttttttttgagacggagtctccctctgtcgcccaggctggagtgcagtggcgcaatctcggttcactgcaagccccgcctcctgggttcacgccattcttctgcctcagcctcctgagtagctgggagtacaggcgcccgccaccacgcccggctaattttttgtatttttagtagagacggggtttcaccgtgttagccaggatggtctcgatctcctgacctcatgatccacccgcctcagcctcccaaagtgctgggattacaggcgtgagccactgcgcctggccatgtttttaatgtttctggaagatacagatagggcagagatccctgactccaaattcataattgagtaattttcctgtgattttgttggattaaagcagaaagccctgtggatttctttaatccctgcctcttgctttgtctcatgcctcagttccctgcaacccaatccatttttcttcattaggattatgaacacactgctgcctctcttaaaaaacaacaacaaaacaaaaacctgttactactgttgttactagggactgttgctggaggtattggtaggggaaggctgctcttcttgcttgtctgctatttagtacagtccctcagtcctacctccatttagaaagtgtgaaaatatctattagggaggacttagtgaaccacattactataggaattcaaggctataggccctgattaaaagtgaacatttaggtcgagcatggtgctcacacctgtaatcccagcacctcggaaggccaaagtaggagaattgcttgtgtccaggagttcaagaccagcctgggcaacacagtgaaaccccatccctacaaaaaagcaaaannnnnnnnnnnnnnnnnnnncccctccctctctccctcaaaagcaaaaattagcctgacatggtagcacacacctgtagtcccagctactcagaaggctgaggcgagagactcatttcagcttgggaggttcaggcygcagtgagctgtgatcacactattgcattcagcctgggcaacaaagcaagaccctgtctcaaaaataaatatatacatatgtattttttaaaaggaaatatttagggagaattttgcaagaaaatcctagattcaagtccatgcctcatctctcccaaatgattaatattgtccaattaaatgtttcatatggagggaatctggccagttataaacagagaaattattcaaatagaaaataactcaagtttgtaacctctttaatgtgagtcagcttgcctggttaagtgtacagtaagctcccagttacctacacaagagagcaggacagtgatatggtgagagtgtgagcgtccatgtcaaagccagggcttatgttgtatactcagggtccttaatacctggcttttaggaggtattcaggacatgcttttgaacacggaatctatgattttcctttgattgttacttatattaattttgcatcactgaacatacattacttggcccaaaaggatcctgagtgtcagaaagaagccatcctggcgttaaaggtatttcgtacacaagtcagtaaatagccagtggttggttcagcttacctcgacactatcacatttcaggtgttgtttatgaactggatatatttaagttcttttcccttggggaaaaataaaaaaaaaaagtcctgctacaatttgtggctattcctagattttctgaataattcattttgggtttcactgaggtattgattccctatacatacacatttgaggtttgtcaaccattttatcttcctaaaatgtgtgtgtgcctcacattcttctatttagccatgtttctgttctcacgccatatgacctgaaataaaacctgataaatacagacatttgattgtcctgtcacccaaagtttatcctgaatctagaggtgtatgtgttttctggtattatctttacagtgatattttctgtgtacattatataaaatgcttaaattatggataacattttcaatgaaattaactatattttcaaatgttctgccttttttctctgtttcttttgcccttcctgatcgaagtctaggagagtaagtcaatactttttatgagaatatattgtcctacttgtatgtctaaagaccatgttctcrttctgcagttcaacgttgttgattttatttcttacattttcgtaatgtaatggctgtttctagtcatgtagtccttagaaactatggttaaatgtcagtggaatgctaataataaatcaaccttttttacatctatgttgttggtttggcccttgtcaccctccacgacatcataacacttttcactgctgtagaattgtcttaatttaaaaaatgtggttataggtatattttacagagcactaattacaaaatgagagacataataattgttaaaaccttgcttagaaggttccccttttatttgggggcatattggcagaatgtgtaaagggagaaaggtacagcctaagggaagaacatgtttgggttgcatggactttattttctggtccacttcattttttccagtccctcctgtgtttgcctctgccgctagtgtaaactggattcagtcttacagtagtctgtctaccagtgcattgtgcttgtttgaattcagttcagagtagaggtgggttttgaactagaaatcagagacccagaccccagctctgcctcggacttgctttgtgactctggcaagtgtttagctgccctgtttcctcctctaaaataaaggaaaggacctgacagctcttaaagttccataattcccttagacccagaccagtgccaaaggctcaatggcagaatagaatcaaagatgggagaattgtctctagtttttgtttaatctgtagtttttctttcctaggattctcagagccggcaaggaggatacagcatgcatcagctccagggcaataaggaatatggcagtgaaaagaaggggtacctgctaaagaaaagtgacgggtatgtatgagcccagcccagtgtctcagtgtgtgattaacctagaaaatgtttccagtctctcatatagggaaacacacttaaaattttataatacactagctgcagacctttagcacactggttttcttcaagtaaatccgagatttgaccagctctctttagaagaaacagtaattgctctgtggtccctaaatggcacttctgtcttgtaacgtgcaattataggaaggcagctactgagtagcacatgcagcaggcaagtgctgacctcatactcacccacctctccgcttttttttttttttttttttcctgagttcacgccattctcctgcctcagcctcccgagtagctgggactgcaggcgcctgccaccacgcctggctaattttttgtatttttactagagacgagatttcaccatgttagccaggttggtctcgatcttctgacctcgtgatctgcccacctcagcctcccaaagtgctgggattttaggtgtgagccaccgtgcccggcccctctacccttttattcactgcagttttctctgcctgttgctcaccaggccacccaaccttgggtgtcacccttgactcctcttttgcctcttgtattatagccaatctggcaaaagctcttccatttctaactctgaaagtaatatactcttgccatcccctcagcccctgctctagggtgagctgctgctgtctctcctggagtattcagcggcctcctaactggtctctttgtatcgctcattcttctttttctgcagttcaccttcacacagcaattagagtggtcttttaaaaatcataaagcacagccgggcgcggtggctcacgcctgtaatcccagcactttgggaggccgaggtgggcagatcacgaggtcaggagatcgagaccatcctggctaacacagtgaaaccccgtctctactaaaaatacaaaaaattagccaggcatggtggcaggcacctgtggtcccagctacttgggaggctgaggcaggagaatggtgcgaaccctggaggcagagcttgcagtgagctgagatcgcaccactgcactccagcctgggcaacagtgcgagacaaaaaaaaaaaaatcataaagcatatgatgtcattcgcctgcttaaaatactccagcggcttccctttgcatatagcatctcaaccctgccttcctgtcccacctcatcttgttccattttctcccctgatcctgccacatgaggcttcttttctgttgcttaaacaaatgattctgcttcacagtaagtgcataagtagaatcttcattattccctttaataattgtctttttggagggaggggacaggaccttgctctgtcttccaggctggagtacagtggcaccatcacagctcactacaacctcccaattcctgggcacaagcgattctaccacctcagcctcctgagtagctgggactataggcacatgccaccatgcctggatacttttttttttttttttttaaatataagcagggtccctctttgttgcccaggctggtcttgaactcctggcctcaagaaattctcccaccttggtcccccaaagtattgggattacgggcatgactcactgtgcctggcctattgtcattgtttttttttaaaagaaagctccttgttttctgattacttgtggatacgtactccttggcttaatctgagacatgtacattttttactgtaatttgtttgttaaaattataaatatttctcttctaaatttctggggtcattgactgttttgcttattattctactcatgcattcaacaaagatattttgagtcctgctgtatgtctaggactcactcttctaggtcctgagaatacagcattgaacaaaagaaaatctggccctgatagagctgacattctaaggaaggaaagagacaaaaaatactcaatatatggtagatcagatggtaattagtgctacggagaaagatcaagcaagagatgcaggtggtgtgggggatgggagtggttcttgctattatacaggtgattagggaagactttatcaagttgatgtttgagcaaaggaagtgagagaaattctatgcagatacctgggagaagaggaannnnnnnnnnnnnnnnnnnnaagtagtcaggagcatgcatctcatggtgacaaaatacttgagagttcaatgtagctagagtagtgagcaagccaggaggtcataggagataaggtcagagggacagggaaccactccgtgaggtggggaatcattagagggttttgagcacaagagtgacataatccaacatgttttggaagcttctctctgactaccaagcaaagcagagtcatggagggtgaaagcacagagacaaggagaccagttagagggagggctgcatcagaaacctagatgggagctgatgatgaggccaggggaactgcagaagagagggtaaaaagtggtcagttgtggataatggaggcaggggcagcaggacttgctgatatggggtgtagagaaagaaaatcacccctcgtccagcatctggctcattgtagaatcagttagcttaatcctgctgtgaaagtaaaaggagaaaagaaatcccaactaacaattcacagatttaaactgggctctagaatggtgaccaaatgctagtccaaactgcatgagataaagtgtacataaattgtaaattccatagcttatcttgctgaaaagcctcaggctcagctccttgttcttccctgaccatctgtggtacaaacatctcttggaaatgtgacctgttctgtcatcaaacgaaaagttaatattgtgttccattatgagcaacaatgtactattacatatctattgaagcaaaagtataaaagtcattttttaacactactctcccgaaatcacaatgatcttcttgaaattagaattgcctaattctaagtgaaacggttaaaatctgtatatccaaggaagatcaacagtcttttcttaagtgttgcatagttcaaaccctaaagtgttcaagtaaattatcttgagagcacctgtgtatgcctgccacacacccaggtgcctgctcactcatctcatttgacatcttttacagagggattaaataatttgactaagatcatacggacagtaagtatgaacactcaaatttgaacctgggtcttctgacttaatgccagggtatctcccctttgtttttcaaaagggccactgctgctgttatcactctaaggatatgcaaggcataaactggcacaaattcacccccttgacttcttcgttcttttgttcttttccttcatgtactcattccacacacatagatgaaatactctagtgtatgaggcagcctgctagatgctggaggtaaaacataaatgagatacggtcctcaccctcactttgactgcagtctgttggaaagagatacagacagagctgttggatcatagagttggaaaggaggttggaagtcaggtggttccacctcctaataatggcacagatagcaaagatgagcactaataacctggagttgcttgtgacttctgtggaagagtaaaaaattraaatgcttatacatgaaaacagactcatttgcaaacaatgaccactgatatgtcctgtgatttttctctgaagtattatttgcgttggtaatttttgaccstagctttggaatgctctttattacttaaaggattataaaaataattttttaaaactttatggaccagaggcaattattgagagacaaaggagcaattgctttattatattttctcattatatgtacgaaagtgggcattactgtctttgtaatacagaaaaggagaatgagtctccaagaggtcaaataacatgagcaaagtcacatagctagagatcgcgctgggatcaaagctcaagtgatctggcatcaaagttggaattatctatttatacgagaccattttctaatagaattttcttttctggaattgtaagattctagcatggcataatcagtaatcgtgtgtggcactctctgtgagcaccagatgccaagagtctttggtatgtccattcaggagctatgcagactggaacatttgtaaagctttcagtacagagagtgggggagatcacagcaattcagtctagtccatagaagtcttgggaatagaagctatcaaaatgttcacaaagatcaggtgctggctgggcgcagtggctcatgcctgtaatcccaacactttaggaggccgaggccggcagatcacgtgagcccaccagcctgggcgacatggcaaaaccctatctctacaaaaattagccaggcgtagtggcacatgcttgtaggcccagctactcaggaggccgaggtgggagtatcgcttgagcctgggaggtcaagactgcagtgagccatgatcgcaccactgcactctagcctgggttacaaagtgacaccctgtctctctcgcacacaaaagatcaggcaatactgctctcaactgtgccaggagatatctcaagattgttccctttcctctggcgatctgaaagtgcctcagtcacaatctctgtcaacccagaataatgcttctgtgttactttccttggctttattagcagcagaagagaaggggtgtgtgcgcgcgtgtgtgtgtattgtttccataatatacatgtgtaagtaaaactaatgagtaaagacttaataaaatggataaactgaggctttaaactattcctgaaggttgaatagtttgattggtggattgagtgtttgatrtttaggatgacactggttttggcttagtgtatacagggatgcctcacctatgttagcaggctcttgtgagagtaagatggatgcaaaactacttgcagagagttagtcacgttaaccaaatgtggctctgattagttgagagatgccacctctaatcagacatttccctggccagtacttctagaagaaagtatgtgatttagctcttatttgaggatggtttatcaattagtagttaaattacctcctcagcaaggctagcattytgaatacagtatgttcaatttgcatttggttagatggtgtcagattcttacttccttctgtgaagcatgctttagaacaaactgtgcttctagtagttaaatgcacaatattatttgtgtttagagatggttttaaatttgtgttgtggcagctttcttagaggactaatttaagaaggaaaagaaaaacataagatgatactgttttaaatgcctgggaaagctacagtggtctcctgatgtcatttgtttccacagcaacagaaggccttcaaaacttacttccagcctagggaatcactgttccctgcccatttcttcttatctgatggaagtagttagtctcaactagtgcatttgcatctacctgcacacacgcagatctaccacacatgcagtctcgtctgtgcctggagcttcacacacacaaaactcttccaagttttaattcgttctctttggctttttttatccttcaatatcatcaaatcacatttttcaaaatgtctatcacttgttactaactatttgtgaatgatttggtcaccatttacttccctttgtgaatcatgaacagttttttctcggggctctgaggcaccattctgtctctggaagacccctaaaggggtggtgtatgagttaccaaaaatgatgatgcattcttgagccctggctaagcttgtcctgtacctcccgaggcagttcacccctcgctccttgcatggcagacttcttgagttactttcttaactttaatttttattttttgtagatatgggatttccctatgttgtccaggctggtcttgaactcctgggctgaagcagtcctcccacctcagcctcccagagtgctgggattacgggcatgagccaccatgcccaaccactttcttaatttttaaaaatcaattattaataacaaaagtaatcaattgaacattcttatgaaagattcacagatatgattgaaaactacttaattaacaccacccccaacaggtttgggtccccttcctagagaggagttattattatatcattgtagtacctgtcattcatttattgagtctcctgctgttagattattattgtttctatttcccatttttactgtccaaagcagtgccacggccagtcacagtggctcacacctgtaatttcagcattctgggagggcgaggcgggcagattgcatgagcccaggagtttgagaccattctgggcaacatggcaaaaccttgtctacaaaaaatgtaaaaattagccaggcatggtggggtgtgcctgtggtcccagctactctactctggaggttgaggtgggaggatcatatgagtctgagaagtcaaggctgcagtgagccatgattatgccactgtactctagcctggatgtcagagcaagaccctgtctcaaaatatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnctactaaaaataaaaaaattagccgggcgcagtggcaggagcctgtaatcccagctgctcgggaggctgaggcaggagaatcgcttcaacccgggagatggaggttgcagtgagccgagatcatgccactgcaccactctatcttgggcaacagagcaagactccatctcaaaaaaaaaattaaaaagcagtgctgtaatgagcatccttgtacatggctacttgtgtgaattaccttccacctgggataataaaaggcaaccaggatttttttgggggggttggattttttggtttggggaagttattttgtaattattattatgtatcatactgtatcgtcgcatgtcccagagtgaatcagwtactatatctagttgtgtttgacttcctccttaggatccggaaagtatggcagaggaggaagtgttcagtcaagaatgggattctgaccatctcacatgccacagtaagtatgtttcttaatttaccctgcctcatgggccagaaagcaaacacgattatgtactcagcagtaaaaattggcgcaaatatatttatgcatttgggtcagatcattttagatattcctttaccaaaaaaaaaaaaaaaaagttttatcttgtcctgtggtagtctgcaccattctttggcatcactagaaacttgtttttttgctctctcaaaatgaatacggtattttgatttcataatattatcttttgggaaatattgattgttctgaaaaacctaggtctttgaattatagagatgacaggctgttctttgcatgtaaaaataatgtaggaaacgtaacagtagatgtaaaaaccttggtggtagtcaaagaagtgcacagtaagttttgccctttttaaaccaacagaaaactcttttcagttcttaaagatgcagagattgtagtggaaaatgtaccaagcaggaatggaaatggcaaagtatatgccaagacttttttaatgtgcttgctgtttaacccagtaatctcagtttggattttaaaaactcattaaattacagtatcctgtgccaagtgatgtccttggggcactgctcaatgaattgccagcagaatagtagaaawgagagatgagcatttattatgttggcaattttgtatgacttacagctgactttagatatctatcagggaggaaaggaagtaccacttaccttcataaactttatttcagttaatcctcccaacaacccatgtggtataataaccttcattttacagatgaagaaactgaagcacaaagaacagctgtaacttggctagttactcacagaattggaagttcaaactcgggtgtctgtctgacattagtccttgtggcctttctctctcttcctgcagaacacatcatcttactagactgtaagcgcccccttgggcacttactagtcctgttctttctgtcttcagcctctcacacagaacttgacatacagaaggctcttagtatacacttgtggcccagtcctttgtggtaaatgactgcacacatcttaaagattgttgtcctttatggaacttgagcagttgcattgtctctgtcccttgcccctcgcagcacacttttcagtgattcttcggaggaattcctcagaggtctgcaatttccctcaaacagcccagctgagatttttagctgtcatgccagttrtgtccagctacccatctgatatcagaaatcctgtctacagacttggatctgtttgtaattatgattgaggctgtctaacagttattcatttcttcagcaatctttttttttttttttttttttttttttttttttttttgagactgagtctcgctctttcacccaggctggagtgcagtggtgcagtcttggctcactgtaacctccatctcccaggttcaagcgagtctcctgcctcagcctcttgagtagctgggactacaggcgcccaccaccacacctggctaatttttgtatttttagtagagacagggtttcatcatattgaccaggctggtctcaaactcctgaccttgtgatctgcccgcttcggcctcccaaagtgctgggattacaggcgtgagcctgcacgcctggcccttcttcagcaatcttttgttaagcttccattctgccatgttctggtgtaggcatcaaagatgcatgaatgaaaaattagataatttttattttcttatatttaattccatacacagtcatctgtgtatgccagagtgaacatttctgatcctttgactatatagatggtgagtttttagtcagttaccatgtttttgttttgttttgtttgagacagggtctggctctgtcgcccaggctggaatgcagtagcacgatctcggcttactgcaacctctgcatcctgggcccaagccatcctcccatctcagcctcctaagtagctgggaatgcaggcacacttcaccacgcccagctaattttggtatttttttgtagaggtaggggtttcgctgtgttgcccagctggtctcaagctcctgagcttaagtgatccacccgcctcggcctcccaaagtgctgggattacaggcatgagccaccgcacctggccagcgttaccatgcataccctaactctctttgccttctgctgcagagctctcccctgggatttgtgaggctgtaacagtcctcactaggcattttgagaagttatatgatggttttatcatgttgtatctatttgcttttcttaggaatctgctgtggaaggcagtgcagagtgatgggagatcatatagttgatgaagtgaatcagtggcactgcttagtggttatatgaccttgggcaatttgctaaaaataaaataagttcccttccccctcctgattttattcctgccaaaacacattgttgtggccaaaacaactgtttatatgcattcttaaggcttgaattaacaagtctcatcacatcatccacattgtttagtggctaagataatggactgtggcatctgtctgatgtgagtctgaatgccaactttgccatttactttgtgaccttgagaaaagtatttaacacataaagattatatgaggattcagtgagataacatgccatgtgtggccattctgttaatacttattgctgctattaccgttagtttattggatgttgctgacaatactgaaatctgttgacaagcaaaccctcctgctacaaacatcagcactctcctgcccccagagcagcctggagggaaatggcttactctcctaacttctgattccctcctgctaatttgtgctattctgttccccacttttcactggctttggcccagaccttttttgctgccagtwacatcactcataatcacattgctgctcccacagaaaggtctctagccagttttagcgggcttttcctgactttgcaaacaccattgattagaattagattgaaaatcaaggccagcagttttctgagaaaaacataaagggcttctttgaaaaagtggggagaagagcttttgttgtcagaaaacttgaggtgtttgggacacatggaaattctttggtttgaaggccctcatcagtgtcacctttgcaaattgttcttatcaaagtgattcaggagaaggccaagtatgcatttagattaatgatgcagggtttgttggcttggccacccaagcaaggtctgcaccagaggtgattcatctccccagcttactgttctaaagagaaatacatttctgtgtacacctgaaaaattggcagcccatccttagaagatttcattcataaattctttgcttttcatgtatctgttaaaacaaaaaaaattcttttaccaactattcaaagtaatgcagaattgtgggaaccaaattcagtgtgaatctctgaatttgctataacagtagtaatattgtgatagcagcttccaactatggaccatctagtatgttctaaacacagtataagatgctttcatttcaaaataccagttccaacaaatctttggcaaacatttcagttagcctcaggccaggcgcggyggctcatgcctgtaatccgctcatgcctcattttgggaggctgagacaggcagatcacttgagcccaggagttcgagaccagcctgggcaacatggagaaaccctatctctacaaaaaaaaaaaaaaaaatgcaaaaattagctgggcatgatggtgcacacctgtattcccagctacttgggaggctgtgaagtgggaggatcgcttgaacctgggaggcagaggccgcagtgagccaagattgcgccactgcactccagcctgggcgacagagccaggccctgtctcaagaaaaaaaagttttagcctcaaaactcaagtataaagcttatatgaagcgactaaactattatcatttctatagttttgaattgtttgttttttctaactaaaagtattgtagtataaataaatatcataaaacaaattacaacagaaagtataagaattatagttgacatatttattgtagtaatcttgagaaatcaatttcaaaagtataagcagctatgttcttcaaaaaccctgttctgtgaattaaccagtgtcacattctgtttaaataatgggttgtaaaaagaaagagaactgccatttatgcagcacttagaatgcaccctgcacttcatcttcaagatggccctacaggataggcatcactatcttcatttctcaccatgctggaaattcctaggaggtagggaccgcatcttactcatctttgaattttcagtacctaacacattgcctgacgtgtacttagtgctcagtgaatacttttctaatgagactgcattttatagatgaagctcagagaggttaaatcccatgctcagggtcatgaagtttgtaaatagctggaccagttttccagccttaaagcctgtactctttctactgtatcatagggtttttttttcctcagctgccagattgttgttaggtctttgaaagtttcatgaataacagttctttgcagtggaactgcttaccttggccttaccttgatactccttgaattagtcaggggtcttagggtagagagggctgtaagggattccgggaagggaggagaaggaggagtacttgtcatgaagataatgcaagtgttctaagaatttatatttgaatctgaaactgcctaaataatgcattacatctttcagatgtcttcagatgcccttatgattaacacttacaacgattattaaatttattgtcacttttttctcaatcaaccaacaccaacagtatttttaatagcacacagaagttcattaaggtctggtgttttactcaaaagggttggaaatccagctggcctctttagaggttccacctcttaggtagataatgtgtgtgtgtccacctgcttgatgggctgatcattttgaacagggggagagtcagaccacatccttttgagtccatctgcagtaaatgcccattcaggatcttaytgtatgtgccttttattaagctacttaacttgtactaatctgtgaaacagaataacagtacctgtcttccatgttacgagaattaaataagatgatgcatttaaagctttgcagagcctggaccgcaataagtgttccttaaacttaatagctgttgtcatctcagtgagctgaagtaggatcacagcatctggaaccctggagccagactgcctagacttgaatttcaaccctgacactgaatctctagtgaggattttccatctaaataaaatggggctattaatgaggcctaattcataagtgattgtaaagattaaatgagtttattgattataaataattagaacagaatgtagggcagaattagtgctcaataaatgtcagctattagtattactacttctctaatgtacaactatccccattttaaactgtggtttattggaattctttttttttttttttttttttttttttgagactgcatttccctttggagtgcagtggcaccatcttggctccctgggctcaagcaattctcatgtcacagcctcctgagtagctgggactacaggcatgcgccaccacagccagctaatttttagtatttttagtagagacggggtttcaccatgttggccgggctggtctcaaattcatgacttcaagtgatccacccacctcggcttcccaaagttctgggattacagacatgagctgccacacctggccgttggaattcttttgtattgctattttcattactactcagtgtactttacagagcccatttggggtacctcttctttcatagaaatttaatttctgcctttagggattaacagcagctctgtcaccttccatggcatttcactaaagcaagaattggatgtgtctcttctccctttcctttggatctttgggtctaaggtctgttgttttcttgccccatccagagcgctgaagataacattcagcttccagggctttaaaagaagcactgaaagcacatacaggaaacaggaagagacctgcaaaatggattgctctcttctttgctattaatgtattcagtaaccttgtttctgttactggccttcggagctctccttggctgtcctctgattccacgtctttactctcattgtcactgaaaagagagaatgagaatatttttcttcgctccaacagattagaaagcagcactgtcagttgtaagagggcgaactttggagccagttaaacccaggctcacaaatttagagctcacaaatttagaaagtgtgaccatttggttagagtatgtgctgttggtccttagcatatacagaggtcttagcatatacgaaggtatatgctaaggggtaaaaaggttttttttacttttactaaggggtaaaaaggcttttttaaagtcttgatttacaaatttgaaggtataaaaccaaggaacctgcagtttgacatcagctgtgatgttacctcctgcccacattcctaatataagaaataatagagttctttaaaatgtttcaggccaggtgcattggctctcacctgtaaacccagcactttgggagtttgaggcttaagtccaggacttggagaccagcctgggctacgtggcaaaaccccatctctaaaaaaaaaaaaaaaaaacacaaaacttagccaggtatggtggcacatgcctgttgtaccagctccttgggaggctcaggcaggaggatcactgaagcccatgtggcagaggttgcaatgagccgagatcacaccmccgtaccccaccctgggcgacagagtgagaccccatctcaaaaaaaaaaaaaaaagttttactttgacctaatgttctgttgttaacagctgtgaccttaaggctgagttaacttaaccttttggtgccttattttccacatctctcaaatagtaataatagtggtacttagttgtagggtggttatcagaattaagtgagcaagtatatgtaaaacatatggcatggagcccagcatgagtaaatgctgtgttctcatcaacataatgatgccctcgctttaaagactgccctttctgtgtgaggctaataaaagcctcaagcacattttgtctcagccattcatgaggtcatgagttcaagaacagcctggccaacatggtgaaaccccgtctctactaaaaatacagaaaagtagccgggtgtggtggcgcgtgcctgtaatcccagctactcgggaggctgaggcaggagaatcgcttgaacccaggaggcagaggttgcagtaagccaagatcacaccactgtactccagtctgggcaacagagcgagactccgtctaaaaaaaagaaaaaaacatatgccatagctcagatgttttactatcaaattaatgcattttatacaaatattccaagtctgaaggttttagttttatgtacccttgttggatagcatgacgtaaagtggctactgaaattaataggaaatgtgaatttaaaaattcttcctgtattggcccaaactctatatactatcaaatagtaggtacttaatacatatttgcagaaatgcctgcgtggatgactatctagcacattcattgggtgcagtaacctcagcgccacgtcttagcaggagccccagtaagctctttttttctatttgcattgtagcattgattgtttaatgttgatttgagtggaacatcctctcaaaagtaaggtaaccgattccttgctgcaataaaaaacattttcttggagatctccattttcaaatatttctttctcacatatacatacattctgccaactggaaatgagtccctttattaaaatgattgggagatacagtgataaatgtttgacaaaaaaattagtaaaatggttgggagggttaagggaattcagccatctaccctagaatgaattacttcagttagataatcactacttatctttttccctgtctgaaggatcacacaggggatgtgagagctttagttgtggccacagagtaataagtttggaatttggaacgtgcatctggagggaagatgagggaactggccatttaagggcagtaagaaccagaaaaggcaaaacagtaaagctatattttgactgactttgtaagttttcctagggcttggcttgacagggaaacagtgtgataagtgagaagagatttgttcagaattcagctttgccttttattttttgtaaaacataggttagtttacttcaccttcctgatccttggttacctcatttatgaaatgggtttgggaacagtacctaactcatagagtcattgcaaaaattaaataatagaattcatataatgtatctggcagtttaggtactcagtttttcaaaaaattgttaccttttatctgtttggaaggccaaaagccaatagtcttgattgctaaaattctggcgataagatctctctgcagtggtaagtgttcagcatgtaccttaatttcttaccacggttgtagttattgattgtatgccaaaaatatatgtccctgtagggcacagtaggtgtctaaaaaactatttattgaatgaaaactttgaaatgaccataatggtctgagcagctctgttttcagacactagcataggaagtgaagagagctttgtcattttatttttacctctttccacgcgtcagcctcatcctggctgggtcaggcctattttccaagtaattaatgttcacttcttgtttgtaaagcagagcaattcagtaagatgatgggaggaaataatttcatttctgggtactaattccagtagcagctgttttctgctaactgagaaatatgcctgtgctaayaactttacacttccagcaaaaacactggaaccatggtgcacactaagctgtctaaagacaaatgtgcggtgtttattttcttttaggaaacacagaaacattaattgggattgactcattctgtttctgcatgcatttctacttacttatttgatgattttcctagctaaacagccactttctgttatgtcagagggatatcttcatcacttctcttcatgaaatgtacccagagcttccctgattgaaacattttcaaaaatcaaaaacttgaataggtttgccttttgtctgagggtgtgtaggagaggggtgtgtaaaatgaagacatctgtgtatattgttaattgggaaaaacagtttacaaaatagtatatacaagttgaaccaacatatgtcaaaaaaaaaaaaaacagacatctcacacacacatcttggtaaaattaaggtattaacagtgattattgctgcatgtgaaagtgagattccaacaactaatgtttggtttcttctttgtactatctctgtctccttttcttctatgaatgtgttttattttaatgagaagtgaaacctataaaaggacaagcctcagagtttgaaggaacagagttgtagaattgtcagytttgaaaagtgtcataactatatttagagaagctcttgtagcttttgaaagagatgctgctcaagacagccttcaggaacaatgtgtccctccattcaccattcaaatttctgcactgaataattcacatagtaggtaatgattacttgtggaatgatgcattgaaagtctccttttctagctgtcttaagcctctggccaccagcaccactaccgtacgtagctctaattcaggccctcctcatttcattgctcatcttccttactctctcagcctctctctgcctcctctacctttcccaccaactgcccccccaccaccccaccgtgaaatagagatctaactggccactctgctttctccagtagattgccagagtcatggataggaatgtgagtttcttagtatcatatgcagagtctcccttcctgtgtgctcagtgtcacctcctgcagcttgtcccctcctatgccccaggcctttggacctgcttatcacacttcccagtttgtccatattccctcctccaagtcctctctgaaggttgaggctgcctgtgtggaaccttgcctacatctttggtgcacacccttgagctcaggtccctgggctccctgggcccccatacgtaatcaagtctgtttccacagatgtttaatggcatggaccatgtgtttctcagatgtgcttggaatgtggtagagacttaataaatatatgatgaatgagtaagtaggaatttcaaagtggcttctaaaatttctcttttccccaattatgaaagtaagtacttagaggagagtcagataacccaagaagatattaaaatagaaattaatctttggagcttttgcttcattgacctctaacccttactgtaatcaggaggaaatgttcttgtgtgctgggcatccagctgttattctccgagctatatcagattactttctttccaggctggactgcagagtgaccgcagaagagaaggagtgggggctctgacccatccaaaccactttcttaccgggagagcttaggaatgttacttaacctttctgtgcctttatttcttcacttagtaaaagaaactgaagacttccctcacaggtagtacatgagatagtatatgacataagatgcctggaatgtagtcattaatttagtaaatatttattgagggctgggcacggtggtacatggctataatctcagcactttgagaggctgaggcaggaggatcacttgaggccgggagtttaagatcagcctgggcaacaaaccaagatcccatctctacaaaaatttaaaaaattagtcaagcatggtgaggcatgcctgtagtcccagctacttgggaggctgaggcaggaggatgccttgagcccaggagttcaaggctgcagtgagccatgattgtgccactgcattccagcctgggcaacagagtgaaatcctgtctctaaaaaatacatatttttaaaattagcctcgtgtggtagcgtgcgcatatagtgccagttactgggaaggctaaggtaggacaatcacttcgcctgggaggtcaaggctgccatgagccatgatcttgctagtacccgatgtgtgccaagcacattttaatgagaaaaatgtgtgtgtccttagtgagaaggaagacaggaagcaaataaggagtgttaagagccagaaagaaaatacagcagggtgtacaaaaatggaacatcatggggaggtggtcaggccaggtaccgcctcctctgaggaggtgctgattgatgagagttctgcagggagtgagcagggagstctccgagggcctgcaggagtgtgtgagcagcaggagggaccagtgcccctcctcagccaaaggaacaactcagagtgacaggagctgagtgcgagaaggggcctgcgattggtgcctggaggtcatggcacagatgtgtgtttattctgaacaggatgggaatcaacagcaaggactcaatagatacatagacgtttccagagtttctcctgttttgttttcttttttctctcctgtacttaaacaatatgaaagcatttcctaaactgttccactgtggtgtagcccagagtaaatcatttagttttactttaattttagtctgctgaaatcccaggaaagattatacagtctccaatcaatatacctataaattagtactaaatgtcaagaaagtgctttgaaattttggaaagttacacaaacatctgaagttacaattattactgtagtgatttctgtgcttcaaatgccttggtttttggacttctgtggaacataccactcccctctggtattcgtgggctcagccctgggtaagtcagctgcttagacagtcaaaacttaygcgtacttggctcctcaaagtcacatttgggatgatggccatttgtcaagtgcctcactggcagctcagtttggagaagagcactatgtttaggcaagatgtgcctgtgtcaaatgcagttcatgttaatgtagcaaaagtcagtctagtagatttggcaaacttctaagagaataaacatcataacgtcatcaccactgaagttgtgggtcaatcatggaatgacttaaaccatataaattccttatcagcaaaatactttgaaatagtccgtgcttagaaatgagaggtgaggaggatgggaggagggaaaggagcagaaaaggtaactattgggtacttggcctaatacctggatgataaaataatacgtacaacaaacccctgtgacacatgtttacctacataataaacattcacatgtacccccaaacctaaaagtttttttttaaaaaaaaaagaaagaaagaaagaaatgagagctgagacctgaggccagcatggtgcctcacgcctgtaatctcacttgaggctgacagatcacttgagctcaggagtttaagagcagcctgggcaacatggagagactgtctccactaaaaataccaaaaaaaaatagtaataaccaggtgtgatggtgtgcatccatagtcccagctacttgggaggctgaggtgggaggatcgcttgagcctaggaggttgagactgcagtgatctatgatcaccccagtgcactctagcctggccgacaaagcgagaccctatctcaaaaaaaaaaaaacaaaaaggagaaagaaaaagaaagaaatgagaggtaaatagtgctgtttaacttgcctgaatgcagttaatactcagctgagtgtatggtgtttttttgttgtttttttttttttaagatttgtatctactcttggttgtatctgttggtaagattgttcagaaacaccggagaaatctagattttgggagaattaaaaaataaagttaaccttctgtcacattcaaatgtgaatagtgtctaaaaattactaaatttttctttttctttttttttttgttttttgtttgtttgtttttttgagatggagtcttgctctgtcaccctgttgcccaggctggagtgcaatggcgtgactttggcttacagcagcctccacctgtcaggctcaagtgattctcctgccttagcctcctgagtagctgggattacaggcatgcrccgtcatgcttagctaagttttgtattttcagtagagacaacggggtttcgccacgttggccaggctggtcttgaaccccaggcctcaggtgatccgcctgcctcagcctcccaaagtgctgggattacaggcatgagacaccacgcctggtcagcttaaaaattattaaatttttcaaaggcagtccttctctacttaagaaacctgaaacctcttattatgcataatcaacttaagcttgggaagttcttccttatttctggcccaaatcttctgcaattggagtgtatttcttttcatctgagctaatggaaaacagctgcccaaccttcccaataacaaccttcatatacttgaagatggtcattaagtcaccccctagctttccctcctctgtactaagtaatgcctctaactcatcttcagagtttccattttccaccctttcaatcatctcttcatctccccaagcttttctgcatccttctttaaatgtggtttcctaattggaacataatatcgtagcaagagttgttctcaccattaactgggtcactgccttttcaggtggtcatatgccattgtcatttatatgagaaagtcagcaattttatcaacatccaaaaagatgagatgtagaactaacagttctttttacagtgagctaagcctgcttcgtggctacagattctgattttggagtctgaggcctttagcaacccaaacacttcagctgttttcttttttttttttttttttgagacggagtttcactcttgttgcccaggctggagtgcagtggcgagatctcggctcagtgcaacctccacctcccaagttcaagcgattctcctgcctcagcctcccgagtagctgggattacaggcacccgacaccacgcccggctaattttgtatttttagtagagacagggtttctccatgttgatcaggcgggtctggaactcccgacctcaggtgatccacccacctcagcctttcaaagtgctgggattacaggcatgagccacctcgtctggctcttcagctgttttctcagaaaaacttgcaggcccacaagctcctgcctccccttctaggtttggtgacaagttctggagtacaggaatcttcccaagcactgtttcctctttggcaaaattctcttgtacttgacttctggttccattcctaaatcaaaggtacatgcattgaacatggaatcccctggggtctctcacttcctcccctaaagcagttcgctttggaatagatagatatgggacaaagggcattgttttctatgtttaatctcattgaaatcatagagggagaaagatcttgaaaaatggtccagagagcacaggaagataaatagaaattgtttaatgcccattatttagaaggagaggtggcagtgtgtcattgaaggtgtcttgattgtatgccatctctgttgtttcaggcttactgatgtgacttgtctctaactccctccccctctcttttccctgaaaattttaattcctcagctggagatgcacctggtactaggattttcagaaccacagctctcaatcgaaacagggatataggtccaattaaagagtttcattgcttatttctccaggcttctcgtgttcgagcacagcccagcctgggcactcaaacatttcattccttggtcagcttctgcaggaaggagggatcctagtatcagccattgtccagcatgtgaccttgaacatgggcaggcaggagagtgttttgaccagtgtgaatacgtggtgagacttcctaagttagcgtgactatctagatactatagggtctgttttatatgtgtgaccaagagatttgctgataagttatatgaaatccttatcaaattttctctctccccagatattggggttcattaagcattgcctcacaggtagtaattgtcattgtacttctgagagaagtaatgtaaattttgcatcacaaccaaaatttgttgaatccatggatacctgggagatcaatttggggatgattgattaccggggtcattttgaatgaataaatgaaatatagctcagctacatttcatagtaagatacagcattaaaagtgccaactgttggtgcttagttatgggtaggttccagaaaggtgcatttccatggaccatgccgactgttcattggaagtgaggtggattatttttttattctcttctgaaaaatcaccaggatatttatgcacagtttaaagacatttagtaggacacctaatttttttttccatctttaatgagattcagaattcaactgggataaataaaactttactaaacttaccagcttatatttgagggcagaaacctacagatctgttgtcttcttgcagcaaacttggaacaatgctcagatgtctgtttcttctttgctgaaaatgtatttttgtaccactgagcaggccttatgaacagcatacctgccctacagggcactgaacctgcagacaagagagtggagctgcatgtaacttctccattttctctttttttccagtctaacaggcaaccagccaagttgaaccttctcacctgccaagtaaaacctaatgccgaagacaaaaaatcttttgacctgatatcacgtgagtcctttttctctctctgagttggttattgtggcttctgacacctgcacatttccattctccaggtcagcagcttttccaagcagggctcctcacagttggcattggaacagttattcctgcatgtgctgctctaggaagatgccccaggtctcttaatttccactgagcccacctgcagttgacaaggcatagcagtgtcagatctgaccagcaatagaatagaatctaggatttgtacattgaactaaaccartgcttgactgtgagtacacagctttatccccttggagagatgtttcttagtatattcccatttctgtcttagatctactgaattatagttgttggtatgaggcccagacatagtttaaaaaaaaaaaaaaagccactaggtgattgtaatgtgcacctgtggttaagaagcacggatgtagacttgggaatgcagatgtgccactatatctgtacaacgaatttgcccagagttatatccctgcaaaatctagctcttaaaggaaaaatcatttccttgcttccaagcagaactgccttcaacctctgtgaattgatggcactgcaccctgtcactcttctacttcatggttcagagtttgcttttctcttgtgatgagagagcgtaatgagctacccaccccacagcctgttatagcctgtgccctcatagtgtgtaaagagttggggggagatgttcctttaggctggctacctgtgcttgtactgattcctatgggtgtgcttaccgacccacactgtagactgagaggactcctctttgtaaagagaggatgacagtgccattgaagtgactctcgtgaatatcctgaaatcctgcaacactaatcttaagtatccttccttctctatcacagcccagcaaggcagacccacagccaaagtggatgatctatgtatagaagcacagaaatattttcttgccctttgaaacctttctgatgcagttgtgtgaatagtcctgacccaaaagatagagtcagtcatgaggctctttaggggtagtcgaaactgtattctgcagcatctgtatgaagtttagattccctgtgattttcatgaccaagagatttattgagttattgatgagaaagaaataggaaaatttggaattattttatgacttcaaaaagccaaaaacccctagttatgagagtctgtaggttattaataatagttggcagttatagagcatctgttacatgccaggtgccttatatacattagtgctaatcctcatgaaagccctatcagttttccattttacagaagaaaaaactcagactccaagaggttcagtgacctacagaaggtcacacagcaataaagcagagattcaaccaaagctctcaggctctgccacccatggcatgttcttttttttgttttgttttgttttgggttttttttgttttgttttttgtttttgaggcagggtctcactctgtcacccaggctgcagtgcagtggttcagtcgcagctcactgcagcctcaacctcctgggctctagtgatcctgcttcaccctcccaagtagctgggaccacaggtgcatgccaccacatctggctgatttttaattttttgtctagaggcagggtctctgttgctgaagctggtctcgaactcctaggcttaagcagtcctcctacctcaacctcccaaagtgttaggattatagccatgagctgtaacattaagcatggtatgttctttgacatacacattgtctctctctccaagagagatgaagggtgtgaytgcctagcctagagtagtcacacaggaagtgctcaggatatgttagtttgacctgaatatattgagaaagagcttccctcatgtacatccagcccaaagtatccaagttaggtcactccttcccactccttcccttacatggatagcagagattgagcctttcttcctgcaacctgattcagccagagagcagccccaacatctggggcatagtatgtctagtgttgggggtgttggggctaccccatggttaagtctcagaacaaatagggaacagtaaatgaatcatttctgaaaaggagatttctttaaaaaaaaagaaaacacagtaacaattgaattgaaaatgaaacagaaaatactgaattagctggcactctccagtttgtcatggaaatccatttggatcaaataggaccttcccctctcctcactgtttattcaaaagcagtgccagatgtatgcatggtatttgtggttattttattgtattcttgttgcacttaagaagaataacctcgacagaatgaatcatgtagctgttttattgccgtgtgaccttgtgtaagtcactgaacctcttggagcctcagtttttttttctgtaaaaatatgagaaacagatagagcttttgtgaagattagcaataatatacacaaggcacctggcacataatggcgtaaaactaaaataatattaaaattctacttttactggttttcttcccaggaacttaaatctgtgttgtacctgaaagtaccctgctttctaaggtttcacttatttttctttttttttattttagataatagaacatatcactttcaggcagaagatgagcaggattatgtagcgtaagtagttttgaaataaaggtgcgatgccttggattgaaaaagcacctctctgtttacaatacacatcaacattttcttttcatttgtaagaacctcgcctggtggctccatgcttctttcccgcctgtgggccatcacatgttgctcttctctctgtctgtggttctccctcttgtctactcaataagctctggtacctcctgcaagattctgctcaagcctcaccctctctggggttatagctcactactccttgcccgcggcctcttcataaccttctgtgatcctgtggtgcatgtctgcagccctttagagaccaagagcttttcgagggcaaggaccgtgccttatgcatcttttaatcacatcccttgccctcaggaggggcctttgctcagtttttggtggccaaacatatcagccagcctacctgggcacttgaccattattgtaagaggagcaggtgagccaggccctgaaggaaggaaactgccatgtgcctttcactggggtgaacagagtcaataaaagggagygtgatatagtggaaaggaacaggttggtatcacatactcctgggttggagttttttgtttttttttttgtttgtttgtttgtttgtttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccctgggttggagttttgcactcacctgaccaggtatgcaaccttagatagtccctagtcccttttttaaaatgctagccctggtcctgagctgtctttattccctcttctttcctgtagcctgtctagactgaaaaaggcagtgtgtgactattataaatctcagctgcttgggagagggatgtttttgttaaaatgggcaattattgttcactttttttttttttatttctaatgagtacttggggtaatttggaccgagttttataaactgtcaaacttcctgtcccatcagtggcacagaatacatgctatgttcctctcttatttctggagagccacagaattctgctcataccctttttgccttatactcacttctyttctctctcccactcgcttacttttgttattgctcacacacacaatcttctctggggaattttactcttttcccatttcaaaggagaaatgataaaggatcagaaagagaagagaacatgggtagaaaagatacagaggtgggaggaacagggtggggaaagaaaactgagagagaaggtagaaagacaaaggaaaaggatgagaaaggtctaattagctattcattatttgaatatttaatgaatgccagctgtatgccaaggctatgcaaagccttgagaatacaacattaaattagatggagcccctgccctgaaggaactgcatctctactgcaggaggctgttggtacgacatggtgcaggtgctaagtgtaaggacagaggaggccatgtgctggaggaatagactcggggcacacaccctcatggtttcctggggttgttcctcagagatgacttccaagaggaaggtaaggctgagctggctcaggaacgtaggggaaggttgtaaatactctatactccaggcaggaggctctgatggcacagaaacaggaggatggaataggaaggaagtgattgatgacttgttgttatgggtatagagttggtagactgaaaggtgactagaagtcaatgaggaggaagtcagaggcctggccctccacccacaggttcagagaggtactatttataataaaaatgggtaatagttattgagatgttacgtgctaaatgcacttcatgtcttattaatcctcacaaccccagaaagtagggacttttgtccctagtttgcaaatgaggaaacagaggcacaatgtgcccatggtaacagtcctagtaagctaggatttgaacccagatagaattccacagtcaccttggaatattgtttctccttctccgatttcattctctcttcctcatttccctttctcaaaaccctaagtgaaacacaggtgagtaatttgggtgaggcagggaacacaaccactttctgtttgttcccttatgactcaaactcagatcttcaatattttatttactcttagaacttacaggtaattcagtcccagttttgttaagagattggtgtcctgcccgtgagacttaacatttttcagtaaaagaattacatggcccaccctgaagttgcgcattttgcactttgcagttttgttttgtttctgagacaaggtctcactctgtcacacatgctggagtgcagtggcgtgattatagctcacttgcagcctcagtcctcagtctcccaggctcaggtgatcctcctgtcgcagccttgcaagtagctagtgctataagcacgcatcaccacgcccagctaattttcrtttctttttttttttttttttttttttttttcagtagccatgaggtcttgctgttgttacccaggctggcctcaaactcctgagctcaagccatcctcccacctcgaccccagaaagtgctgggattacaggcgtgagctatagtgcccagcctgcattctctctgggtgctggtggtgagaggggaactttgttttgagtgctgtaggaggtaatggcagtccacaaagaaagcacatgcctcagagggaagccttagttcttcacttacctccaggttacatagaggcagtttcactgcatcattgagtttatttttcatatgaaagtgttcgatgaaattgaatgaaaaaatttcttctcactgaggaaagttcacaaagagcagatgcatgttagactcatttggcttcttgtccaggctctgctggctagtggcttttttgtttgttgtttgtttgtttgtttgtttgtttgtttgttttcagagtcttgctctgtcgcccaggctggagtgcagtggcgcgatctcggctcactgcaacctatgcctcccgggttcaagcaattctgctgcctcagcctcgcgagtacctggaactacaggcgcgtgccaccacgcctggctaatttttttgtgtttttagtagagatggggtttcaccgtgttagccaggatggtctcgatctcctgacctcgtgatttgcccgccttggcctcccaaagtgctgggcttacaggcgtgagcgtggcttttttttttaaaatgagatctatgttgcccaggctggacttgaactcctaggctagagcgatcttcccgcttcagcctccccagtagctgggactacatacgtgcactatggtggttagtggctttttaaccttaggcagatcatctggcttcagtcttctcatcagtaagatgggattatatacctcgattgcaggattttgagaggataagctatgtaaagcccttagcacagtgccaagttattttttatcttataaaactcaaagcgacgtttaaagtattaaaatacaattatgcattctttatgcttttgagtatgcttgttacttgaaaataatttaaaagttaatgtcacaaatgatcactgtgagtcttggtccttttgaaatttagccatttcattccaccaaatttgaattattttctctagaaaattatcctttaaatatactttttctgattatcatgacaaacttctttatttatttgtcatgagctcctgagtaaagaggcaaatggaaggaactctgaaaaagtgagtcaacaaaagtgttttcttatccccatctggtctgacagaatccagcctagaaccttaggcaagtcatataacttcagtttcctcatctataaagtattataaaccctaacttagaggcatgtgagaagattctacaggttgagtatcccttatttgaaatgcttgggcccacaacttttttggatttcaaatttggggtgttcaatctatatgttaaaaattgtaagtatttggtacatagtagatactggccaatattagccaaatgctagaatgcctgaggaaagcgaaatagaggctttgcagtcaagtgaaaaatccagtaacatcagtgccgctgataaaatgcagtaatcagtcctgttgaacccaggttcttgatttgtttttaacaaaacaatttctagtttctaacttcagactgatataaaaawtactgttttaatcttctaaaaggtataaaatccccccattccttctgcatatgaattcctagactcttggttttgaaatgttcrgttttctgcatcacagaagttaagctgtgtatatgcgtttctcccaacatactgaaggtgagcgccacctagagtcaaaggtgtgacttgcatagttcacatactccaaaaacataatttggtttttaattcttatgctgtcactattgcttattcaaagtcttttgtatagtgctttgtttcatatccatttcattcaacgatatacaaaaaaatgagagactcagttctgaacctctgtattgtctgttgagaataaacattagctgtctatatagtaacaaaaaattaacactggtttggaaatgttttttattttctttttagaaaataaatttggcttttttctcattcatgaaagtaatacaagttcattatagttttgaaaaattatagaaaggcacaaagtcgggcaattcctctatcagttgttttctatagaaaatcactcagagacaaccactattgacgtatttgtgaaattccttttagcctttattacatacatatatttaaatttgggattatatcattctattagcccgttctcacactgctataaggaaatactgtagactgggtaatttataaaggaaagaagtttaattgactcacagttccacatggctggggaggcctcaggagacttacaattatggtggaagggcagcaaacatgtctttcttcacatggcagcaggagagagaagtgtgtggagcaaagagggaagagccccttataaaaccatcagatctcaactcactcactatcatgagaacagcatgggggaaaccgccaccttgatccaatcacctcctacaygggtctctccccagacacstggggattatggggataacaattcaagatgagatttgggtgaggacacaaatccaaaccatatcaatcatataataggtttttttgttgttgatttcacaaaacactatattatgagcatttatccaatgtcacccaaaaattatttgaaaatgtacactttaatgcctgcttaactgttctactttgtggttatttcaggcctagttaatcaactctctgttgttgggtttctaggttattttagtagcaaagggttattttgtttgggacatacagtagtcatactgtatataagtaaatctgcagtcttcatttaatattataaatgtcatcatgtttccatgttaatatgcctttttcataagtataaatttttatggctgctaatgaaatatcccttcattttcactgttaagtgtccccactgacatggacttgcagaaaatacataccttttgctaaactccttttcctggctcctctccatttctcatcatttctttctcatccttgcattggatgggtccctcattgagtcctctccattccaacattccctttattcagtatgcccacacggaaatgcagtctccttgtatattcgttcaagtcctcagttatattgattttttacttttctcatctgctcctctcctctctctcattttcccctatgtgtcatttttcattctttaactctcaccttccttcaagtttgatttctttgtttttcctcactttattgctattttggaagggggcttctcttttggaattacttgacaaaagtagattttttttttttgcagtggcaaaaaaaaaaaaaaaaaaaaaaaaatgaccatgctcttataaagacttttttcctcttatgtttttaccaacagatggatatcagtattgacaaatagcaaagaagaggccctaaccatggccttccgtggagagcagagtgcgggagagaacagcctggaagacctgacaaaagccattattgaggatgtccagcggctcccagggaatgacatttgctgcgattgtggctcatcaggtttttgtccccatatttgaacgagcttttacaacatcctttctcttcctgtagaatataaaacgatctagttattgaaaaaccttaacccctatggacacactcacatacacacacaaaacacgtattcccaacgtgatttttcctaccgctgagctgcttttacctatgctgttttctctacctggaaagccccctcttgctctcctaggtgtcactgccaaaatactacctttcctataaggtccaggtatataagcaccatggacattatggagagagtagggggcatggggtccacattttgtatcactgtccaccactcccagcctggaccatctcacactgagtccctttagtattctgattcgtagtttacttatcctaaaaaatgggtcagtaaacctcttgctatggcacggtggctcacgcctgtaatcccagcactttgggaggctgaggcgggcggatcacttgaggtcaggagttcgagaccagcctggccaacatggtgaaaccccatctctattaaaaatacaaaaactagctgggcgaggtggcgggcacctgtaatcccagctacttgggaggataaggcagaagaatcatttgaacccaggaggcagaggttgcagtgagccaagattgcaccattgcactctagcctgggcgacagagcgagactgtctcaaaaaaaagaaaaaagaaatggtgcatgtgaaatcaactgacatgtggtacatgattttccttccttcctactcagccacaccttccctcacctctgtatcacattgaagtcgccttctcccaaacttttattttcaaatagcactatattaccagtgtattggcaacagctaacactgagtgttcccgctgtactgagaatcatgctaggtgttttgcttatctcagtgaatccttgcagaacccctgtgagcaagatcccaatgttctcattttacagatgaggaaactgggactcagagaggttgaatgacttgcataaggtcacacagctagtaggagtcagaacaaggatgcaaacctggtattcttaagcactgtgatataccttttttgcggttttacttgtgaaactggattttctacacaagaagccataagcacctcagagagaagtctcagattttctgccattattgtgtacatgtatgatagtgacacacgtagtgtcaggaaatggcaagcaggtagtaaaatctcaagcattgaccagtcaggaagaagcttgacccagagagagaaacctgaagatttggctaacatggaagtaatagttcccattgttctagggccattggaggttgtagaaaaaaggccttaggtcactgaaagaaacatttggtgttcaatatttacagctgtcttattactaagaagtgctcatggggaggccatgaccaagaactgttgaggttaatgttagttgcaacttggaggttaatgatggctatagaatccactcccctgtgagcagtacttaatagaccttcagtccatcactgtcagaggtgatagtggcagtgagggaacatctctcacaggcctagaggtgttgcatagggtctctkaaggaaagcctttctcactttttcacaaggataaagtgcttaattttgttttcagttcagtatcaaagggaaacttttatggtagcccctaggctaaacctcaagagtccatttcttccatttaagtcttttcttcatagttcttaacaatttgtactactgttttagcttcctctgtagttggcacactaaaattagatgtcttttttgtttcattgtcttcaacattckttccacagaacccacctggctttcaaccaacttgggtattttgacctgtatagaatgttctggcatccatagggaaatgggggttcatatttctcgcattcagtctttggaactagacaaattaggaacttctgaactcttggtaagtagtgacctgtacttgggaagaatgatattattgtcatgagtaattttaatatattgttttggattttttttgtatgtctgctgagtacaaagaattataattcctgaattttgtgagtttgcgtagacgtttaaaatgtaacttttgtggtatgtaatgctgactttctatttcctgtttgaagaaaggatgaatcatacatgtctataagtagctcagtgaaattggctcttttcttttgggatggtcttcttcaaaactacatttttctttatgaattagttttcatataactcgtggaaatagcagttaaactcaaatgttcacattacctcatggcttctgttgtaaataatgactaaagagtttatctcaatttttttttattatttctaagtttgtaaaagtacacatgaattacaagtggcttgttaactattgtcataaaaccaactactcttgaacccataacttctttaggtagtaagggaagaaattgtgagaagttgtggtgcttagcttcttaatccaaaaaaggggttatgtacacttaaacttgttttcctttaacctctgcccttcccatcatgagtcacccagatttggagttgtcatcaggtccaaattgctccccgagatataccaaaatacagaaggggagcctacttggcatcccccaagtaggatgcctactggacaaatgccccattttgcataattttaacacctggtgcactgtgagagagtctttgtactaagagtgaaatttttaaaataaagtatgacttctcagacaggaggctcacccttgagcagaacctgaatgaacctgggctcaaaaaaaagctgaaagtctagcttatcattagccttaaccaaaaagggcagttagtgacccagccagcagccctggtcatctgagcgttcactaagcaatcgtgatctgtcttgtgttctatgcacaatacaagacattccttctaatttagaatgtaggaagttaccatgctgatactcggctccctagttcacttcaggattgtagagaaaagacacagacctattacctgtaacacattctttagtgcagaaatgatgtccctcatctccttgacctgtattaatgaaacccagtttgacaacaagaaagaggaaagtccaaatcctaaacgtttgccatgcaataaacccaagactttttccctcaaagacatggttgcatgtatgtttcttaaactttgcatcccaaaattacataaaatgattagaggcccttcagaacaaattttcttagaatgctcttgaacccagaagcaaaatggttcctgggtcctctgctgcctgcagcatcttaatctgtatccagatataaagtaatcctgtgtccttttctgtcctgggagtaaatttgttcaatataaaaaggaaacatgatggtggttgataagctattgctgtttattaaaagtttaacctagactcacatatggagcctgctctctgtaatctcatatagtttatatgtgtgtagaaccagattctgttctagcatttatcacatatttgtagacatgattgatttccttgtcaatggccccactagactatgagcatctatggaaagggaacatagtttacccatctctgtatttccagcacttagtttggtgcttggcacgtagtagatgctcagtaaatatttgtagaccagatggacggtggtttgtattctaagtcaaatgagggaaaatacatattcataaatctcaaaaacaaataataggagacttttaactagtagcaaagagtttgctatattgtggttgtttgttttttctgttacagctggccaagaatgtaggaaacaatagttttaatgatattatggaagcaaatttacccagcccctcaccaaaacccaccccttcaagtgatatgtaagtatttctgatatattgaacttttttaaaccattctataattgtttttctacccttccaaaaaacttctttttttttttttkgctgggtgcagtggctcacgcctgtaatcccagcactttgggaggctgaggcaaacggatcacgaggtcaggagatcaagaccatcctggctaacacggtgaaacccgtctctattaaaaattttaaaaaaattagccgggcgtggtggcaggcactttgtagtcccagctactcgggaggctgaggcaggagaatggcatgaacccgggaggcggagcttgcagtgagccgagatcgcacccctgcactccagcctgggcaacagtgcgagaccccatctcaaaaataaaagaaagtctttagttttttacagtgtttgtttgtttgtttatttgttttccagagcaaaccccattgtcaggggaaagcagaacaaagaaaagtatttagaaatgtatttccgggatgcacagattcttttcaccctcaccttcccctaggttgttgcagctgcgcacctgctctgtgaagcacagattgtcatgggggcagttctctcaaaaacatggcatattgtgatgagtaagagacattcaaagacaatgggagattccttttagcctggcaaaaatccaaatgcttaaaaacccactcagcaagactgtggggaaactgacattctgtctcataatattgccagtgggagtacaaaatggtacactatgaaaaacaaattaaccatatttaccaaaattataaatgtacttaccctttgactcagcagtcccactcctgggaatttattcctattctgtaatgcaaaaagattaggaacaaaacaagtatccatctgtaggcatctgatgaaatactctatggtagagccacacaacagaacactatgcagatggaaaaaaaaagcacaaattacactgaaaaggcttttcaaaagttaatttgatygtaaaactaccatgaacaaataagacctaagttttactttaccagcttgataacagcaagtgctcaagcacatacacagtgcactcttgtccacaccagcattttttaaatgtttgcatgacccaaaccttgaaggcacagctgccagatgaatgtcataacaacatgggtttttatgtcctgtttctcatgtgggaagcagcatcagcgccacctggtcagctttgtgcctcatctagtcatttggcctctgtaagactttcaccttcaaaatgtctgtgattctccaatatctctaatgtagtggttagggtcatagattttgaagccagactgctggagttcatatcatagctctgccacttcctaaactatgtgaccttggacaagtaactttaattgtctgtgccttagtttcctcatccagaacatatatctacctcatagggttgtggtgacaattaaggggcttgaataaaaagtgcttggagcagcatttggtctatagttagtgctgtataagtatctgttattattattattggtctgtagtaagtgctgtataagtatttactactactactattattacttccttgtttggccagtgacccagaagcataaagtgaacctcttgtaacatgcagtttgatcactcatttagttgttgatcaaatccttacgaggcagcttccctacttcagccagtcttgtaggtgctgaagatacagtagcaaacaagacagagtttctgtcctgcttacattctgaggagatgaaaacacagggaattaaaaagtcagtcatacaattacacattgtattaggtgttatgaagaaattacaacaagaggaggtgttgaagtgtgtggggaatggggagagggtatttttttcaagttgaaggtggggaaagtgcagaattgaggggcatgaaggcaccctccctggggggaagcagccaggcagctggaacaggtcatatgggtgccccaaggggcagtaaggcatatttgagctatgtcatgaaggaagatgtggcgggagagaactgagcaagagggagatgcaggggaatgctgggcaagatagaggtggagccagatcgtgtaggtcatggactgcctggggatttgattgtaagtgtgattgagaggttttaaacaggagtggcgtgatctgagttattttctaaattgatcgtatgttctttttttttttttttttttttttttttgagatggaatttcactctcattgcctaggctggagtgcagtgatgcgatctttgctcactgcaacctccacctcccgggttcaagtgattctcctgtcgcagcctcccraatagctgggattacaggcatgcgccactatgcccgactagttttttgtatttttagtagagaaggagttttctccatgttgatcaggctggtctcaaactcccgacctcaggtgattcacccacctcrgcctcccagtgtgctgggattacaggcatgagccactgcacccagcctcttaaactgatcatatgatattggttctcaaccaagggtgactttgcccycagaggatacttggcaatgtctggagatactcagttgtcatgacttggacaggtgctactgtcacccagtgggtagaggtcagggatggtgctaaacataggacagctgtcaagagaaaagaatgtacccagccccaaatgtcagtagggctgaggttgagaaacccagctgtagctgacgtgtgaaggacagactggcggggagtgtggcggggcctgggtgcctatgaaaacagacagaggagaagctgttagaatagatccactgagcgcygaaggtaaactggacaaaggtggtagcaatgaagataatgaaatgtggttgacttcccaatgtattttgaagggagagccaacaggatttgctgatcagttttaatatgagatgtttaagactcagtcaagatgacacccaaggttttacatctaggtaaatagatagtagcattaacaaaaacggagcagataaagagaggactgggtttaaggggacagaggagaaaagttgtctttatcagccataggactagaattctagtgtccagatttccagacaaatctattttccactctccctattactccagtgtcagaaaacattaaattgccaggggactatgggctgagtgcccataaaaagttgaaggcattgtgcctagtaagaggccagatacttcctatggccacagaattagagacctaagggtagaggtgattttcaaggtgatcatgtgatacctgagcaccctctgcatcattgcttccaaataattgcgtggcatctgcatgatatttccagtgacaggaagccacctgcagacattcctgaaacgcagatgaatgcatggaaacagtaatctaagatctacctccccgcaactttgcatctttaagcctagttctggcctcccggataataatgggaaggaagctttcaaatgaacccctaacatgtgcatccctctttgttccttacccataatcttgcttccttggaaggcagctatgattactaatattttacaggtaaagaaactgagattcagtgagaacttgatttacccagggtcacatagttagcacgtggtctcagacttgaatcgagcgatttaatttttaagtctgctgctccatccatcaacacagtagctgcctttcacactttatataagacacatgcagcagaggcctcagaagccaggcttgggccgttcttttggttactggaagtcctctaattcatcaggctctagccatcctaaaaaggactttgacctaagcataagggacacacgtgagcataagattttggttacttagtagaatcagttggtctcttctcaactgcacagggttgagaaaagaccagaggctgtgtgccatcatcaaccagctcaactgtttttactgccaacccaaaatgaaagaaaaaggtaccagcacagtgttaaactgtgttgcctgactgtgggctgttggaaacagtagcagcttccacaggtggaatgcatatttttgagcaagaaagtttatgtcctttgtgttagagccctctcagaaggaagaaaacacttcttaggcactgtacatcctttaattcaaaatataccaatgtcttatccccattttcagattaaaaaaaaaaaactgaagctcatgacgattaagcagtttactatggtcacacagctggggtgctgtagaactaaaagatttaatccaaagttcatttactgtctttattaattagctcatgtaactgggaaattcaaggggtggattcaggtacagctggatccaggctgtcagacagcatcacgtggaccctagctctctttccttgactcctacctctcctttcctctgagctgacttccattttagtctttccccagaggtggccaaggtgaccattgggccacttaggtcatttactcacccctgtggctgggaggtgagctcagtcccaccagaaacacttgaacggaagtaaagaaggcaattcctcaagaaaaggaaaaagtactacaccctttcagactttgggcatgttatccatgtggtctcctgctcccatactgaacctgtgcaggaaagacagctcatcttcacccctttggagctcaatgcctggcctgggggagttgcttcagtgacagcctttctgagccttagtttcctcacctataaaatagagagttatggccgggtacaggccggctcacacctgtaatcccaactctttgggaggccaaggcaggagaattgcttgagctcaggagttcaagaccagcctgggcaacatagcgagacccgatccttttaaaaattttacaaaataaataaaaaatagagagttatatcagacgaccaaaatcctttccgtgaagctctgaaaacttttaattggtctttcagaatgtgtttaacttcttaaatttttaaatttattcatatgcttatatatcagagtttgaagtatttataaatagttgatttctcatgctgttggtcaaggtgaaaaagaaatctgtgatttatgtgcccgtttactttgtaactatatctattacttgtatatattagtaaacatatattattttctttattctgtctctgttggagtaatttggtctaaaacctggtttatttgaatggtgaaaagaagcgtatcttaattaaaataacttctcaaagagaaatgtttgtcagaaaaatgtaaacctttcctagcacttggaaaataaaaattctttattttgttctgttttaggactgtacgaaaagaatatatcactgcaaagtatgtagatcataggttttcaaggaagacctgttcaacttcatcagctaaactaaatgaattgcttgaggccatcaaatccagggatttacttgcactaattcaagtctatgcagaaggggtagagctaatggaaccactgctggaacctgggcaggtaaggcctcactaaaatcattggataaaaagtaatgtggaaaatcagtttaaaaggtgacttattttaacattataccatataatgagattcttatacattgggtggccatgtctaaatcaagagaatatgagagtgaaraggtgtgctccttataattacttgggggcaactgatatatatgaagcctcccttggcagagcatattattgacttacttatacttttctttccctttttaggagcttggggagacagcccttcaccttgccgtccgaactgcagatcagacatctctccatttggttgacttccttgtacaaaactggtatcgtttttgttttctctgttgaattacctgaatatgccttataaattaacacaaaccagtcctatcagtggcctagatcgggaattggcaagctttttctgtgtcatgctagatataaaaattatttttggctttgcaggcatgaagtctctctgtcagagctattcacttctgccatggtagtgtgaaagcagccactgacaatgtgtaaacaagcaagtgtggctgtattccaatgaaactttattattttgtttataaaaacagacagtgaaccagatatggcctacaggctgtagtttgccatctcttggcctttataaatgtaaaattatgtctgtatccaaaaatctgctgcacagattggacacatttgctaaccgttaggagaggttaaaagagagaagacttaacagcacaggtcaaccatatttgtgagttttcattgttcctaaatttaatataagacagcagcagtgtgtgtggctggatcaatagctcattcaagtttgggatatactgatggaagtataagagtgaatataggaagtttggacttgctggattctttattctctttatctgttctgtaagcaacagatgatgaggaggaactagagctcatctaaagaagaagatcaaaatagtgaggggatttgaacccatagaggaaaaatggtacatagacacaagccaaattgtataaaagtccaggtttcttcctcagagacaatatagcatagtggctcaaaacattggctccagagatagattacctgtgttcaaatatccctgcttcaccatccctatcttgaaaatcttgaaagcaagcacttcagcctctctgcgcttcagggttttttatctgtaaaagcggttattattagtatttaccccatcatatagttgtaaagattcaatgaactaatacatgtaaatgttaagaaacagtgtctgtcccrtaggacctggcactctaaataaatactgcctgttatcactgtattgcttataaatctaggttagaaacatcataattttctctattataataattaggtctcaaatttgactcagttgtcagcacaaaaataagtggctaatctatagttttaagttataaagtaagtcatttttttctaatcatcatctaatttttcagtgggaacctggataagcagacggccctgggaaacacagttctacactactgtagtatgtacagtaaacctgagtgtttgaagcttttgctcaggagcaagcccactgtggatataggtaagagtgtgtctagtgtcttcatgactgtagtaagcgtgtgttgcatggtacattgtaatttgattattgttccttgccttcttaaggtgtttcctagataattatgcaaattaatttttttcctatttcagttaaccaggctggagaaactgccctagacatagcaaagagactaaaagctacccagtgtgaagatctggtaagcaaaaatggacgtgggagatttattagacattggctgccttaaaagtgtcattctgagaagctagaattgaatattaaaaatgcagattcatttttttttaacacttgctaaagaaaatcagatgagcaatgtgctacattagaaaaagtggtaaaatgataaatttgtcatccacatgtttttggaatgcagttaaaggaggtgaaaggcattacacaagtattattaccagatcgacttgtgcattgaggtcatgctttttatttcccagaccattagactttctctgcagcttaatagtaaagaattatttgagaagctgctccaaaaattgggcaagtaaagctcagagagtagtggtcttcaaaatgttaacacactgttctcccagcccctccccttcctgtgcacattcaccttttttgaccctactagttcttgcttagcaagtcagggccttcacattagtgtgattctcttgagtttctgctaagtgccaggttccaggcccaccagttgggcctttttattcttaaaagaatcctttgagacaattatccctgctcccattttatgaatgagaaaatggggccacagattggactgggaccttaaaagcctacgtcttaaacttcaaagactcgttttgcctttcagccaggaatttgcaagtttgaggcccatttaataagaagaaagcttttaattttggagacaagtcatcaaaataaagaaggctctgcctgcaattgtttgcatttcttcttgagcctgtcacatagcagtgcagcttgtctaagcagagtgttgcctatagtacacctacagatgattcattgaaaactaggaataaggtgggatttgctcagtgtttgtataatattgggatgtttcagcatttaaattaaaatggtgcacatttgctgttccttccagctttcccaggctaaatctggaaagttcaatccacacgtccaygtagaatatgagtggaatcttcgacaggaggagatagatgagagcgatgatgatctggatgacaaagtgagtgtaaattatgtcctcgaattctcaacaactaccccarcttttctagtctgtgtagacaagatccatttttggtgagattgattgattgtggttttatgatccaatgtatcagggccatttatgttgttcagtccttattgggcaccatttaacagctatattaaggttgtccagagaaacagagccaacaggatagggagagagacagagaaattttttttaaggaattggctcacatgattgaaggagctgtcaagttcaaaatgcacagggcaggccagcaggctggaaatcccagcaggagttaatgttgcagtcttcaggctaaagacagtctggaggcagcattccttaccctttgggggacctcagtctttttaaggcctttctttggctgattaggtgaggcacacccacatcatgaagggtagttcccttgactcgaaatctactcatttaaatggtaattgcatctaaaaaattcctttacagcaacatctagactagtatttgaccaaacaccaggacactgtagcctgttgacacataaaattaaccatgaagctaggcatggtggctcatgcctataatcccagcgctttgggaggccaaggcagaactatcgcttgagaccaggaattcgagagcaacctaagcaaaatggtgagaccctgtctctacaaagtaaatggatcaatcaataaaacgtggtggtgctatttgacaagctgaggcaggaggattgcttgagcccaggagtttgaggctgcagtgagctatgattgtactactgcactcttgacctgaatgacagagcaagaccctatatcttaaaaaaaaaaaaaaaaaaaattaaccttcaaaacaagtaattagtaagtaaataacagttgttatttattgaacataatcatgcactgtataataacatttcagtccacaacacactgcatactcaatggggatcaatataagattaaaacggagctgaaaaatagccatcacctagtgatgccatagatgtcataatacggtagtgcaacacattcctcaaatggttgtgggatgctggtataaaccaacctactgcactgagttgtataaaaatgtacagtaatgtcctaggccttcactcacacccagagcagcttccagtccttccagctccatttatggaaagtgtcctacatagatgtaccattttttaatcttatataacatgtttttattttacctcttctatgtttagatacacaagtaattaccattgtgttacagttgtttacaatgtttagtatagtagcatgctgtacaggtttgtagcctgggagcaataggctataccatatagcctaggtgtgtagtaggctctcccatctaggtttgtgtaagtatactctatgatgttcgcacaagaacgaaatcacctaacacatttctcagaatgtatgcctgtcattaaggaatgatgttcattaaatatggattagacagatttaagcacttacgttatctcagatcatctttattgaaagtccataactgagtgctgtggctcacacctgtaatcccagcactttgggagggtgagacgggtggatgccttgagcccagaagcttgagaccagcctgggcaacatggcgaaaccctctctctacaaaaaatacaaaaattagctggccgtggtggtgtgcgcctgtggtcccagctgcccgggaggcagaggtgggagaatcacctgagcccaggaactcaaggctgtgatgagccaagattgtcccattgcactccagcctgggtgtgggtgtctgagtgagaccctgtctcagaggaaaaaaaaaaaaaagtacataagggacattgttatccccattttacagaagagaaaacttacaaagagaatttagcaacttgtctaaagtctcccagctagtaaagacagtttggaggattaaacccagttctcactgagttttccttataagcagttaactacctctgaaagttcattcatgcattaattgattgcctatgtattggacatttcctgtatcacaggcaggatgtaaggaatggccaaagaggtcctcaagccttaacaactttaagaggaaataaattataatacaatgtgataatcattataagagtatrgaaaaattcctgagagctattcagaggaccaagcagctgcctcagtctgccttctcaaggacattggagatgggtttctaaggataggtggaagcttgccagggaaagaagtggggtggaatgcatcattccagaacaccacgtgccaagggaaggagtcatggtagagtctggatgtcggaggaatggagagaagcactgtgtgtgagatgcattcacctggctgggtggggagaggcaggcagctgccttgtagagtcaggcaaaccagatcaggatggctttgtgggcaaggtttggcctttgggtttttgtgcaagcagtcagaagcccacagaggtttattgtctaaagagcaaggtttcccaccagctctggctgcagtgtggagaatggactggaggaaggaaactggagaaggggccattctggaggctagagctgcagtgggagctggtgagcacctgtactagraggggcttcaagggatatttccaargggaatgcaggaaccagggactccaggtgacactgaggtttctaacctgggcagttgagtggatcctaatgccatcaccacaagcgcaaataccagagatacctcatgggccattggtttggaacacaagtcactggggttgtatttacagatctgtaagtaattattgtgtagcgggcagtgggtgtgaatccgtttactttgcagggggatataaaatgagaaaagaggcaaagaaagaacttcaacgttaaagggttgagcagggaacaaaacttaatgtagcaaattagaaataggtggaaatactattcaaatgttgctgaaaaagtcctgcattctgaaggtgtttgcttattaaaagttaaatctacctgtgaccttactgtgcttctgacactgctgctgatcctaaccagtgtttcactagtgtgattattcatagtggtgaacgatatgaaagtgtggtatctagatccttcccttgtactgtgtcagcatcatgaggctcattgtggctgacctcataaagctcagagagccacaggaacccagattcccacctgagcccgccctgcggaggccctctgtacacatgaagggtggtccttgattattatctcaccttcttatttcatctgccagccaagccctrtcaagaaagagcgctcacccagacctcagagcttctgccactcctccagcatctccccccaggacaagctggcactgccaggattcagcactccaagggacaaacagcggctctcctatggagccttcaccaaccagatcttcgtttccacaagcacagactcgcccacatcaccaaccacggaggctccccctctgcctcctaggaacgccgggaaaggtatgggctttgagaagggcttgtgactccatcctcgaagggcttgtgactccatcctcagagctgatagtctagccagctttgaggtaagaattgcaaggtacatttgagtggcgcggatcgtgttgtcaggagcagcttgaaatagggaccatgccatttgccaggtaccaagagcaggacaggcagtgctgtgggctctctttgtgcattatttgtgttaaccttacaacaatcctgtgaagtatgtgcttttgtgcccattttacagaagaggaaactaaggctcaatgagatacactgaccagcccaaggtcacaccactggtaagaggtaaagttgagattcaatctgaggtccacgtggctccagaacctgtactttttrtaatgtggagtggagtttcagttctctggaaagttacttttctctacattaaaatgccactcttttgaagacgctagtaataatagtggtagttaatagttatggagcacttgccttatgagaggctctacgcctagtacttcttttgtaatcatctcaaaatgaggtaggtgctattatgcagttactggcatcatgtraattaggggatttgttcagagatactgagtaattggcctgtagttctcagcctgggattctaacccaggttctgtgtgaccaaagcccattctcttgtactctctaataaggaacatttttccagagacagtacttggagaggaattttttttttcccttgagacaggcctttctcagtcgcctccatctccggggctcaagtgatcctgatcctcccacctcagccttccaagtagctggaaccacaggtgtgtggcaccatgcccagcttttttttttttttttttttttttttggtagagatgaggtcttgctatgttgcccaggctggtcttgaattcctgtactcaactgatcctcccaccttgacccctcaaggtgctgggactacaggcttgagccactgcgcccagacgaggaatcccgctcataggagggttgttgtgctgtgagttgtcaaatgtctcacagggctggcgcctcaggctaccattaaagtgttgcctcagccagtagggataattgagaggtacccagagctatagcttcaagtttggtctttgccagtgaatccaaatgcagggttctccctgtgtgctcagctcgtgctcccacaggtttcatggcttctcgctacacaatgccatgcctatttgaatcacactagggctattttctgggaaatgtgagctttattcaaaacagtgttttttcagagcttattctctattgaaatagtgttataaatgggagctgtgttcttagagagaccccaaatggcctcatagatcataaagtaatagagaaaagttaaaataacgctttggcatgaacagctatcctcaaagataaccagtggccacacagtaatagtgcatgtaagccaaaggtctaacccaccagtgttttcttaccattccatacattgtactaaaatgtatgtttttaaatcactcacatatcaagctgcaggtctgtagtgtaagaatgctgtgttgctgcttccctgtgggtaatggcattccccatcagggtagcagtctgacagagagcagagattctctttctgcaccctacagaggactgtgagaagcctccagactgaatrcaataatggaaaaagtgactgaaagatttcacatctcctgagtgtggttaccaacatagcagtggggacctatctagacaggcacagcctatgcctgttcagagagcctctaggtcattgagagtcctgaaaatggtttataggagaaaatgacaccagagtcctgggggccaagagaccccctcatttccctccacccccttctgtaattttatctcaagggggacaacagaaacccataatatatactgtctgactttgtgccaggcatatctctcatgtcttgaataaattctaactagctctttaccaaagacccagaagacaaagactaaatttatttagtgttccagctgctgaaacaagtgtttgagacttggccacagcaaccgtggtcatctaaggatacagtactttccccacttcccccaaaaaaagcccataattgaaaatagaaatcctccctacaaaaaccaagagtgttcttcatggctgttcacagcaggacatcaaattcagagatttggcctgtctgctggtgagacatagggagtacagccttctcatgacttttataagggatttgaagtgtgcgatatcccatagctagctcagctcacatgcgcttacatttggaaaactgataatgtttagaatggagctcttagaagacattgttaaagatcagctgatactctgtgtgcagagataattcttctctgtttttttggcccctatgttttttttcatttccttctgttgagctgatagaaccatttgcatgaaaacaaggatgccttggatctctcatttgagttccttgttctccatgacaaataaagcagaggtctctatttgcagcagaagtcatttcctcaactgaatttaggggtctgaaggacccctaaattaagtcttccagtgagacagaaacagacacttgagataaagtccccacaaaagcgaagaggagaaagaattattctgaatctagctgagaatattttcaagaaactccagctgcctcatcgaaattcaaggaagcttgacctaaattaccgtcaagcaaagcccccttgtgcttacaagtgagcagtgccccagagtctcagaggagctcagtagctcagaatcccaaaatcactatcctcaagccccataccgaaacacttcgctgcctaacccctcttcagatgtggggtcccgagagactaaatcaaagctgtaaaattaatttgtgtgtggtagtttctcgtttgtgatcagtagcttccccctgcccccaccccacttctactgtacgtttattaacactggttcttggaccgggtgcrgtggcttacgcctataatcccaacactttgggagaccgaggtggccggatcacctgacgtcgggagttcgagaccaccctgaccaacatggagaaaccccgtctctactaaaaatacaaaatgagccgggcgtagtggcgcctgcctgtaatcccagctactcgggaggctgaggcaggagaatcgcttgaacctgggaggcggaggttgtggtgagccgagattgtgccattgcactccagcctgggcaacaagagtgaaactccatctcaaaaaaaaaaaaaaaaaaaaaaaaaaaaaaaaaactggtttttgaggcttgccaagattagtttctttttaacctttgattaagattaattaaaataatatcacagaacctaggtttatttactgccaccatgcccagctaatttttgtatttttagtagggacagggtttcaccacattggccaggctggtcacgaactcctgacctcaggtagtccacctgcctcggcctcccaaagtgccaagattacaggcgtgagccaccacacccggccaagcctgttaaattaacaaatgctctggataatgagaccgggcacttggtaggcatcttaactcaaagataggatgtgttaagtaaaagaatgataattccaatctcaagaaccttctttaacatgcttaaaagaactaaccttttaagcgtttagaaaggtgaacacctgatatgctaattacagttcattcccatctattcctgaagccaggcctctagaatcaggcattatatagcccttctcaatagcatgtgaatacctgtaagtattaattcttcatttcatacacatttgctataatgtagacttcctaccttagagaggctctggcttggaactaataaactagcagataacctgcacgaaagtagcgtgctgtgtggcatactgagagcgtcaatagatgcttgttgttgaagggttggtgccacagagaaaattgaaccagatgctacccttgccaacaggtaggtgaagagactaactactctcattaatcaaagtatatgcagtagtttgagagtaacaaactaaggcagatcagtctgtgtcaagccagaccatggctgcctagacagctgtgaactcctgagaagcctttccagcrtcaccttctcctcttccaagaagccttcttttccgtgccacacaaaagagactatggtggtcgggcgtggtgtctcatgcctgtaatcccagcactgtgggaggccaaggcaggcagatcacctgaggtcaggagttcgagaccagcctggccaatatggtgaaaccctatctctactaaaaatacacagaattaaccaggcttggtggcccgtgcctgtaatcccagctactcaggattctgaggcaggagaattgcttgaacccaggaggcagaggttgcagtgagccaagatggcaccactgcacttcagcccgggcgacagaatgagactctatctcaaaaatacatacatacatacatacatacatacatacatacattttttwaaaaaaaaaaaaaagagagactatgggccgggcatggtggctcacacctgtaatcccagcactttgggaggytgaggcgggcggatcacgaggtcaggagatcgagaccatcctggctaacatggtaaaaccctgtctctactaaaaatacaaacaaaaattagccgggtgtggtggaggacgcctgtagtcccagctacttgggaggctgaggcaggagaatggcgtgaacccgggaagcggagcttgcagtgagccgagattgtgccacttctctccaacctgggccacagggtgagactccgtctcaaaaaaaaaaaaaaaaaaaagaagaagagagagactatagttcttcctcataaggcccaatcctgccccatacttgtctcatcctaacattgagccaatcttgctgattttcagagtcttcaactgaaaaataaggattaggtgtctaccttgcttagagagcatgaaataatgtctatgaaatgactggcacgtagtgagcattcagtaaatacaagtttgttcaatcctcctgcatgttttcagtttaacaaacattctgggcactggaaatgtaaagaagaaggaagaagtacctcccactctcagggctccagggaaagaggacacagtataatgtgcccctggggccactagggagtattcctggaggarcaggaaagagaagtgctgttcacagcttcagagagaggattagggaagtcttcaatgcactcttccagttaggagcagaactcctcaaggataagggctgtgaatgagctgcctttgcatccctggcacagagagtaggatgctcgtcagtactcgtcagatgcataaacaacagcagaaagaatcagtgaaagcatgtcccagaaataggtggccaggataaggaggggacatttataaaactaaaccagatgtccacaggtgtgatagttgacttgctgaaaatytaataaatgcagcagttgtgcccagacacagctgtgtatgcattttagacatttctccaactttccttggagatctgtggcagtagataggaagaagagtagaaagggtgaagacttgctcagtatrtgacagcacctgccaccatgaaagtacactactgcatgattcagactcgcatgggaaatattttcctatcagtggtgttattcatatattgatgactttacagtttcctgcggttttttatctcatgggaagacagtcattagagtagcttgatattaaagcttctcataggctgtcacccttgattcgtgttttgttttagggtgtttttttcatttgggtttggtttgcatttgggtttttggcctttttaaatcctttccccctgtcctttgtaaggcattgcacgtgaatcacctagtgctggcccagagtatcatctgtgatttttgccctgaatagtgaccttgactgaggctctctagctaagtcacctgactgccaggktgtggaaagggaagcagaggaaatccttgttgtgcctctggcattcaggggtggatgagttaattgttaaagaatcagccctaagtctctygaatcctggtactttcttcttaattatcagtgtcatagaaggaggtggaaggacagatggatagctaatgctgtttcctgtgtggaagtcagttgacagagcaatgtggcacatatcatgcccgggcaccagcctgtcctgtaatcctggccagccctgctgacttacactagtgtcccagcrcactctactccaccatgcctgtttctccatctgaatgtggagataacagctcctccgttctacactgagtccttctttgtataawtatacggttaattactttttaaagtarttaacttaagctttccactcttttaagctttatactatgaaaaccattagatcagttaggaggaataagttcaagagatctgttgtacaacctggtgcctgtagttaataacgtactgtattcttgaaaattgctaagagaatagattttaaatgttctcgctacaaagaaaaagatgcatacgtgaagtaatgcatctgttaattagctcaatttagcaatttcacaatgtacagttatcccatgccaaaactccaggaatgctcaagtgccttatataaaatggtgcagtatttgcatataacctacacgcattctcctgtgtactttaaatcacctctagattacttgttatacctactacaatgtaaatgctrtgtaaatggttgctatactatattgtttgtttgttgttattgttgttggattgttattttttattgtgagtttcttttttctgaatatatttaatccagggttggttgaacctgcagatgcagaactcccagatacaaaggtccaactgtatacatattttaaaacaatatgttatacataataaatatatatgttatcaattaaaaataaattgaaaaaagaaaactattagaaagtgataaaatcttcatgtatattgtcccaagttggatagatataacttttgtcattacccttcctatgtggcagcttagaatgtgtaaattatgtttctacagacaactttttcagaaactgtcaagataatttttaagccatcttctaggtctttttttttctttgaaacttcagttatacttttatttggtctcccagtgtaagagacttttggtttttctgtgtgtaactaaaaaccagatatacaaggatattgaaaaaacatcctcctgacttacatcatgaattatctttatagtcgttgtttgaaatgcttgtttcccagtgccataaagaaatagcacttgaacataaatttaattttttcagcaaggccgtttttatactttctgtagaaagggtatacttgccagcagttttgccacgagagtacactgaacaaatgagacaggatcatttataacctgacgtgtccatcctattgctgtgtccagtttccattggctgttttgtatttgtcctgattggctagtaacttagaactttttaaaagagttgcaaaggcagagaacaaaggacggaggaagtaacttgtggaatgctgagaaaggtaaaaacaccttcaaataaggaagaggaacaggccatgacctaatgcttgcttgaaccagtataagcatgccagggcaaagattcaggctaaattttgggaactaagaacataaagtacattgatttctttattatggctagcagagatttaaaaatgttagcacaggtctttgaataaattttacttctaagagaagttactatttattcctaattagatggggaggaaagtctttgaagaggaacctctactgtactttttcagttgtgtactgagtacccagagcatgccgggccctggcaggagagctgtggagacagtacagatcatgccctatggatgcacacagtctggaaaggaagagaaattgtagctgtaatgtatggtagagaatatccattaagccctggaagctcagagataagagtgggtattccagggaagaggggatggattagagaaggattctggatgaagttacatttgaactgacccttaaaaaaatgaagatgtaaccaaaacctgtgggatacagtaaaaacaatactaaaaaggaagttcatagcaataaatgcctacatagaaaaagaaaaacatcactaggtgcagtggcttacgcctgtaatcccagcactttgggaggccgaggcaggtggatcacctgagggaggtcaggaattcaagacccaagaccagcctggccaacatggtgaaaccccatctctactaaaaatacaaaaattagctgggcgtggtggcacacgcctataatcccagctactcgggaggctgaggcagaaaatcacttgaacccgggaggcagaggttgtagtgagccgagatcgcgtcactgcactccagcctgggtgacaagagcgaaactccatctcaaaaaaaataaaaaaataaaaatgtcaaataacctaatggtgcacctcaaggaactagaaaagcaaggacaaaccaaatccaaaattagtaaaaggaaagaaaaaagatcagagcagaaatatataaagttgcaactgaaaagacaatacagaaaagcagcaagtgttgtgtttttttgaaaagatgaaaaaaattgacaagcctttagctagacaagaaaagaagggagaagacccaaataaataagattagaaatgaaaaaggaggctgataccacaaaaatacaaaggtcattgtaggagactattataaataatgataggccagcaaattaggaaacctagaggaaatggacaaattcctggaaacaaccaccaagattgaaccaagaagaaatagaaaacctgagcarattaataataagtaacaacattgaatcagtaataaaaagcctcccaacaaagaaaactccaggaccagatggctttattacttgaattctgccaaatctttaaaaaacagacagctaggctggatgtggtggctcgtgcctgtaatcccaatgctttgggaggccaagtcaggaggctcacttgaggccagaagtttgagaccaatctgggcaacatggtgagaccctgtctctacaaaaaatataaataaaaaattacttgggcacggtggtacctacctgtggtgctaactatgtagaaggctgaagcaagatgatcacttgagcccaggaggtcaaagctgcagtgagtcaagatcacaccactgcactccagcctgggtgacagagcaagaccctgtctcaatcaatcaatcaaatagtaaagaaaaactagcaccaattcttaaactgttcyaaaaaaattgaagacaaaggaatttttcctaactcttccaatgaggccagcattgccctaataccaaaaccagacaaggacacaacaaaaaawgaaaactaccagccaatattcttgtggaacgtagatgcaaaaaatcctaaccaaatactaacaaactgaatccaacaacacatcaaaagataataaaccatgatgaagtgtgatttatcgcagggatgcaaggatgtttcaacatacgctaatcaataaatgagacacaccacatcaacagaatgaaggacaaaagccatatgatgacctaaatggatgcagaaaaagcatttgataaaattcaacatccattcataataaaaaccttcaataaattaggtatagaaggaacatatctcaaaataataaaggccgtatgtgacaaactcacatctaaatcatcctgaatgggggaaagctgaaagctttttctctaagaactggaagaagacaaggatgcctgctttgaccactcctgctcagatagtgctggaagtagtcctagccagagcagtcaggcaagagaatgcaataaagggcatccaaactggaaaagaggaagttaaattgttcctcttttcagatgacatgatcttctatatagaaaaacctaaagacgtcaccaaaaaacacatttagaactgatgaataaattcattaaagtgacaggatacaaaatcaacatacaaaaatcagtagtgtttctatacaccagtaacaaactagctttaaaaaatcaagaaaaagccgggtgtgatgcttcatgcctgtaatcccagcactttaggaggatgaggtgggtgcattgcttgagcttaggagttttgagaccagcctgggcaacatggtgaraccctatctctgcaaaaaaaaaaaaaaaaaaaattaaccaggtgtggtagcacatgcctgtagtccccagctagtagggaggctgaggtgaaaagatcgcttgagcataggaggctgcagtgagctgtgattacgctactgcactccagcctgggtgacagagaaagaccctgtctcagaaaaaaaaagaaaaattgagaaagcaatcccttttacgatagctaccccccaaaaaactaaaaaacccaggaataaatctaaccaaggaggtgaaagagctctgcaatgaaaacttataaaacagtgataaaagaaattgaaggggacaattaaaaatggaaagacatcacatgctcatgattggaagaattaatgcagttaaaatgatcatactaccaagagcaatctacagattcgatgcaatctctttcaaaatactaatgacattcctcatagaaacagaaaaaagcaatcctaaaattcatatggaaacacaaaagacttcaaatagccaaagtaatactaagccaaaagaaaaaagctggagtcattacactacttgacttcaaaatatactacaaagctatagtaaccagaayagctttgtattggtgtaaaaacaaatgcatagaccagtggaacagaacatagaacccagaaataaatccacatatttatagccaactgatttttgataagggtgcaaagaacatacattggggaaaggatccttctttaatttgctgagaaagctgggtatctctcaactcaagatgaattaaagacttaaacataatacccgaaactataaaactactagaagagagcataagggaaacacttcaggacattagtctgggcaaaaattgtatgtgtagcacatcaaaagcacaggcaacaaaaaaatagacaaagcagacgatatcaaactaaaaagcttctgcacagcaaaagaaacaatcagagcaaagagacaacctgttgaatgcagaaactatctgcaaactattcatcttacaagggacttgtatatccggaatatacaaggaactcaattcagcagcaaaataataatgataatgtgattttaaaatgggcaaaggatctgaacagacatttctcaaaagaagaagtagaggccgggtgtggtggttcatgcctgtaatcccagcacgttgggaggccgaggtgggtagattgcctgaggtcagggcttcgagaccagcctggccaacatggtgaaaccccatctctactaaaaatacaaaattagctgggtgtggtagcatacacctgtaatcccagctactcgggaggctgaggcaggagaatcacccgaacctgggaggcggaggttgcagtgagccgagaacacaccattgcactccagcctgggcaacaagagtgaaactccgtctcaaaaaaaagaaagaaagaaagaaagaaagaaaacacgacatataaatggctaataagtatatgaaaaaatgctcaacatcactaatcatgagagaaatgtaaatcaaaaccacaatgagatattatctatttccagttaaaatggctatcatcaaaaagacaagaaataacaaatcctgatgaggatgcagagaaaggggaactcttatataatgttggttggaatgtaaattagtacaggtactaatgaaaaacagtatggaggtttctcacaaaactgaaaatagcactgtcataccactgagcaattctactactgggtatttatccagtgcaaaggaaatcagtatattaaagggatacctgcaccccatgtttaytgcagtgctatttacagtagccaagatatggaatcagtctaaatgtccatcagcaggtgaatggatgaagaaaatgtgtatatatacatatggaatattattcccataaaaatgaatgaaatcctataggctgggcacaatgactcacatctgtaatcccagcactttgggaggccgaggcgggtggatcacctgaggtcaggttgcagtgagctgagatcatgccactgcactccagcctggacgacacagcaagactctgtctcaaaaaaaaaaaaaaaaaaagaatgaaatcctttcatgtgctacaacatgtatgaccctgaaggacattattttaagtgaaataagccaggcacagaaagataaatactgcatgttctcactcatgtgggagctaaaacaaaacaagaaaagctcaagcctggacaacatagcaaaaccccatctccacaaaaagtttttcttaaaaaattagctgggcctggccgggcgcagtggctcatgcctgtaatcccagcacttttggaggccacgatgggcggatcacgaggtcaggagatcgagaccatcctggctaacatggtgaaaccccgtctctactaaaaatacaaaaaaaattagccaggcgtggtggcaggcacctgtagtcccagctactcgggaggctgaggcaggagaatggcgtgaacctgggaggtggagcttgcagtgagccgagatctcgccactgcactccagcctgggcaacagagcgagactcagtccaccaaaaaaaaaaaaaattagctaggcctggtggcgtacacgtatagtcccagctactgggcagactgaggtaggaggatcacttccagagccccggaagttgaggctgcagtgaactgtgatcatactgcagcattccagcctgggcaacagagtgagactgtctcaaaaaaaaaaaaaaaaaagcttatattagtagagagtattgagcttatattagtagagagtataagagaggttattagagttctgggaaggggttgagcggaggatgaggctgattaatggatacaaaataacagctagatgggaaggataagttcctgtgttctgtaacactgtagagtgactgtggttaacagtaatttggtgtatattttcaaaatctacaagcaaggattttgaatgttcacaacacaaagaaatgataaatctttgagatgatggatattagctaccctgatttgatcattacacattatacacatgtattgaaatatcactatgtatcctataaatatgtacaattgtgtcaactaaaaagtttttaggcctggcaccgtggctcacacctgtaatctcggcactttgggaggccgaggcgggcggatcatgagatcaggggtttgagcccagcctaggtggccaacatggtgaaaccttgtctctactaaaaaaatacaaaaattagccgggcgtggtggcaggcacctgtaatcccagctacttcggaggctgagacaggagaatcgcttgaacccgggaggtggacattgcagtgagctaagatcatgccactgcactccagcctgggcaacaaagagcaaaacttcatctcaaaaaagtgtytaaagatgagaatgtggaagtgaagtgataactcagttatgtccctgaaagttctagccggaaaggatgtgatgccatttagaggaagggaagcaagctgttgtcaaggctgagagtctggccttgagtcagacagaatggggttctgcctggacgtagctgctcatttgctgtgacttgccaagttcctaaaccctctgagccttgggtctttttatccttcaaatggataatgtgacaataatgataatattttacaagataaattttaaatactgtgttttagctcaagcacataatactcagtaaatggtagctccagaaaatgcaagaagaggaggaagagatttgaaaagcatgctgattatgattttaggaattaattttcattttttaaggtatatttatatctatttaggtataagtgaatgaatttccaggacattttttctgggctaagtggagagattgccttgctgagtactgttkggggagatattctyaaaccaccttcatagtttaagaatatatcgatttcccataagggagcttcagtgagaagagaatgtcagttcctgggrgagtctcaggagatcgctgccactttttgagagactaaattgttgggcccaggaatgtgggacaagagctttggcctgaaaactgcccgtgggcctgccagggtgarcatagtcacttctgcaatacactgcctgggtgcacttcctgagccctggctgtatgccgggcacacttctgacatagacctcagacagaggcatccccgaggctaaggacgttgaggtgctctggcagcacatcaggtaggttcagcggcaaccacttgagttgaaggcacagcagaatgtccaaatggagtgaccaagaggctgttggagatgtgggaagggacccaggcatagccagggtcagggatggggatgctgtctgtgcagggagggccgttaacaagggaggacggtgaagaacagatcagaagacacatttagaacccctggagaacagggcaggtgaggagagaagccacagagcagagtgccttgaggacaggcctgtgtccagagcacagcacctgatacccaaaagaggacccagaagtgcctccagaatgaagggtggtgagaacaggcaccagtgggtgtccacaatacagttttcaaggactttttttttttttttttttttttttttttttttttggagactaactgtcactctgtctcctaggctggagtgcagtggcatgatctcggctcactgcaacctccatctcccgggttcaagcgattctcctgcctcagcctcccaagtagctgggattacaggtgcatgccaccatgcccagctaattttgtattttttagtggagacagggtttcattatgttggccaggctggtctcaagctcctggcctcaagtgaccctcacgcctcggcctcccaaagtgctgggattacagatgtgagccaccatgcccggcctcaaggactttttctgatcatggattatttaaaaataaatatgtggcttgccttctcaccctgcagaacactagtcctgtcatccatctctgtttaagggcagggaatgctttctcgtggaaaacacatgctcctagatgattcagcttctttgaatgtgacagctgatgctaaactaacatgtaaaccctcaggaagaatgaggtgtactctacttcctcttagaagatcttctaattatttaacctcagatttattcatagaagctttggaaggctagacccatgtttttaagaagatatagacattatttcacatggtagccaatattagtggcaagtgaggtttggggcactttcttgttacttccacaggcctctggcagagttcaggagagaaaattgcctcttagtcacctctgcatctctgtcaccactcactaatcttgcctccccacccttttttgtgttgcgtttgatgctgtgttccattttattttgtttcagctttctttatcttaccagaattgcttttttcctgactgaaccagtactcagatttattttgcataaaagatcccttttaatgctgtgggactggttactaattttggaagtcttctgagctctttaaatcttcaaacatttttttaagtctgcatttctggggtcttatatatagtatttttcaaccttattttacctcatgtcttcccagccaagattttgtagcatcttcctttctgtagcttctactacaagacaatagataggtctgtctgtgtgtttgttttccaagtgtaagattataaacttgaatatcccttttcacacttaacactgttccctcctgctaattctccccacttgtttctgatcagtcaacctaagtgaaacrtattggcctccttaagaattactggcctggccgggcactgtgactcacgcctgtaatcccagtactttgggagtctgaggtgggtggatcacctgaggtcaggagttcaagaccagcctggccaacatggtgaaaccccatctctactaaaaatacaaaacttagccgggtgtggcggcgtgcacctgtagtcccagctactcaggaggctgagacaggagaatcccttgaatctgggaggcagaagttgcagtgagccgagattacaccactgcactccaacctgggtgacagagtaaagctctgcctcaaaaaaaaaaaaaagacaaaagaatcactggccttaggccaggcatggtggctcacgcctgtaatccaagcactttgaaagactgaagcaggtgaatcacttgaggttgggagttcaagacctgcctggccaacatggcaaaaccccatctctactaaaaatacaaaaattagccagacgtggtggcacacatctgtagtcccagctacttgggaggctgaggcaggagaatcacttgaacccaggagggggaggtcacggtgagccaagatcacgccactgcactccagcctgggcgacagagtgaaactgcgtctcaaaaaaaaaaaaaaaaaaaaaatcactggcctaaaaagatagaagtagtggttgagtcttctatttattcagtaaatatttactctacacgaaaccagagaaaagcctggccctaatacaactctcccagtcttatgggagagtcaggtaacaagtaagtaaacaaagacttaattagagattatactcagcaatatgaaggaagtcagaagtatataagggcatgggacgcacaattacttaatttttgaaatgattcaggaggttggattttacatggtttatggttacaggatgcctctttggtgtaatctctcctacagtctcatacatatataatgcagcgttgctcagagacatggctccattagcattttgtctttgacaatttttgtttcctagcagggaactgcatctgcatcagaaagtccctagatggcgataaagatgaaattgctagagaacctcrccattgtctattatctattatccatttatttccaaaaggaaagttacacttcctgatactgagcatttgttgttgttttcctcatatgccaagcacaggaaatgctgctctggctttcaggaaccagcagcatcatttgatggggtgagtgcctcgccagtcctggacacctgccttatcccagctctgcccctcatggcttgtgactttaatcatgcctctgagttctcggctgcaaaatggggacaatactacctgacccacatacttcacagagttagtatgaaaatgaagaggtacaactattcgtatccataaacattttttttttttaaatttagactaggcgtggtgactcacgcctataattctagcactttgggagggtcgcttcagctcaggagttcaaggccagcctggacaacagagtgagactctgtctctactaaaaatttaaaaatttttaaaaattagctggatgttatgatacatgcctgtagtcccagctactcaggaggctgaggagggaagattgcttgagcccaggagatcagggctgcagtgagctgtgatcttgccactgcactccaagcaggatgacaaagcaagaccttgtctcaaaaaaaattttttttaacgataaacctagggaagaagctgaggaatagcatatataaacacattttgaaaactacaaagcattatacagatgcaaggccataataacaatctctgtattgttacaaaaataaaatagtttctgaaaactgctgtgactgacaccctaattaagtgttgatttggggtaagcatcaggcttccattgtgtaatagaattacgcaatgggacaaagatgtaaattatatagcctggcaatttaaacctaaagcagatgataattttactgagattaacagtatttactttcagaactagcctatcttatagaaataatggtttaagtcaatattggtagggactagtaattgacaatgggaaataggaaagcttactttgtaccaaggaaagaggccagcagtaattagacttttttttttaatatgaagagtgtataaagctcttttggagcccttctggattactaggtatctactaatctgtgttaaacattcagtgtggcagtgttcttagctttctttcttttttttttttttttttttttttgagacggagtctcgctgtgacagccaggcaggaatgcagtggcatgatctcagctcattgcaaccgccacttcctgggttcaagcgattctccagcctcagcctcccgagcagctgggactacaggcgtgcaccgccacacctggctaatttttgtatttttagtagagacagagtttcaccatgttggccaggctggtcttgaactcctgacctcaagtgatctgcccacctcggcctctcaaagtgctggagttacaggcgagagccaccgtgcctggtcctagcttttttttcttaacgtttacagaagcagtttgccatgaacacagttaaaccatataccttaaataaagcaatagtagtgaaagtgcccagcatggaatacctggcacacaccagccacttcaatgtcactttgaataaacaaaactaagatcaaatacactactcccttaacagcttttaaaaacgaaccccatttttgtgtgtatgtggaatattactatcattcctgctgtcttgtctttagctctggagaaagttgagtcttttttttagtctataaaaatcagtgtctatataaatgttgttcaggcttccaatataacagatggtttggtttctagagcaaagggtttttggatttctcttttttctaggtaatgctttacgtccagttctttcttcattatttagaaaagccttaattttttttttttttttttttaagaaaagcgtcaggcagtttgctgactagaagaaaaagttgtagaaagaaaaattctattatatgaatcatttcatgtttcagcttgtggcccagtgaaggcttagcctgtactctgttctttctctgttgattttgytggtagtggtgtgtgatttctccttcagtaggttctgtgatggttataaggagttattgttttaagatgtgtgtgtgtgtttgtttttcccattgtacctaaatgatctaaactcagtagcattctgtgttgactggcattttgttcctaaaagcacacactcttcttacctttgttgtaaatttttctctgttgcctaggctggagcgcagtggcataatcatagctcagtgtatcctcgaactcctgacttcaagtgatcctcctacctcagtcttccaagtagctgagactacaagcacacaccaccacacctggctaattttttaaatttttatagagatggcgtcttgctgtgttacccaggctggtctcaaactcttggcctcaagcaatcctcccacctcagctttctacagtgcaggggattacaggcatgagccactgcacctggccaattttattttttttttaaccaaatttttgaaaccctacttgtgagttattaggttgatggagttagccatatccagccttttgcttttgtctctgtgtgtcataccacattctgatgtgtggaagtgatttcatactggctgttttgtatctgtgagactgggattaatcttcctgcccccattcaatttcctttctaggtccaactggcccaccttcaacactccctctaagcacccagacctctagtggcagctccaccctatccaagaagaggcctcctcccccaccacccggacacaagagaaccctatccgaccctcccagcccactacctcatgggcccccaaacaaaggcgcagttccttggggtaagttatcctaaagtcagggccaaagctgctggggccaggcagcgtgtggggctccactgggcagtggcctgttagcacattcagaaagtgtgccaaaatgcacacacatgctgggtgctgactygggtatatatgacatgattctacctgtctcttaagggaaaggaacattttgaaaaatatttaggccattaaaaactaaaaggtgctgagcacttcctaaatcttactcaattataatagcaactctgtgaggtaggtattattagtctcgtttatatataaggaaacagaggctcagaaaagcaaagtaatccattttcctcacaacagccagaatggttttcttataaagtgtaaatcagctcatggtcacttttctccttaacacccttttgagatttccttttgagcttcagataaatgcaagctccctatatcaaggcccacagggccctgcatgatcrggctcttatctcctagaccctctcctgccactctatcttcagggctggccttctttcacttcttggatacaccatcctctgcctcctgagggccctcccactccctggaactctgtcatgctttttgaacagctgcttccctttcatccttgagttctcagccagcatgtctatctcccccgccctccaacgcagcttcctccctacctgttttcccccaaacaccttatcacagaatgtaagccgccccactaaaatgtaagctccatgagagccagaaccttgtcttggtcttgttctcaccagtgtttactggaaccacrcctggcatacagtgaatattcaggaatcacttgagaatgaataaatttgcccagagtcagcttgttaatcatttcagtgacattgactgcacatgacaaattcccatctacaagggacataattcccatctttactactagcctgctagcgacttaggggtcaccccatcacgaaacagggtcttggcccgtgacagacactcacagaagctttgctgaataaatttgttagtttgtgtgtctcacctcttcctgctgtggagtttcattgtggctttcttcatattttttgtgttttgagttttgggggaaagttatattgtcccgttgctgattgtcacctgttcaccatctggcccagacaccccgggttatgtgtgtgcaagcatgtgtgtgcatttagccgttcattctctgactctgtttgcttacttgaggcacttactatgccccttgcttgggccttctcagtccatatgctcgtggagttcatggtctaatgcaggacacacgtgggtaagtcattagagcacatgttctttactatcaggatagacatgttgtctaaacactagaaatgccagaaaactgaatgtcagactttagaggaaagccagggaaggtttagagaagaggagacattggagtttggtgttaatgaattagttcccmcaagccaggcaagaacaattgaggtgtgctagcacatatgtacataaagactaaggatgtccgtgacattttcagaggctgctgtgtaaggccttcgggatccccagatttcatcaaaaaggcctttcccccaaataacattccatgaaagtcacaagtttcacatcagcgtttcatatcacaaattaacctcctttccaaatttctctttaagttttaatcctcttgtttaagtggctttatttcttaaggtttgaagtgcctttattcacattgtatagactcgaacattcctcaaataaatttaccaaatttctgctttctggcttgaaaatcatcacttttttagattttcacatcactcaagagcaagactagcagctggccgtttttccccccattgttgatgggtcagggagcattttttattaaacaaaatttactttaaaagagtgcctgacagtgagctgggagccttataaccttttccagatgaggacgctgttctgtctgtcagtttctcaccagctaagagcctctcacctacaaccagccttgaaggacaaaaatcatcatctgtcctcggccacagtgacagttcgccacatggcatggacttttgattgttgaaatcaaaattttaaatttaaaaaacaatttaaatttttttttaaattttgattttagaaagcatatgttggtgtacatgcatgtatgtgagatatactgtctacagacacaggtcagtaatgggcatgtatgtgtgggtgcattcatacacggctggacttctccttagaaaggttatagttgctctgctcctagtgcttgaggtctgtgttgtattattactgcttggttttatcccttccccgcctcctgctgacattgtattgtagaagccaaaggcagggcccagacaggtcatcagcaaggcacttaggggatcaaccttctaggcaaccttcctctctgatgcctgcagctttcgtctgtggacgcacctttccaacgctcttatgttcccctaaacctctcatctctcctcagcccatgaggatcagggcctttgaactgtgagagatcaggactgggaggtagacaccaggcaygagcaggtagtaaaagaacagccccttagctctcaccaggccttacctctccacccccaaagctgaacatgtctgccatcttgaggtacaccacattccccaaagttctatttttttctctcagatctgagcctttgcttacagtatgccctcaacctagaatcttcttccctctacttctttatgttaatgtttagtcatctttcaagatctgctgtcctgggatctacttaaaaggccttttgcagtccagtaaaactccccactccccacccttttgtccccactggtgtagtgggtatcacagtggctgtttccttgcctgtctttcctagtacatgaactccttctgagggcatgtgctgcttctctcagcagagcaaagtgctctaaggtgaactcaagtgtcatactgtctggattctcattccatctctactactcaatagccttgtgattttcagcaagtatctttgaaatgttcagtgccaaagcttctccaactataatatggggctagtaatagtgtctgtattgcatatggagttatgaagattaaatgagaagaacacataaaaagcaaccaaaaccataggcagcacccaataaatgatagctactgttaccattattctcagcctagcattttgctggatagctagagatgggagaaacctgcattmgtttcctgaggctcctgtaacgcataccgcaaactggatgttgtaaaatgacaaatttattctttcagtattagaagctagaggtccaaaatccagcagggttttgctccctccagaggccctgtgggaagaatctgtttcttgcctctctcagcttctggtgactccaggtgatccrtggagtggtgcagcctctgccttcatggtcatctccccactgccgccgcctctctgtgttctcagaactgcctttgcctctctctcataagtgtacgtgtgattgtatataggacccacatgaattttctgtgataatcttgtctcgggaggccaaggcgggcggatcacttgaggtctggagttcaagaccagtctgactaacatggagaaaccccatctctactaaaaatacaaaattagctgggcatggtggcgcatgcctgtaatcccagctactcgggaggctaagacaggagaatcgcttgaattcgggaggcggaggttgtggtgagccgagattgcaccattgcaccccagcctgtgcaacaagagcgaaactccdtctcaaaaaaaataatctccttgtctcaagatccttaacttaattatatttacaaagaccctttttcctagtcaggtcacatttacaaattccagggatcaggactcgataactttgggtggccattattcagcctaccacagcttgtcctctgacccccaaagagtcacatccaacccacatgcaaaatatgttcacccatcccagcaacctcaaaagtctcaaacccctgtcttggccattgttttttctagtcttcagagaagatgtgagctgtcatgtactcctctccccactgtgcctaggatttcctcctccagattcacaggggagatttgggggtaatagttgttgtcagcagctctctattttttagatcaatgggttcacgctgatcgcttgcctaacattaaatatggaatcaaacttgtaaagtaggcaagactcgaggcctcctgtcccaatctgttttaggccacctgttcacaccaccactctgttgtacccaccagtctcactagccatccatacagcagcactggcatcactcccatgacccctccctgcagcacattagcctctttcctcagccaggtggaggtttccacctgtcaagttctcttttttttatttcgaaacagactcactctgttgcccaggctggaatgcagtggtgcagtcccagctcactgtaacctccaccttatgggttcaagcaattctcctgcctcagtctcccgaatagctgggattgcaggcacccgccacmatgtccagctgatttttgtatttttaatagagacggggtttcaccatgttggccaggctggtctcaaactcctgacctcaagtgatccacccatctcggcctctcaaagtgctgggattatagtcatgagccaccgaacttggcccacctgtcaagtgtgaagcctatacccctctttggttccccgacatttgtgtttctggtctcaggggcacctctgacattcagctcctttgcagagtagccatggctgacaggtcttggctctgctgatgatcacactttctatgctgatgattagccccgcccagtcccccatgctgacctttaagaaggaggtagaaggtggtttaagaaggaagtagatgttgcatttagccttggaagatgartggaataggcaggaggaaataagcaaggcagctgatgttgagtgttttgtgagaacgagggccagagatcataacctttaatgcatctacttcacagaaggccacacttccttcattacaaagagtctgtctttccccctctcaaattccatttcatgccttcataaactcctttttctttgtttttgagrcagggtcttattctgtcacccaggctggagtgcagtggcktgatcatagctcactgcagcctccacctcacaggctcaagctatcttccyacctcagtctcctgagtagctgggactacaggtgtgcaccaccatgcccagctaatttttgtattttttgtggagacggggtttcaccatattgcccaggctggtctcaaactcctgagttatgtgatccacctgccttggcctcccaaagtgctggagactaccggcatgagccaccacacccagcccatraattcttaatacaggtttatggcttgtaagacaaaagaaaatgacaattcattattttagaatcttcggataaaaaactacgtacgtaatattttataaggccatcacttgtaagtgcctcacagagtgctgggcattgtgttgagcacttcgcatrtgttaacgtacctcattcttaaccatggttacacagagagaaaatgctattatctcaacttcggggcgcagaaaggttaagtgatttacactgtttctcacagctagtacgksggggccaggattcacctgcagcctgtgtggctgagagccagccctcctcaccctctccacgcaccactctgtgctcgcaaaatgcaggcccactggccatttctcctcacagcagtggtttctgtgcccatgaagctgaagtgtggagaaggcgatcaacttagcatggttctcctggcaagcagcacaagctctgctggctgtgcctccttatccatctgcagcatggcaccctggtatgcagctcctgcgctgcccaggctgggagggccaccccaggctttttccctgccagaaccacaacatccacagtgcccaaaatagccccagcrttacattactgaagtcctgcttctgtgatgaatccagccatctgtctcaggagacttctaaggcaggcttttgatagcaaaacaaatagtcctgtggacagatttgggttttgtagggaatttatgatttttgaagttgcatttcattgaacctctttcctttttttttttttttttttyttaaagacaacgtcttgttctgtcgcttaggctggagtacagtggcacaatcatggcttattgtagcctcaacctcccgggcccaagtgatcctcccatctcagcctcccaagtaacttgggactctgggtgcgtcacaccacacccagctgattttttaatttttgtagagacaaggtcttactatgttgcccaggctggtctcgaactcctgggctcaggtgatcctcctgccttgacctcccaaagtgctgggattacaggcgtgagcctcttcacccggtcctcctctttctttaataacctactttataacagactaacacatattttaacacaatttaaataataagaaatgaggacaaagggagaataaaggtagcaaagtaaggtgaattccaggagtgtgatttctccacaaaatgagtaacaaaaagtcacatacagtgtctggaagtgggccacggatttgaccctaagattcttacaggcaagagcaaagagagaaatacaactaattgttaggttcatggtagccttaagactgacactattctaacactcttgaattaatacctgataacaatttcccccctcccctggccctccatcctttggcatttagagaagtgtctgcagtgcacgtgggaaaccataacatgcactgaaagaacattccagaagcccaggttctgatccaggttctaccaatccctgacaaagtgacctctgggaatcacttacattcctcatctttggtcactgggagttagaattgtacttttatttaatatagagcaaataatggatgaaaaactataccaaaaattggtttactgcttatatttcaggcctgggacttccaggtaaaaaagctccatagatgaaatgtctgagacatgcatatttacttattttcttttcttttcctttgtttttttgttttttcttgttgtttgtttgttttattacatatctacttattggaagtgggactgtcattgtcccagttactgatgaggaaattaggcacagagaagtcaaatgacttgcttaagatctcaaatccaggaactgcagaagtgagatttgaacccatttccaactccaaggcctgtatagtaattcactattccagaatactcctgtagcaacctggccattcgctgctgagccaatgccccctctctttccacaaactcttctcctgtagcttcgaagctatggtaggtgaccaggagtcttggccacacttcttccattgcctgcccaggaggtatctccaactttctcttacacacatctgtatgatacactaagacctttttccaaattgcacagagagagaaaaagggattgagttgcttccatatttttgctgctcattgtcctcttttcagtactattttattttcagaattttttctagccacacttttcttctcaagcacagcaggtagcctttgcatagctatgagagtgacaggattcttgtcaaccagaccatagacgcctacccagccaggtgtaagaaggtccgctgtgggcagagaagttgatgagccagcacggtcagtcctgtctttcgctagcagggactattgactgctctgtgccagacattttgttaaaaagtggtgttatcggcctggcgcagtggctcacgcctgtaatcccagcactttgagagaccgaggcaggtggatcactcgaggtcaggagttcaagaccagcctggccaacatggcgaaaccccatctccactaaaaatacaaaaattagccagacrtggtggcgcatgcctgtaatcctagctacttgggaggctgaggcaggagaatcagtgaacctaggaggcagaggttgcagtgagctgagaygatgccgttgtactccagcctgggcaacaagagcaaaactccatctcagaaaaaataaaaataaaaataatggtgttaccaagacatagaaggtggggtccattctttgaagtgaccactcattgagtaaattaacatcatttctgtttcatgccattgaagagctgtgaataataatacccttgtgtcaggcttcctgtggtctagcactgtgtcccgtactttatagtttatttcctttaatactcatgcccatctagggtagtaggtaccatggttgttcccagttgatatatgacggaatcgaggcttagcagaataagaagtcacccaaactcatacccactggtcagcagtacagctagaattcaaagccacacttgtctaggtccaaaatctgcacccctaattaaccactcctggtaagaagctggttataagggctggtcaagtcagctatggaagaattctcagaaagtgactctaaaggtgttctttgaaggttgtgtaggaattcaccaaaactggaaggagacaggccttccttgcagggaaaaggaacgtaaggggcaaagttacagagacataaaaactcacaccatctttggaaaaaggagactcattttgagaagccaaagagtaaggttaagtgagaactctggacatttgggcctgtgggtattgggcagcagcccctgacatgatgactcgtctgtgtgacagcagaatgaatgaccacagcagagccagagggcctttgcagccctgttggtctcaaatttactcatgtatagcacatgcaacctgcattaataatcacttctttggaatgttttctacctggaaagggaattagtggatgtaacagttcattccccaaacataaaattttccttgacgttttgattgttataactcatttaagtgggaaagtataagatttgatatctagccctgaagactcatcattgagcacagtgctagaaagaaatgcctaccaggctaggtgcagtggctcacacctgtaatcccagcactttgggaggccaagacaggaggatcacttgaggccaagtatttgagaccagcctgggaaatacagtgagaccttgtctctaccaaaaaaaaaaaaaaaaaaaaaaattagtaatgagaccttgtctctacaaaaaaaataaaaattaaaattaaccaggcatggtgggtcatgcatgtagtcctagctacttgggaggctgaggcgggaggatcatttgagcccaggagtttaaggctgcagtgagctatgattatgccactgcactcccacctgggtgacagagcaagamcttgtctcttaaaaaaaaaaaaaaaaaaggccacgtgtggtggctcacacctgtaatcctaacactttgggaggccaaggtgggaggatcagttggtctcaggagtccaagaccagcctgggcaacttagaccccatcttgaaaaaataaataaataaaaaataagaaaaaaaataaatgccctaccttgaagaacatcacagctctgaggattttatgagttaccaaagaagtccttaaatattaagttatatgggctcatgaacatatactgatggttagtttaattaaaattaaataaaactaaatttgaaagcctttggttcttctagtaatgccagtttatctcatttcttcttgtatcaatatcatagaattacagaacattctgtccaggaggtgagcaccctgccagcctctccctcttcagtaggtgcagtcagaccaggaggtgataggtgctagagtgtggtgattcacagtacagaccctggaagagggctgctggctttccatcccagctttgacccttaccagtgacctgaccttgggcaattgactttacttctctgtgtgcttcttcatatataaaatgaggggtgattatactatttatctcataagcataattactatgagtatgtagcacagtatgttgctcacagtaagtgctcagtaaacggtcgttgctgttaataatgttactatcagggcgtcttgatgggtaatgaagagcacattgatttgyggtcaggactcccaggtacaccatttccccacgggacctgcagccatttattcatttagtctcatttccttatcttatgatgccagtctcatgctgtgaggaaggaaggctggatgaatataaaagcatgtgggcaatcggtggtgctattgagcagatgtgcagtgtagtgaggatcagttagtttttttttcagccctgccctcttcatctgccctcctggtgctcagcctcctcagccagcccattcccagtgccacctaggcagtattatagtcttctaggtagaggaggagaggaggctgctgaaagaagagaacaagagtttccagagcagtcataggaagaaaggacaaggaaatgaactagagccccagagacagggtgcccatgcagggtcccggggaatcctcctgggtgcctgcagcttggggctccacaactgccctgcactctgcccaccacaaaatggatcatagaagagccctcatttattgtcttgtgaccctctcctggacatagcacacttacctccacctgtgtgcctctggttttgctgctcacccgctagaaagttcttcacctgtccaggtgctatgtcttccccagacagcattccctactccctcttccccactcctgccagcagtcagagtttagaaactattctcctcaattgacagcaactgatgttcatctcattacacattattagtgtatttcctatgtcttaagtctcacaggccagagcataagctctgtgagagcagtgaagttttatttgtttttgtgccttctgcttcacatttatgccttgcacatagtagatgcttaataaatgttaatacttggccgggtatggtggcttatgcctgtaatcccagcactttgggaggccgaggcaggtggatcaccggaggccaggaattttagaccagcctggctaacatggtgaaaccctgtttctactaaaaatacaaaaattagctgggcgtggtggtatatgcctgtagtcccagctactcaggaggctgaggcaggagaatcacttgaacccaggaggccgatgctgcagtgagctgagattgcaccactacactccagtctaggcaacagagtgagactccatctcaaaaaaaaaaagttaatatttgaatgaatgcccctgtagtcccagctacttgggatgctggacaggaggaacacttgaactctggagttcaaggctacagtgagccatgattgcaccactgcactctagcctgggtgacagagtgagactgtctcaaaaaaaaaaaaaaaaragagaatgaatgacgagtcagtaagtgcctgagggcctggcccaacagatgaccacttatccaccaccctgctaatggtgttcacatgcacattccacttgtgagttgtgtgtttcttctgagtttggatactagagggtagtctcctagcatgaggcctcttggtgaacttgaaatttattcttctttctctaccctcaaactaaggacaagatcctgagccagtgggaacatcaccaagtttctatgctctttgaggccttgccacagagcagctgctcacctctttgatacactcctttaccagarataaaaaaccgcaaagcccaaaacagtgctcagttttgttttggtcttaggccagaaatgcatgccgttttggcttgggtcttttaaatgccgttctggaacctgagcaatgcctgtctacaggccaaacccatgtattctcattgcatttccccatctaaagacataccttttcaccttcggttttccttgtaggtaacgatgggggtccatcctcttcaagtaagactacaaacaagtttgagggactatcccagcagtcgaggtaagccatctcagcgcttcatttcccctgttggatccattgatgcaatggacagaattctagaaatgagttttcatgaatttcccagcgctgctcaaagctgtggtcagccaagtggggcwggccacaacaagaaaccagacgttcactcttggtttgcatgcacatcttgtgactggactgggcacaggtctgcagaccgttctctgagcagcaacgctgtctacccagttcacagacaggagctaacctcacttcccggtggtcgcagggttgtgcagtggtcttgaacaaaattcctgtcagaatgagtttttatttttgatattttaatcaagtaactttgttacttttccacttgactccttttgcagatttggaaatgaaaagataatccttagggaaatctgattgcctggagattttcaaacataaaaatagcactctttcaagttctgtttctaatatttttttttttaggctaggctgacagcagtgttcttttcttcccttttttcactgaaattgtatacttgaggagatctcttacgggcartttttatccagccttaccctaaagtgttttctctggaggtgccatccaaggaaaggacagagagccacttccagacccaaacttcagggaaaaagagtcagctcttatccagagtttctgaaagatgagaaaacaaaatctctctttttttgagatagggcctttctctgtcacccrgactggagtgcagtggtatgagcacagctcactgtagcctcaacctcctgggctcaagagatggtcctgcctcagcctcccgagtagctggaaccagaggcatgcatcactgtactcagctgatttttttatttttttgtagagacaaggcctcagcatgttgcccaagctggtcttgaacttctgggctcaagcaatcctcctgcttcagcctcccaaagtgctaggattacaagtgggagccaccatatccagccttttttttaataccactatcttatgtactctttataaccctgtgagataggcccaattactattatcctcagttttgcaggtgaggagagcgaggcccagagtggttaggtggtgggtgcagatgtcagagccagctctccagcctacttgttctcccaactccacattccacaccccttccttgcccttgtgccctgcctttcattcctcactcaccttccttcaaccctaatttgggggaccctgtaaaactaaagttctggtgttctttttccagagtgaggagaatatctgacactccaaaagcactcataaaaggtttttaaaggctggacacagtggctcacctgtaatcccagcactttgggaggccaaggtgtgaggattgcttgagccccgaagtttgaggccagcctgggcaacatagcaagaccttgcttcctaaaaataaaaaaaatcagccgggtatggtggtacatacctggctatacgggaggctgaggcaagaggaccgcctgagcccaggaaattgaggctgcagtgagtcatgatcgcacctctgcactccatccggggcgacagcaagaccctgtctcaaaaaaaaagttttggcagggcacagtggctctcgccactttgggagaaccaatcccagcactttgggaggccaaggcaggtggatcacttgaggtcaggagttcaggaccagcctggccaacatggtgaaaccccgtctgtacgaaaaatacaaaaattagccgggcatagtggggtgcgcctgtagtcccagctactcaggaggctaaggcaggagaatcacttgaacctgggaagtggaggttgcagtgaaccgagatcacgccactgcactccagcctaggtgacagcgagacttcgtctcaaaaaaaaaaaaaaaaagtttttaaacaaaatcaagctgattgtgaactagagcctttggcaactcgttaagtttgtttgtttgcttttgagatggagtctctttcaagagaaacaaagccctctcatgtttactgtttcttgtttagtggtggctttatctcagcaatattcccccgttgcccagagacaggaggatttcaagtgagctgaggaaagagcagtgaagatcaaggatggccaagagccaggacagaaaggagcacacacctttcatcttctctctttgactactttttgttttgttggttggtttggctttttcttttcttttaaaygcagttagctgaggcacaagaatcgcttgatcccgggaagcagaggttgcagtgagctgagatcgtgccactgcactccagcctggtgacagagcaagactgtgtctcaaaaaaaaaaaaaaaaaaaaaaaaagcagcagcarcagcaaccaactcttaggacatcaggggacagaaatggagagatgagataataaaggggttcttggcagatggggctcaggcacttggctactgctgcttctcaggcatgcaggcctcctggtgtcctctgagaatcgccaaaacctcttgttaaagaaaaatagtggcttccacctaatgtagaccactgatggcactggggtttcagttgcagaggttaacgtttgatgatttagacaatgtggtatggacctgtattccagggacttgggcctttgtcaccctcatttacctgtcctccaaaaggaaagcaaggcctaggagagcctggaggcccgagaaccaagctctttgctatagtggaggaagtgagggctctggaggcccaggggagctagggccgaatttccacttctacctctgacccacgtgagaccttctgccagccgccaacacccccattcccttccatttccttgtctggaaacacagagctgctttgtgggatcatgtgggaagagttacttctgtgcactacattggggtcaccacttagagtgtgccaggtgccttcataaatgctttgaagtggaggagttgggctttatcattaagagggacttttttttcatccttttactgtgcctcctcagccaggcaaactgaaatatggaaaatagactaatcttttgttaaagacattttgaggctgggcacagtggctcatgcctgtaatcccagcactttggaaggctgaggtgggtggatccacgagctcaggagtacaagaccagcttggccaagatggtgaaaccccatttctactaaaaatacaaaaattagccgggtgtggtggtgggcacctgtaatcccagctactcaggaggctgaggcagggaattgcttgaacccaggaggccgaggttgcagtgagcagagatcgcgccactacactccagcctgggcaacagagggagactccatctcaaaaaaaaaggaaattttgaaagcattctttagatgattatgtaaatacctttgatttgatttacttgaataatattttgctattgatattctagcacttttagatcctaaatgattcttatttgttgattagcaccagttctgcaaagactgcccttggcccaagagttcttcctaaactacctcagaaaggtaagatctatcatttttacatttacatgtaattaaagtgtcactaccccctccaaggggcccaaggtttttatctcccttgttcattgatccatcccaaatgcctagagcagcacctggcatgtagtggatgcctagtaaatacacattaaatgacgaaaggtatttataaactcaaatttggtgattagcaaagcaccatacttttccagaatacataataattttgtagacattacattattataatccccaggaaccattctttctccccttataaacataatcagagagacttgggaaccaacaccagctctaccacttagtagctgtgtggccttgggcaggtgacgtagtagcttcactaaacctgagattcctcatctgtaaaatggggaaaataatacttcgtgaggttttgtaaggacaaaatgaagtcatgtttcagaaagtccccagcaagtgggtggcaaaggaatccttccctaggatggcatctgttgtgcagagtagagatacccatgctctgcaaagtacaagaaagcagtgtctataaatactgtttttttgccaagctaagacactcagctctttgactgagtcttctttaatgctgacaaggttttcatttgtgaaaccaaaatttcagtcttcttattacaacacaagtgatagttatgccttttttgttgtcgttgttgttaccataccttacctttaaagctgcaaaatacctttaggagcatctagatcattccatccttctataagcctgcaaggccagcagggcccaccttggatacagacggaagctcsgaggagctcagggcctgctccttggattttcagtgccagcagcaagatttgtgaccccagtctagtgctccgttgcctagtttgagcagaagtcaaactgggggttagtattgggaagctgaaattcaccactctctagagttcttcagtgaagtaacacactttgaagagcactgactggtcaggccaggctcctgtgtagtaagatgaggggactcccaaatgactgctgattcactttccgtagaacagatgcaagacttcccctgggtttgctgagtctttatctagggttggtttttgttgtcttttatttttaaactctgcccaacgggctgttttgatctcagaagagtttgaaacaagtttcccaggcatgtatccccatttacagtgtgcccagattccgtcctagatcgctcacatatcaccctacctctccagcctgctttctctagcagcagaccccagcacttcccagtgcccatggggctttaccgcaactgccgccagctcttccctgcacccatcccctccatgccctcccttccctcgcagcatggcgtcagcccatcaccaaagtcactccctgatgtgctccctcagctcctgcccctcctgtgctgggttctgccactcaactgacttctgagaggcacagtcagtgtggcagtctggctctccctatgactgctgacctcacatggtcatctggggctgcccagcagtcccagcaccgcaacctttcagcccactcccctacactgtctctcctctccttaggagcaccttgtttctgttcctcattgagtcagcacaggagtccacccctactaccacctgcctggcatggtggccgtggtcctaaggtagaccttgtaccctcccaccccctcggggacagactccagcaggtgtccctccatcttttgcattgctgtttccttccatctgacttgccctatcagggcaggcctactgtcaatacccatgaagacctgtgtccctcctaccaccaccccgttgctctactctcgttctctctgtgtgtgtgtgtgtgtgtgtgtgtgtgtgtgtgtgtgtgtgtgtgtttactatttggaattttccgtaataaacatatacagaaatacaaaaaaagacacagaatagtatcctgcagcctcctccaccacacccacatacttatcacccattccagcacttaacagtttatacctgatcttctttcatctagttccctgcccagccactctcagtaattctgtagcgaatcccagccaatttcatacatacgcaattctattactacatcaaaaaattcatcatgtctaaaaaatcaaaaatttcttaatatcatcaaatacccagtgttaacatatccagctgtctcacaattgccccctttttttttttaagaacttgtttgtttgaataaggattaaaataaagtccacacagtagagttgattgatttgtctctaagtgtcttaggctaaagtttcccctgcatctctctttttatttgttgaagaaactgtgttattcgttctatagatttctccagtctagattccatcccctcgtgtttgttcatctaacgtgttcccctgcctgtcatatttcctattaattggaagttgattccagaaacctgatcagatagattgaggctttggcaaaaccacttcataggtggtagtgtgttctatcacgaggtgtacaccatcgcattgtctctgtgtgtgaagttcacagctgttaatgctcagagccaagattgatccatccatcctctctttccatccctctgcaagccgatgggccagcggttaagcttcagccctgtcttccttggccgtctgcagctcttggcacagtcactgcttctcccctgcctggaacgctatgtacttgtgttctggacactacctgtccactctcgctgcactgtcagttccttcccgacccccttaactgctttctcgtctcctccacctcagcatgttgagcaccacaggccgtggtcatggactgcttctgttctgcatcttcccttactccttaactcatccaaacagtcccacagctttacacccatctggaaagctccacatttgtatttgttttttttttttttgagacggagtttcactcttgttgcccaggctggagtgcaatggtgcgatctcagctccccgcaacctccgcctcccaggttcaagcgattctcctrcctcggcctcccaagtagctgggattacaggcatgtaccaccacgcccatcaaattttgtatttttagtagagacaggggtttctccgtgttggtcaggctggtcttgaactcctgacctcaggtgatccccccgcctcagcctcccaatgtggaaagctccacatttctatctcctaccaaagtattcgtccataatccgaattcaccaacaacagcctatttcacatcgccacttgatgcctgtgggggataattctctaactgtgtttttcctctgctctcacatcacaacaatcatcaacacagaagaagatttctgtgacaaacgtgtggggatttttccccacacaccaagcagcagacaccagttgggtgtcctcgaattcagttccgacactgtctacctgaagatagtgccagtcccaccgggtgagagctcagtccccaaaactgcccccccccgcgcgcgcgcgcgcgcacacacacacacacacacacacacacacacacacacacacacacacacacaccagttgcaagtccaggccttcagaacttctgactgactggctacaaggtggggctcctacaactccctctttggattcatttaatttgctgtagcagctcacagaactcagggaaacacatttaccagtttatcataaaggatactgcaaaggatacagataaagaaatgtgtagagagaagtatgggggaaggggtgctgagactgggtaatttataaagaaaaagaagtttaatggactcacagttccatgtggcaggggaggcctcgcaatcatggcagaaggcgaaaggcacgtcttacatggcagcaggcaagagaaaaatgagagccaagcaaaaggggaaaccccttataaaaccatcagatttcatgagacttattcactaccatgagaacagtatggggggaactgcccccatgattcaattatctcccatcagatccctcccacaacatgtagaaattatgggggctacaattcaaggtgaaatttgggtggggacacagccaagctatatcaggtgcagagcttccaagccctttctggaaactccaggagcctccacatggtcagctctccagaggctcactgaaccctgtcctcttggctttttatgaaagcttcatgatgtcagcattccttcccccagggtatagggtaggaccctctcatggaaggtgttttaagacccacaatcggaatagagtcctgccttgggataggtaataagagggcaagagaaggtcaggggcctgcctcagaggcctgacacacctaacataataacagatgactataacaagggttataagccagcaactgtggacgaaaactaatacatatcatagcaccacagcctactccctggttttctactgtggatcctttatatcaaaaaacatatatatacacaatcattaataattagtccagtccatcatagtgtatgaatgtctcccaggatgatgaggacactcaggtttgcaggtttcctctcaatattgtcaggttccacaagcaggagtggtctgggtaaatacacagcttcaccctctcaggcatgtggaatcattgagctaagaggcagtgtcatctcttgccctgagactcttttgagttgtctcatttgcccatttatttrtttactctcagctactatttctccttctctccattaatctccaaacttttttgaagggacattagaatcaccactgtgctggtctagattacaagcagcaatacaagtctagcaagtagctcctcagtccactcccattcagatagggtgaggctacatagatgcagaaccaatgagctatttttaccaccggccatattcactgttagccccaattttgttagaaggggtgaaggcacatctcacccccatgatgccctcaggaattttgacataatatttaaaaacatggttacagttttttacttagcattcctgctaaaaattttttgaagtgttgggcgcagtggctcatacctataatctaagctctgtggaaggatgggaggatggattgaagtcaggagttggagaccaacccaggcaatacagtgagaccccatagctaaaaaacaaaaatcatctttgctgtcccagcaactcctgtcctaggatcactgcatcgggtaggggagaaaaaatacttttttttcttagatgatttgggtaaactctgctttctctctctctctctctctctctctctctctctcccctcccctcctcgcacatccgcctagagttcctcaggtagcatgatcctctataaaccagttccactttattgtggaactcttctaggcactgcttccccattagaatgttcttggacatcacctgagacannnnnnnnnnnnnnnnnnnntgagtacagtgatgcatgcctctggttccagctacttgtctgtccccctctctctccctccctctctccctctctccctctctccctctctctccctctctccctctctctccctctctccctctctctccctctctccctctctcccctcaaggagtatctcctccttgagttcctcaggtagcatgatcctctataaaccatttccattttattgtggaactcttctaggcactgccttccccattagaatgttcttggacatcacctgagacagcatgggtatttcagatgtcataggggtaacttcaactaacatttcatagcaaggtcccttaagtggaaattctctattccaaagtcccagtagttgttgctgggaggtgctcaaaacacttttgccataagccccaggaactgctccacagggggttatcaagtggagagtttgtccctgccagcactctagcttctactctgcactctgcaggcttgggcatgtccaattaatattggagagcagatttacatgccttctgttttatagtaccaggtaggggaaacattctccagtgtgatactgtgttcattaccatgatacaatcaaataaaagagatgcagtcggccgggcacggtggctcacgcctgtaatcccagcactttgagaggccaaggtgggcagatcaggaggtcaggagatggagaccatcctggctaacacggtgaaaccccgtctctactaaaaaatagaaaaaattagccgggcatggtgacgggcgcctgtagtcccagctactcaggaggctgaggcaggagaatggcgtgaacccgggaggcggagcttgcagtgagccgagattgcgccactgcactccagcctgggcgacagagtgagactccgtctcaaaaacaaaaaaaaagagatgcagtcaattcacatgaagtgtgttcaaatataccaactttcatcatcctatcaacccttacatttttatattctagtttcaggaacttcttcacccccagaccattttactctctcttgcgcaaaaagctttgggtcttctgccaagggttgagccaaaggaccctggaccttttgtcaatctttattttgattagtctgccccatttttgccccaggcaatttcatatcatatgtttcattgtaatctctaccttgcaacttttaaaatttcttcaaactgcaagaaatacagtaaactgggttagggccgtttaatgttgggagagcggaggggtttggtccacccaagcttcgataatgttgtattaagatctttgttgtgctcacttcggcagcacatatgctaaaattggaaccatacagagaagattagcatggcccctgctcatgaatgacacgttattttttaacaacagcaaaaaaagacctttgttttggtaagcgcagtggctcatgcctgtaatcccagcactttgggaggctaaggcgagtggattgtttgagctcaggagtttgagaccagcctgggcagcatggcagaaccctgtctctacataaaatacacaaaattagccaggcgtggtgccacatgcctgtagtcccagctactcaggaggccgaagtgggaggattgcatgagcctgggaggcagagattgcaatgagctaagatcacgccactgcactccagcctgggtgacagagcaagaccctgcctcaaaaaacaaagacctttgttttaactgtatcaatttccattttattcattccatttcttaataaccatctaaagatttctaccctgctgggatgagtcccatgactctcccctttctttttcttcttagttttatcctatcagtgttttcttcaccttatttgttaataaccattttaaaatttccaccttcctgggaggagtcctttggctctcacttttgcctttccctgttctcttgttaattaacctaatatttttattagcatctataagacccatgaagggaagctgagacagcaaatttaataaggcttcttgaactgttcatttctgtaggagtaatatcacatggggtgcccatgtagaaggggccctcttaaccacacatttaccatgacttgggtaacaggcatgttcagcgtgtgaatagccctgtcatcataaagccagtcccacatgcatacagagcatatcagctactgcatctggggtgtcccacttgacatttgtaggtagagttggacagtcccccttctcagggtgaacagaccttacagtggcttttatctgttccaccaagctgccagttaccgcaggaatagcctcctgtgtgtctggatcatrtatacccatatgcagttgttcaatagtgagctgtgggtcccatcaatccaaacatgtacttctactctgtagtgtttaaaaccaaagatactgcccctaaattagtcactcttacagtgcgttttagtaaaggttcctcaggaagctgatgatactgatctacagaatgaaacagttctttcgcactataccctctagtttccatagttacttagttttgcccctccttcacattgactaccttcttggtaaccacaagtctcagaggtactttctgttgtccctgcgtaattttctcctttgtgggtaactttaaggctagtggactaagctcaggcagacccacatctgagcttagtcyagcctcaagtcctgacccagcaccctcttttattttagccattatagacaacaataaccagggattaaatatttcacttttttcttagtttgcatttctttatgcatccagtgccccaactcmtggggagttggatccatctctgaattccactggtaacttttacctttagtaactgatctcagcacagctgtggcttcataccctgggtgaccacatggccacataggaatccaaagattcctgatcccccacccttttatcctttctcttctcaaaccacatgtttctgtgagtcagagctgttccaacaaatcctgcttcgctgataccaaatgtgtggtgtacggctcccagcagactgatttttatgtcgctattaatataaaccttgatgatcagatgctttgaaagatctttgggtgtaaaggacaaaatgtaatggcagcatacacaacatgccgcagtgtgctatgtacacttttatcaccgttccttttgtggatgaaaagctattaagcagaatacaggaaaacrctgggttcttaatgggattaaagcagtggggctgggcacggtggctcacacctgtaatccaagcactttgggaggcccaagctggaggatcacctgagtccagaagtttgagaccagcctgggcaacatgatgagatgagaccttgtctctacagaaatttgaaaaattagcagagtgtggtggtccgcacctgtggtcccagctatacaggaagttgaggctggaggatctcttggacccaagaggtcgaggtagtagtgagccatgtttgcaccactgcactccagcctaggtgacagagtgagaccctgtcaatcaatcaatcagtaaaatagtgggcatcacatagtggatctgagttcctttagggaatggtcccaccctgagacaaggaaagctgtaggaggccttgtggcacactcacactaaactacatgtagatgtgaccaccactcatctaactctagtatgggtcacccaacatttctgggtgcaaaacatatatcctaactgtactcaggcctttactacacactgcagcaacatgcatgttggatgaaacaacactgacccaccagacagaaaagggccttataggagataggtgcaggtctgggtatcctgggataagttgagtttgctttcaatgagcagcagaattcagaggaaaatgcagattagagggagttctcttccaggaggaaggcaaaaggatgggagtcagcttggaaagataaggaggctttggcagagtgagccaggccaactcaataaacagtgctgaagagaatgctaagatgcagctttgggaaagggcctgtacccagacccaacagggcctcttcacaattttaatacaaatagaggctgaaatggggggcagtggccctcagtcttggctgctgaggctcagggcacacctgtgggactcttatggccctctgaatttacggaagttctctgagggcacttgcagtttacatcaatgtgctatgactgcccatgcctttaggttagggcaaagtaaaacatgttctgcagtgtagttggtaggtataggaactattctaaacacccatcaaatgaatgaatgaatgaatgaatgaaagaaaaagaaacaaggaaggaaggagagagagagaagaaagaaagaaaaaagaaagaaagaatgagaaagaaaagaaagggaaggaaaggaagaaagaaaagaaagaaataggccaggtattgtggctcaagcctttaatcctagcactttgggaggctgaagcgggaggatcacttgagcccaggagttcaagaccagcctgggcaatgaagtgagaccctgtctctatttaattagtaaaattaacaccacccatgtactgtctgcaggaggcaggtgggctgtgctataactgatagcacccagtggaaaccagcagtacaagcctgtgagatgagacagggtgattggctctgcccctaattaatttcaaatccagaaatgactgagtcatggccattgtaacaacacctgtccttaataacatttggtatatgggcaaggggagattttattgggaaggcaaaggaaatacctctgtcattcttactaatctataatgaagctaaattgtaccacgattgtatcacaatatggtgtaatactgggggcattggtaaggttcagcttcctcatgtaaataagctttatgataatactgatacgatcagatgtattgggaggttgagttgaagctccctcaggatggaatgcctgtggaaaacggcccaagaaggaactggatctagctaaccatcagctgatctctgtgcgaaacagctctgcacaagtttatcctaaggtccaatagcggtagaccaaggcaggaaagaacagtgaggctagtacacgattatgaaagtgtttgtgtgacttcataggacaaattagtcatttctttaaattcatccctacccacactggcttctccagattttaggtggcggcattgctgtaactgttttataaatgctacaacaaatgttctgatagatacatttgttttggtataagggatctgtgattgaaaaccaaggaatggcctatggagctgtagatatatatgtattggtatccgtccacagttcctggtttatagtgtccacatcccttgttacagtctggttgtaatgctggatgtgttaggcctcaggaaacagaatctctcctgccctcctttatgtaccccaaggcaggactctaatcttttcccatcttgtgggtttgagatcctaccctataccctgggggaaggaatgctgacgtcatgaagctgccattaaaaaccctagaggactgggttcaaggagcttctagaaagctaaacccgtggaggccaacaggaaagtgaagaagaactcgctcacgtgccgggagggcgacacacccccaactcctcaggttcagaagctcctgtgctcaggacccttccagaccccgccctgtgtgtctgttcatctggctgtttatcctttaaaatatccttcttagagccaggagctgtggccctgagaaggctcagacctgtaatcccagcgcttagggaggctaaggtgggtagatcacttgagcccaggagtggagaccagccgggtaacataatgagaccttgtgtctacagataataataaaaacaaaaatagctgggcatggtgacacaggcctgtagtcctagctgcttgggaagctgaggtgggaggatagcttgagcctgggagaccgagactgcagtgagctgtgattcttacacacacacacacacacacacacacacacacacacacacattcttagtaaactgataaacttaggtaagtgtttctttgagttctgtgaaccactctagcaaatcagtcaaacccagaggggattgttggaaccccagttgaagccaactggtcagaaattccagaggcctgggcttgcgactggacaggaaggtgggaacattctgggggactgagcctcaagctgtgggatctaacgctgtctccaggtagatggtgtcagaattggattggaagacacctggctggtatccgctgcttggtggtggggtgagacccccacacatttggtcacagaagttttcttctgtgttgatgattgttgtggtgtgagagtagagggaaaagcacggttagaggagcaagttttccccacacagtgtctgacaggcttctctacttaaaactggaatacggactccggctccaytccagactgttccttcctcagtgtccccgtctgttaaaggcagtgtcattcttccaggtgttcaggccttaaagcctgagagaggtgcttagctcttccgtttctctcacacaccacatcctgtgcttgtacaaatactgtttcttcccccttccacatctatttaaaacccagtcacttctcatcatctccaccgttgtcagctaggatcaaatgagcatcatctcttgtctggacagttggagcctcctaccctgtctgcctggagccttctaacctggtcctgcagkctgttctcaacagaacactggagccttccacattcaatcatgtcactcctctgtcctgaaccatctggtggttcttctcgcaacccccaccagatatcagcatggctggtgtccaagcctcctgcacatttttgacgcactcttgccatatcagagtggccttccctgaccacaccctccttggtggtcactctcctcctccccacccagccagcactcttttctcccttcccctgcttacctgccctcaccctctggtaactccatgtttacttgtcaccctctcgtggaatgtgagctcccagcaggcagggccctagttctttccatcagctgtgtcccaagtgcctgaaagggtgctgggcacggcacatgcccagcaaataggggtggaatggtaacccttttcctgtaagtctgaactatccttgggctaggaatcgaccatctcttcttactcactttgtgatgtgggaggctccacggcctccctcggtatcttggaagatggggatgatggtgatatccacatcgcggggctcttaggaagatgaagctacrtcatgcagcaggtctcaagaaggccartctcctctctttccctgccctgtagtcccatctctctcctgcccagagttgagtcacctgggccagtgtaccctgaggccctggccagccttgcctcttcccctcaagggtctcagactggtgccaacagtcacattgtcacaccaaagccaggagtgcggagagaggatgtggaacagggtctaratacctgaagctggggacagcatggccctgcacgtctctactaaaaaattaaaaattagctgagtgcggtggtacatacctgtggtcctagctactcaggaggctgagacaggaagatcatttggagcctgggaggtcaaggttgcagtgagccctgattgcaccactgcactccagcctcagtaacagagggagaccctgtctcaatagaactaaaaagaaaaataaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatatctttcatcttttttttctctgctcttctttaaagtttctgtttaagctaatatttttcacataataaaaacatttttcatgctattaattatacaacagtataatttttattggctacatatcattgttgtttgttggtttattgagacagagtctcactctgtcacccaggctggagtgcaatggcaccgtcatagttcactgtagccttggacccygggctcaagcaatcctccagtctcagtctcccgagtagctaggactgcaggcatgtaccaccacacctggctaatttttatttattgtccatacaatcccctgcattcagatgggtggcatttttttcgttataagcagtactgtgccaaacactctagcacagacatctcagtgtatgactttgatcactgttttaggataaattcctagaattggagctgcaggtgaagagggtggggtattttgaaggttttccatgcctggcacttagagtttctcttgccccatcagtgtgactcacagccaaggcctttctagccccaccacctcagggattccccctagctttttccctcttgactgcctggctcagattgtttcttagccaatttcagacttccaagagaggaacgagattcatgtaaattaacttttagagccaagccacctcagcagaagcttagggaccagcctgtgagcagggtgccccttgattttgacttttttrgagatatgactagacaggtcatgagcagaaacagccctagtacagcctgtgacatttacaacatgaggtttatctgtttcttctccttctttaagaatgtctttctgaatacgttatatttttaggatcaaattcctaatgtgagtcactcagtgtgccttagtcagctgtttcctccctgagtgcaggctatgtccttggcccttgtgccaggagccaaagttacaaaaatgagtaaaacaggaatgtaatactgtaatagggccttaaagaaccctaacagtgatggtagtactactgcataatgcttacagcctgccagggcttgtcagtaaattctttgcatatattaacccatgtaatctgcatgccaaccctttgaagtagggttttaagagatcagtaaattgcagcatagagaggttgtgtaatttgcccaaattcacacagctagtaagtggtggagctaaaattggagacatgtccatagttttctaagtaccaagagctgtacaaagagctatggaaatgggtcaacaaattgatacatttcctaagctgtgcatactgtgcagccattaaacagaataaaaaagaactgatttggagctytcctaaacatagtaagtgggagaaaagcaaagtttcagactatgtatcccttgtatggtttttaaaagacatagcacacgcgtgtgtatcaccaaaatgtaacagaggttaacccgagacaggggcacaaagtagaagaagccttttgctacctcgcttatatactgcatgaatcatgtaaaatggggagaaataataataaattatgatacagctatagaatggaatagaatgcaccattcaaaattacatacaactagtaaataatttttaataacatgacaaatactgttgctaaaatggtattagataaaagcaagtaaaagttatatctatagaaaatatataggaaaattaaaaggaactatataaaagaattttaaatggctacatttaggtgttaggcttaagaactctgtactttccgattctctgcaatctgtttctatttattttttttaattctggatgaatgtagacatcctgttcttatataattgaagcataaaatcatgaattgtaacactttccaggctttcaaactttgtctttgtaaaactgcctgggtgggcctggcccctgagttcatccatttcaagtgctcactataggtcagttcccttcatgatgatggtgcctcttttaggtgactgacaggaaagcagcccttcccaccaatgacctccttgtttttgattgcttccacagtggcactaaggaaaacagatcatctctccctagacaaagccaccatcccgcccgaaatctttcagaaatcatcacagttggcagagttgccacaaaagccaccacctggagacctgcccccaaagcccacagaactggcccccaagccccaaattggagatttgccgcctaagccaggagaactgccccccaaaccacagctgggggacctgccacccaaaccccaactctcagacttacctcccaaaccacagatgaaggacctgccccccaaaccacagctgggagacctgctagcaaaatcccagactggagatgtctcacccaaggctcagcaaccctctgaggtcacactgaagtcacacccattggatctatccccaaatgtgcagtccagagacgccatccaaaagcaagcatctgaagactccaacgacctcacgcctactctgccagagacgcccgtaccactgcccagaaaaatcaatacggtgggtgggacaatgttcaggcccttaggaaccctattccgcactttgcaagttggtgggagggcaggtgctccaacttacacaagaaaaagtgagagcttgctcacctgacccttatgtgctctggttcaagcatgatggtggattagagcctgtgggttacaaacccaggctttaggctccagcagacaggcttcaagacctggcttcagtgcctgacataactgcacaaccttggcaagttactttctctgagtcttactttcttcacatacaaaaaggagctaatacaatatttgagctcacagatgattaaatacagtgacaaatgagcagcacttggctggcacctagaccactgagcaagtagtcactattacctaggaaccttgaggatgaaacttttcctttcctgagggtcacgagaaaccaatttccctctcggggttctgggtattttctctctctctctattttttttttttttttttttttgagaagggctcgctctgtcgcccaggctggagtgcagtggtgcgatcacagctcactgcagcctcagtctcctaggctcaggtgatcctcttacctcagcctcctgagtagctgggaccaaggtacatatcactacgcctggcttttttttaatatttttggtagagatggggttttgccatgttgcccaggctggtcttgaactcatgggctcaagcactcctcccatcttggcctctcaaagtgctgggattacaggcgtgagccactgcacctggctccctgagttgctaagtcagactttctcgctgcatcttcctaaaggaattggagataaagctctcgatataatagaatagcatagaattttgtagaaatctcatattctgtcattttcatgaaatgtttcctactctatatccagaagttctcccattgcacatggcagctctacctgcctcacattctgttataaaatgttacagtacccagcactttgggaagaggcgagtggatcgcttgaggccaggagttcagggctgctgtgatcacaccactacactccagcctgggtaacagagcaagaccctgtctcaaaaaaattaaaatggggctgggtgcagtggctcacatctgtaatttcagcactttgggaggccaaagtgcgaggttcccttgagcccaggattcatgaccagcctgggcaacatacagagaaaccgtctctataaaaaataaaaattaattagctgggcatggtggtacatgcctgcgatcccagctacttgggaggctaaggcgggaagattgcttgagccctggagatcgaggctgcagtgagcgtaatcatgccactgcactctagcctgggcaacagagtgaaaccccgtctcaaaaaaaaaaaaaatttaaatgttgcagtaaaagtgtgtcatatcaatacttaaattaagaaaaataaaacccatcttcctgtaggttggaggctgccgtgtctgatggtggatacttctgctattcaaaagggaactctcccatgactcccaagcaccactgatgcaaaattttcatttcatgctacacactatatagttttattatgtcatttaatctctgtgttataaattaacacactacaggcctctcagttgctcacgcagtcactgccacagttctgccaggcttctccaacccacccgcacggcccagaagggagctcggaaagcagctggaactatcagggtgattaaaggagaaaccaggggacagagaggaagaggcactccacccaaaacatttaaagagacagcttgctttttttaaaattgccaattagccaggtgcaaaacaaaaacccatcatttagaaggtgatacctctattttcacttttctatttgcaaagaactggaagttcaacaaataaatgctcaaatcaaaactaatcaaaaattaaaactgttttaggaactgcatagacttctccgagccccaggccgatcctgctgtgtttaaccagcatgtactgacttgctgttttgcatgaggggactgacaaatttgtttatgctgcacattcattatgcagaagctgcagattttgctttacatcatgtttcctaaaaacatttttagactctgctgtcattctgcaagctgatgtgggttgggggtgcgtacagagtgcttgatggtttttggtgaagctcaattttgatccctacccatagtgtttgctttctggtgaaaataacttgatgatgcccaatcaccaatgcagggccaccctgatgatggggggagaggaagggcctgtagttaagagtacacagtatgctgggtgcctgacagacactcttcttcccgcccttcaagggtgaggaaatcaaggctcagcgaggttaagttactggccaaggtcaaccattttacaaagaaccgctgctctttttttccattcagtccattctttcaattaaaacccagtttctttctttaaggggaaaaataaagtgaggcgagtgaagaccatttatgactgccaggcagacaacgatgacgagctcacattcatcgagggagaagtgattatcgtcacaggggaagaggaccaggagtggtgggtacgtacgaatatccatccacttcatccgtacattcatacagcatgcctgggcaggcaccacattggagcctacagacagtgcagtaaaagagggctcttgagcacaaggaccctgtcagctgcatcactcacccaacagccattgcatttggtgtcttttctatgtcacacactattacatgctagaaaaacagccgtggagctggccgggcacagtggctcacgcctgtaatcccagcactttgggaggctgaggcggatggatctcgaggtcgggagttcgagaccagcctggccagcatggtgaaaccccgtgtctactaaaaatacaaaaaattaactgggcatggtggcacgcacctgtagtcccagctactcrggaggccaaggcaggagaatcgcttgaacccgggaggcacaggttgcagtgagatgagatcacaccactacactccagcctgggcaacagagcgagactccatctgaaaaaaaagaaaaacagccatggggctttgaagacaggtcaagagaattaacatttgtatgtactttacccatggtatcatgtaaccttgtgagttgtaggcattttctgatttttcatataaatactaaagcggaagaaagttgagcatgttgcctgtggtccctcagccagtaagcaggctaagtcaagattccagatcggccctgaccccagagcctatgtgctttgctcaccattccacactgtccccaggctgggaatcagaatgcccaagttcctgctcaggctgagcagttgacaagtcctcagactcaattcttaatccagtctgcagttctttctttgtcaaataggccaagacaccttctccacgtaattttaggaaaagattaaatgaaaatatctatgaaaactccttttacattaaaacctgcagctcaggcatcaggagggaaagacatcagcatcctcataggccctgctaggtacccaggctgtgagtgacctgcgagggcagtccacacatctattggttttcacgttgccagggagtaagtctcccgatgggaactgccaggccaaggtacagtgaataagccacctcttctgctctccttgttgatcatttcctgacatcagggtgaaaattccccttccttggcagcctgagccccgtcctgccaagagggactcagttctgtctgccaggaagggacctgaggctcgcagttgagccagcagtacctaagaatacccagaaatacatatgtatatacatgtgtgcacacacacataggcatgggcacacattcacctttgacttttcttccttcaggcctagacagtgacctcagattcttaatcacagctgtagggattttgtttggactcaactggggcaattttgccctccagggacatttacaatatctggaaatattgattgtcaggacctaggaagggggttgctaccaacaactagtagatggaagtttagtggccagggatgccactaaacatcctccagtactcagggagcccccacaagcaaggatgccagtagcaccatggttgagaaactggactgaagggatcagcctggggaggcccaggggtacctccagcctctgtcagcagagtggggccagcccctggcatgaagcctgtcagagagtccacttcatctcatgacgaggaggtgggctctgaagcccccccacgtgaatcagttactagctctatgggccttggataaagcatgtcccttctgtaagcctcactttcctctgaaaaataggacatgattaatcgtttctcacaaggatgttgaggaactcactttgtaatctgttaatattattataatcaagcagtgatcatgttctttgctaagcaactgatgactacagcagagatacctgcggggaatgggaagctgtcattggtgtccctagcatcattcctaggggacattgtgtgtgccaccattacgtgcctcgccagatgtaaagatggtgccacacacacatgctaactgtgatgtgaaattcacaaagacctcacacatgcatgatgccaactaagaccacacgcrgtgggtgggcaagccttcaggagagctgggcaggcctggttgactctgttccactcttaaaaccaccttcctctctatcgatttggcattggaagccaatatgcacgattttgttttttctattgaaggccyattacatgattctctttagtgcaatcaatactaatctaattgaggtaattagaaaatttttacaggtaactggcttacaggccaatgcagcagacaataaaattgccattcgccaccatcagtctcaaactttcacagtattcttcctccacggtaaccagaaaacaagtgatagtacatagcagccttttttttttttttttactggctagaacaacactttactcacaaagagaagagacagaacaagattagctttgatttgagtatggtacccygcagtgggtcttgccaggcagctgacacagcttaatggtctgtatgcatcctacctgggctgtgggcaaagaaaccccttccttcccaactaggaataggtaatagtactgggattggccaggtgccatagcagccttttcatttgcttttttttttttttttcttttttaaatgtatcacacaagcctggagagaagggattttctttagccccacttaacagagaaaaggcttagcaaggtttgtgtgaggtcacccagctgtaaaggcagccaggcgccctggttcagagcaaggactctagagccccacgcctgtgggagagcatgtcacctctctgggccactgtcccttcatctgtaaaatgaagattgtaaactgtataagaaatatccacctcagggggttgctgtgtgggtacagcaagatccatgtagaatgctgagcatattggaagttctgtcgtttgctctttccttatgtagtttatgaccgttaagctctctgtagttcactaaagggtgggaagaagggtaagcctgggattccaccgccaggtctgtgggcagactaggctgggctcttacccactgggtttgtcgtggggccactgcctgctgcctccatcctgaccactctcttttctccctgcagattggccacatcgaaggacagcctgaaaggaagggggtctttccagtgtcctttgttcatatcctgtctgactagcaaaacgcagaaccttaakattgtccacatccttcatsmaagactgctkccttcatgtaaccctgggcacagtgtgtatatagctgctgttacagagtaagaaactcatggaagggccacctcaggagsgggatataatgtgtgttgtaaatatcctgtggttttctgccttcaccagtatgagggtagcctcggacccggcgcgccttactggtttgccaaagccatccttggcatctagcacttacatctctctatgctgttctacaagcaaacaaacaaaaataggagtataggaactgctggctttgcaaatagaagtggtctccagcaaccgttgaaaggcatagaattgactctgttcctaacaatgcagtattctcaattgtgttactgaaaatgcaacattagcaaagaggtgggttctgttttccaggtgaaacttttagctccatgacagaccagcctgtagttatctgtgtacacagtttacagctacaaaaacctactttggtatttattacagaaaagtgctcagttaaatgtaagtgttattccttcagcaaaatattcactgacccaaaactctttatggcattttacaatgcacacagcctcatgcaagtttagacaagtggatttatactgtcttatgagtgcccgcccctgatatattacctcattatgcaaaaataacatatctttcatgactattttgacaaaagtttaaaacacatatgaagttcaaatttcaggaaccaaggactgccagaaaatattagcctctacattacgcatgcatttagaagcttacctgaaatctgccttttataaaggaatagtatggataagtggaattgtacattttttaaacttgattgccattaaagcagaaattataaggttgcaacaatatttgtttctaatcactggctttctcaagagtatggattgacatattgtgttatgaatgcacatctctcagatgtgttgaagcatccattgcatccattttttattattttcttagttttgttcttggacaaatttaaacttttaaaagattattcaagatgaatttaaaagtcaacccttcacacagtttccctactgtatgtagaatccaggtgctgaaaccaagtgtttcttttcccatgctctttgttaaaccccaattatagataatttttccagtcttaagctctgtccaccttcaagtcaattcataaccaagtttttgaacgctgctatgaattgcactgtgaaaagcactcttccctctcagttttcttttcatcccagccatgtttatcagatccttaagaacattgtatttcagtcttttacatcagtctgaattttggaaaagaatgcaatagttgtactccacagtcagtggaactgttccctgagtccgaggctcatgtgtcattctggcactacatttgcttaaattgctattttggcaacagcacagaaaactaatatttttaagcagagaatcttggcaatgagtgagagatgttaatttcacagaagcacaactcccaacccaacccttaggaaaagccctcttccatcgttacagtgctcagtgaatattaatttagttctgcttaagtggttgctatacaaactttgaatagccacctaataaataaaccttgcatgacaaacctgcaaaatattttatcagctgttattggaaagtgattttaagcaattgcttcctcagtgtcagggcacatgtgaatttccacaccaaacagagcatgaggaaccagttgacatgctgggttgtgactggcagctttagcagcctcrgtactgaagccacaccagtgtcmggatggaagtctgcatctgaggttgctcagtgtcccggtcattcatttacacattttaacttgcattaaagagctgttcttttctgtggcctagactcttttcactgatctcaaaataaactggtttttttcaaaaaaaaaaaaaaaacaaaaacaaaaaaaaaacacaaaagctgcatgtctaaaattacatggagttagtgtctattctttttccccttttgcagcaacttacacagcatttttaacaccttttttttctagtttttttgttcggttttgttttccatcaggaatttgagttctctctaacccagcttactgtgggacataggaaaactcagtagaaatacctttggtgatcttgttgagtttaagtctgatcttgatcttaaactcagtaagccactatctgcaattttgtacattatatagtattttgaagatatggaaccttatgaaaaaaaaatagcaaattagttctttttcccccagaggggaaagttatgttctgcaaatagtgtgtgtcttattttactgttgaacagcaattgctatttatttttttattgcctagaacttcaacatgttgtataggaatcctgtagtgccactagttaaatgccgaattctcatctggatgttaccatcaaacatcagtacacttgtcatttcacatgtgtttaatgtgacagtttttcagtactgtatgtgttaatttctactttttttaatatttaaaattgcttttaaataaacatattctcagttgatcccaaacttctgaaatcaggccattttgtgagttgttcactaccctgctgacaggaaagaatcaaggcttcctctggctgtgctttcgggtatatagatgacacaggtcactccaacccttgtcagagatcactctggatacataaaaatatgtggcacttgccccggcttacaaactgtgggccttcggcccctttctgtcctccaccttccgcattccacctccaccacgtccacttgtgcgcccgttgatgtgaacagggcaagaagagggtggaggggcacgaggcttacatgttgtcgtgtggacagcacttctgtcacgtagctgtcacaactagtgctgccacgcagtggagcagacctggcccaggcactctgcctgcattaacccctgaatccttagcaagcccaggagaagcgtgagcccctcagctttacagagctgacaaatgaggctcagaggcattcattcacacacaggagacatgtggcttgtaaatcactaaggtgggagtgcacacaggtggttctggctccaaggccatccttgcaattcccactgcctggaagacactctcctttatggagaaccacagtggcggaaagcaggccgagactgcggcagggaggatcccgaagtgctggtctcagcattccttctgtcatctttcatggaagttggtagacatggctgggcacggtggctcacgcctgtgttcccagcactttgggagcctgaggcgggtggatcacctgaggtcaggagtttgggaccagcctggccaacatggtgaaaccctgtctctactaaaaatacaaaaaattagttgggtgtggtggctcacacctgtgattcccagctactcgggaggttgaggtgggagaattgcttgaacccgggaggcagaggttgcagtgagcgaagatcacgccactgcactccattctggatgacagagcaagactctgtcaaaaaaaaaaaagttggtagacataatgtgcctgttcatagtccaagacaaaccctttaaacaccgtgctaccggggaaaatgggcttgggcatggaagccagcggctttctatcgggatatttctgggaaaagctaacatagtgacctggataatccagggggaggcgaagccagctttttatctgatgacaaaatgttctttcacatcggttgtatgtggttttaagcctggaacagtatctgtttggaactgacgtcccccttcaccaccccctgactccgttgaaagcagcccctccctttatccaccagcccccgacagcccagcctccaaggtgaggccaggagctggaggcttacccctgtctctccacctcaggtcctttgagggcttactgtgcttgggcccatgtttcctttacctgcgtttagtctttggcagggcgcgtgacaccgttaggcacattaccacagttgagtgatgggcagccgtgtggacccaggtccttgtggccccagccacagccccctactctccacacccttgttcttctcccctcccctaaccttgtgcccacttttcgtatgtgtttttttctttttttgtttttttcttttttgtagacagggtcttactttgttgcccagtctggcctcgaactcctgggctcacatcatcttcccacctgagcctcccaaagtgctgggattacaggaatgagccaccatgcccagcctagccccccattggatactgtttcaggcttgaatgtgtgtgtgtgtgtggcaggggtgcagtggtggtggggatgatcattactgagatcattcaacctattctcctctgccccccatgtgttcccctcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtattcccctctgccccccatgtgttctcctctgccccccatgtgttcccctctgcccccatgtgttctcctctgccccccatgtgttcccctctgccccccatgtgttcccctctgcccccatgtgttctcctctgccctccatgtgttcccctctgccccccatgtgttctcctctgccccccatgtattcccctctgccccccatgtgttcccctctgcccccatgtgttctcctctgcccccatgtgttctcctctgccccccatgtgttcccctctgccccccatgtgttctcctctgccccccatgtattcccctctgccccccatgtgttctcctctgccccccatgtattctcctctgccccccatgtgttctcctctgccccccatgtattcccctctgccccccatgtgttcccctctgccccccatgtgttctcctctgccccccatgtgttctcctctgccccccatgtgttctcctctgccccccatgtgttctcctctgccccccatgtattcccctctgcccccatgtgttctcctctgccccccatgtattcccctctgcccccatgtgttctcctctgccccccatgtattcccctctgcccccatgtgttctcctctgccccccatgtgttctcctctgccccccatgtgttctcctctgccccccatgtgttccccctctgcccccatgtgttcccctctgcccccatgtgttctcctctgccctccatgtgttcccctctgcccccatgtgttcccctctgccccccatgtgttctcctctgccccccatgtgttctcctctgccccccatgtattcccctctgcccccatgtgttctcctctgccccccatgtgttcccctctgccctccatgtgttcccctctgcccccatgtgttccccctctgcccccatgtgttctcctctgccccccatgtgttcccctctgcccccatgtgttctcctctgccccccatgtgttcccctctgccccccatgtgttcccctctgcccccatgtgttctcctctgccccccatgtgttcccctctgccctccatgtgttcccctctgcccccatgtgttccccctctgccctccatgtgttctcctctgccccccatgtgttcccctctgcccccatgtgttctcctctgccccccatatgttcccctctgcccccatgtgttctcctctgccccccatgtgttcccctctgccccccatgtgttcccctctgcccccatgtgttctcatctgccccccgtgttctcttctgccccccatgtgttctctgcaccccatgtattctctgcccccccatgtattctcctctgcgccccccaatgtgttctcctctgcgcccccccagtgtgttctcctctgccccccatgtgttctcctctgcccccccatgtgttctccgaccccatggaaatctttgattctcctcattatgcagtctgtgggtaatttggagtgaatgggctcacatctctagcaggggtgtctgagcacgtgtccctcccacagaggcctggcctctccagccagctgcctgggatggaggtgaagtccactaaattaggtcaccttactcttacacacctgaggctcacatggtccacaagcattccatttttgtctagacagtgccaggcctttggttgcaaagacagccccatattctgtccctgagaagcggagaaacacaggtaagtaatgatgactgtagagttcacctggcagggagctgcctgaagaaaggagcgtagctcatcctaggagcctgcacagattgagctcctgcaaagctgctgggatggggtggcatccctgcaacagatggagcagacaggagaaggaaacggcagactgaaggcaggcaggaccagccccaaagtccctgtgctgtgctgaggagcactctgtgcaggcggatccgtggaccaccagcagctcatcatactgaggcctccacgggggctgagcaccaggccaagcgcttgagcagcacgattgcagttctctcagcagtactgagaggcagggactgttactttccccgttcacagattaggagactgatactcagagcagctgagccgtggcgtgccaaaaagtcaagtcactcatgaagggtggaggcaagaattttgagccctgacatcagggttcagccatggagctcctggccacaaccctctgctgcctcttggctgctgctggtcaaagctggcctgtcccggccctctaccattaggtcagcaccagggaggggtgaaccatgaagggcaatgaagttccggattcggaaattaaggcatttgccagagggccccacagcgagcatttctcataacatgtcatggacagccactgtgcacttgggagctagaggtggagctggcacacagggtgacttggtgcacgtacaatgtgagtgactgagaagaaagcagagtgtgcatgtctgtgtgtgagcacagcagcccgtacacaaacacttgagctcctgaacaccagaattaaagctcagataaacagctgttttgcaaaatcttaccacatagcaaaccctggtctgaagctcaggaggccaaaactttcaccttctgcaaaaccgccaggggagaagccttatttgggttcactcttcaacagaacttaaaactttatagctctgagaaaatatgagggcacaagatggcaaatgtgtcacatgcacactggcctaaaatatattagggccaggttttcacattttggcagcatcacctgaggtccccagtgccgacggattcgcaagtctcaggaagtgcttgagaatctgcatttagccagcgtccctgggtggggtactcaggtcgctcctgggccaccttgaatccctgagactctggaactgacaccacaagggaggattacctggaatccatacaggggcaccttctaatagtggagagaaccctcatcctgggctcggtacttacagaactacagctctttttcctgctatgttaagatgcagtgaaaagaccacagaagccaggtaaagtggctcacgcctgtaatcccagcactttgggaagctgaggcggaaggctcacttgaccccagcatttgagaccagcctaggcaacatggtgagacctcatctctatggaaaacttaaaattagccgacgttctggtgcacacctgtgatcccagctactcaggaggctgaagtgggaggattgcttgagcctaggaagtcaaggctg

SEQ ID NO: 12267 - DNA, 12273 bp, Homo sapiens
ctcagtttgttcatgttgcccttgtccacccattcaccaggagtgggctcagattgtattcttgaatgaggcctcaatgccttttttggaaaaactaggtatggtctggctgctttctcataatagtccctgtcacagagccatcacccaaggagatgagttcagctaccatttttcacctttagacacagagatcccctaaggcatgggctgcagttcacatttgtaactcaggacctggtgcctgacatcctatattctctaggcactagttggtagtcttgggtgcatgagttgatttattagtttactaataaagctggtctgaactaaaaacttttgtcaaaaacatttcccccagctttttcagaacttgaaaccaagtgtgactggttgttttactagctagaatactttgaaagactctaggttataaaggtccctgttccctaggcctatgagggtaccttcacctcatctttgtagcaattttttttttttttttttgagatggattctcgcactgtagcccaggctggagtgcagtggcgttatctcggctcactgaaatctctgccacccgggttcaagcgattctcctgcctcagcctcctgagtagctgggattacaggctcgcaccaccacacccagctaatttttttgtatttttagtagagatgggctttcactatgttggccaggctggtctcgaactcctgacctcgtgatctgcctgcctcggcctccaaaagcactgggattataggtttgagccaccgcgcccggcctctttgttgcaatttatcatttaaaaacagtgcattttcacacacttgtctgtcagaatgagtgtgtccctttgggtgtgttggcttcatttccatgtgaaaagagaggttccaacacctgagaaggttagcagcggctaactggtaaagttgagtgtgatatatcagacgcagattttacttctgacatgttttaatgctctttggtaatactggcagtaatccattgttgctttagtcatatcacttttgtaggattatctgcagacatagaattatttctggctttttgaaattaaagtctaagttcttggtaattttagggaaacttcataagctagaacccagatagcatatggaaattccagaaatctccagctgctatctgcctcttttatgattaagtcttaaacactggatctgctcactcctcttcagagcttctattccaagcggtctttggctgtttcctgctttgattcccctactagactaagtgccacaaaggaaggaaccaccagtgctatggtcactctgtccccatgcctggtgccatatggtaggtactcagtagatgtacattaagtggtttccagaagatgcacaaagatgaccaacatcaatctgcaacctacttagtgaacatacagatcagttaatacctcagatgtggggaagtctttcttaagaaaatgaaagattagaggcagtctataaaatagaaaccctgtttattcacagcatgtgggagaactattaagttctaacatgtgatgtaactcacaaatgctgtctatcgccgaggctttgttatgtcccttggttggcaaattgcaagtccccccatccccaccacctcgtctacatacataaaggctccccagatggcccccaagttggcaaaatcagctgctctagccagaggcttcatcttatagtttccagcatctctaaactacaaagtaggcaaaggatctctaagcaagcattgaaacatttctaacagaatctccacacttactctcacaggacctaacaggcattctcttgcttagagactcaaaataactgttgggcccaagctttcctaggagacttcactcaaggggaaaagtatgctaaatttatggtccaggttgagcatccctaatccgcaatctgagatgctccaaaatccaaaactttgagtgctgacatgatgccgtaagtgtggaaattccacacctgacatcacgtgacaagttgcagtcaaaactttgtttcttgtacaaaatcattaaaaatagtctataaaattaccttcaggctatgtgtataaggtatatgtgaaatataaacgaatttcatgtttagacttgggtcccatccccaagataccttattatgtatgtgtgaatgtcccaaaatctgaaaaaatctaaactctgtggaacccttctggtttcaagtatttcagataaaggacacttaacctgtgttatcacctgccatctcatttggttcctgcagtgcagttagtgtacttaactaagtggtattaacagtgtttagagtttttgttgcaagccaatagacgaacttagcaaagagacactgatttagtttgaaaaatgcagacagtaaaattgagatgatttttacttaaaagccagattcgcctatagctaggttagactctgccccaactcttcagaaaaactatcagtcctcagattttctagcccaaaactctttaggtggcagaaaaaattgtccctggactacttacttccgcttaacaagtatatctcgcccataacctcagcagacagtatttttggactgtttgccttgaaagtagtctatcactctgttgtccaagtattcttttgagattaaattagtagggaccaaactaagcaattttgaatttatcaactaaccatgtagagggcagttgtattagccaccacaaggagctccctaaggcaggtacatttacaacgaacatcattatagacctcatcaagccctttaatacatttaatttcttataggctagtatgtgaaggtggttttccaaatgaaagtcagtatccaaagtgaatgcaatcattactttaagtcacgtaggcaactgccttgtcttaaacacttttccctgcactgaaaagaacaaatttacattctgtgagaaacagaaaatgggctagatatttaaaatgaattagctgtatttctatgctgtgtgccaagtcttcaaggtttgggatcaaaacccgaagccacacggctgggtactatgtgttcccttgatcttatggtcatgttctactctaggagttcttgttaagtcttatcaatttgatacctctcctggagcagaaggggcttgtaacaacttttttcctcttccaaaactgtaatgaaactactcaagtcaagtttacggttattcaattttatgacaggtagagacacttggatcaggtcttcacttcttttgagcatggagactgtcacctttgctagcaatgtttagtgttaaatagcagtctattgtactaaagtcttaatatttggcagctctacttgacctttatacatgctttaagtatctggggactcaggccataaaagcaaacaatcaaaatgacacaggacaggcactataggtaaatgccacataaagtgggcaagagggtgatccagggaacaaagctacactagatttcatgaagctgttactgccaaggagggcttggctggtgaccttcctttacgcagtccctgctcacatgagtgatcagtctttgataaggggtactatcatcgtcataccttcattggtgctatctggatgagccaagtttactttccatgccaaccagtttcctacctccaggtctattactaccaccagtaccaccaacccacttctcacaatgagggaattttctttctattcttaggctagttgctagccatatatgaatagctctcaaaaaaccttggttcttttagactctggccttaaagaatatatcataccacagatcttaatcttgactacttaggctgaaggaaaatgtcccagaacccccaggaattgtgcaatcaggtataccaacttcttgttagccttaagttccttgccagagtctcagtgttcacctgtcttgtccaggagtattgtggaacagcaccatgtgccagtggacagaaggggtatgtgtagaagctccagggtagaaagtcagcccacatgccctgagactttgaacttaagacagatgccggttgggattggtttagggtcaataactgcctcagcccaaatttcctccagttctggaagaatctgcttcctctcctttgaagaatttgtttttccattgttcatggcatgtcaaatatttcacatgtgacaaagtgaaaaggatcctcacctgcccaatacaaggtgaacatctggctttgactaactcatgtcagtagtttaggtgcattcctagcattctataaggtaaagttaacctctagtggaagggacatgcagcaaaaacgaaacttttctctcaccttcctggataattgtccctccttctggtataccttagcgttttgaaatgttacaaaaggcataatgcaagtcatggcactatactgagaaatcgtttaataagttagtattactcatctattaatgattaatgctagcgtttggaaactcttgtaagcagagcttttctaggctctcaggcttgttacacatcagattccatgttcactacacattcgtcctcttcaaagagtccaggcaggggaaggcatttgagagaacagcccgtaagagcctgtggagtctcctactttccattgaaaataacactgcccatgctgcccacttaagagtccgcggaaccatgtgaccaacctaaacgtgatcgcaccgctaaccaatcgcagagggcggaaaggccagtcccagttcacacgctccggacagtggcaaccaaagggcaggggcattcggagacgtaaaaaccccaggcgctgcccgacaggctccttgaccacatgctttaaagttcgctctcacttcaggagcacgtgactgcaggccggcagggcccctgaagccacccggcgacgggagccagggactctggaacgggtgttaagggcctgggcggctttcagtcccaattccctgcagctggcaagcaagcccctcggcgtcacatctgaagatcacttcggggacgcgctaggattccgactgagtcctctcagaaaggcttcctgtcgcctgtccaggaaagttacgaggccccaagtgggaacgtggctgacgaccaggcggggcccccaggcccccgcggcagagtctggggacccgacagtagtcaccgccgcccttcccaacaagacagggccacacgctcgctctcgcgctgctcctttgagctattgtgtagaatgaaggctaattacagtcactagcctaggactcaattcctctcgaggaaacgtcaccgggaaggagggtcagcaaactaaccagattaagtctcccctccactccccctccgcgttcagctacacgggagacccgagcggtttccaaacgccgcccgaggcggggaaaagggagaggagaagcgcccagagcagagtcctgcgtaaagccccgccgctcccctaccccgcacgccggagaggcggccccgcgccgggggagtcgcagtccgggtgccctcggctccgcggagcctcccggccgccgcccaccgaacgtgcgccagctcgcggccgccggaagactctgaagcccggccggcccctggcgctccgcgtccccggaggcgctcaccttctccccccgtccgctcccgcactccccggggttcgagggtgcgcccgaggctgccgcacacgtcttggccctctgcctccttcccaacactgcgcctggcagaggaggcagaaccattgttcaatgctcagaagcccacgcacctcggcgcccgtcaagagggcgagaaacgaggcaaagcagcggctctgggggaggcggagtgaggggcagaagactagttcaggcgaggcgtcggggcaccccgaaccccgctgttccccaagcccggctccctttagcctcggcgctgacagctcagaggcgccaccacggaggggagggagggaaggcgaggagaaccgagaggcgcctcctaggaggcgggtgggcaaacggagacctacgcctcggggtctcccggtgccccggctgggtcccgcccgccggcggaggggcgcgtcctyactcaccggttccggtggcgccgctctcccggggcgcccagcacagcgcgagcagcagccagagcgcccagagcgcggacgtgcccatggtgcccgcctggatggtgccgccgccgccgccgccgccgccgtycgctccgcacgacaagttaccagtccttccgaaaggaggaagaaggtgggggcggggaggggaaagggggagaaggaggggaaggagttggcgggggaagggagcggggaagaagagggcaccccctcccctacaacttgcacagtctcctccccacccacccagccacctccccgggctgcagcagcagtgcaagccgagcctgcgggcagaaaataatgcaggcgctgcagaggaggggaggcaaggggagaggagggaagggagagggggtggggagccgagagcagaagagagcacagaacggagaggagccggtagcggagcacccgcaccggcggcggccggagagcggggtgagcagcggggagggggccggagggggcgtggtcaacgggaggcgcggcgggcgggcgggagcgcggcggcttcggccctcctttccctcgacgcgctcctcttgcacgcgccgggcagccgggtgcccgcgcggggagcgtgcgagtgtgagcgtgcgtgagtgaccgcggtcgtggtcgtggctgccgccgccgccacccggaccgctctaggggcccggctgctccgcgcgttcgcctggggctcacgggggcccggggcgaccgctggttggctcgcgcgccgccctcgcctccaatcccgggtgcctgtcctaatttcctgatccagggaacctgccgccgcagcggctgtgcgctccctacagtcattactgtaccctcccggcagcctccggcagaacacgcagcagcagcagcagttagcgctgatgcaactatcgttgctgttgccaccgcctccccactgacggggcgtgcacctggggggtacttgcagtttccaggggcaacaagcatctctctaccaccctctcctgcgcccctgagagaggctggtaggtagcatcttcttcgggcctcctctatccactcagaaagtgatgaagcggaggggctccaaacgtttgggctgctcaaaagtggggtttgggatgccggtctcaatcgcacgctgagatgccgttttgccgaaaactaaatgtgtctttaagtgagagagtgtgtatgtttgaaagagagtgcgcgcggttgtggctggtcctctgtaatagaacaagactgaaataacccagcctgggatgaggagaagggaaattgctagcgcagctttgcatttgctcatcaacgattatagttaattgctaattgcacaaaatgatagtttgagggcctgtaattaaaagcttaaccttttcttgtttggaagagaggggccccatacgtttattcctcttgatatactttgtaacattcaattacaagaatcgaggaaagaataaaggaagcaaagacaagactcctagaaagggttggttcttcttttgtgcctgacagtacctgagtctataatttgctttttgtgtacttcagttttcttgcacacttagccctggttgaggtgcattgtctgctgtggtctgttgagcatctaaccagagtgggagggcacatcgagcgatttcactttcttaaataaaaggtttttggtattttgaaaaagttgtttttatcttaattcaaacttggaaggtttcaataatatcatattctgactctattctgttggtgatctgaagagcagcgggcactgcctcactgtcttctccttgccctggttctcctggaaatttgtcaaggctagcaatcagaggagatgtttattaggaacttactatatccaggagacacacaggagaggaaaattccagtcaggataggtttctgtgggccaaagatatcctgattgtgactgctaagcatgaaagggcttaactctacgtatggatggtatcttgcactatagctcattttgaatgctattttgcccaccctgtggttacatagttgatacaaactgcagcagccacacaggttgcatgtgaaacaactgaaatttgtttgtatgacatttagtagtgaagatgcatgccggtgttattcacctaatggcattgagatgtgataggaaaaccttagtgcatgatgtctttcatattctcagggttctgaaatgccatctgatgagctactgctttacagaagaggaaaggagtagaagggatgggtggaatcaatacaaaaagaggcagcattaataaacagtcatatgacttgtttttaatactttactcagagatacaggtatactacaagctatacattgatatggtataataagacttaactttgaaaaacgtgtgtgagtactttctaattctccaagggatataaataaactttcagtgaacttagctgcagctctgtattcaatcctgtagcttttttgttgactcaaaagaaagcataacttttggctccatctctgattgactgtgtaacttgggaaaaatcactgtgcctctctgtgtctgccttttggcctgtaaactgaaaagaaagccaagccacattatatcaaagtgctccgtggcctcaaggaccagctctctgcaaggtgttgtttattagaagaaaaaggttgtatggagaaattcattggattatgatagaaagtagctaataactaaaaagataaattgatgataagtggatattgaagtggttgaactaacagagctaattgatcataagtggagactgaaatggttgaactaactgggttcagagaagttgacactgctggattcccgacgccgtcaggtaaatgcagaggcaatcccattcactcctacaatccaccacattcatttatttgttgaagcaacacatagtgagcatccctggctaacgggcactgtgcaaagtagtgggcatacagaagtgcttatctaggaagctcagcatctggtaggggaggcaggcaagtgggcaactgtagtaccctatgtatagcactctgattaagagatgcttaaagtgctagaagattgcaaggaagaagcagctattctggctgcaggatgaaggtatcagaaaaggcttcacagagcgtttgtctctgagcttttttcataatttttacccggtgatctgaattctccctacttctggacacatggtaggattggacgtcctggcccccttatggttggatggggtcgaaagactaactttggctaattatttgtgagcctaagttacagggtgccactttcagaccggagcacttaattgcttatgtgaaaccctctctttgtgtctgcgtggtgacaagaaatgtttaagaggtggctgctgcattagcccaggtctccgagtgattcgattcatttagaactacccatgtgagtagttccctgctgtctatgtgtctttagcactggtcacatagagtagaggttagcaaactagggctcatgggccaagtctagccagtcacctgcttttgtatggcctacaaataagagtgatctttacatttaaaaagagttttacaaagaagaggaatagtgtgcaacagagactgtatgttgctcccaaagcctaaaatatttaccatctagtcctttagaaaaaaaaaaaaatcaaacaaacttgccaacccctaacatagaacgggtgagagagtagtaaatctttgtcatcttcatctactgagattttgttacctcagcataacctagtgttaacctgactgatacaccaggggaagagggaaggaaaaccatggtgagcagagggcacaaaggcaaaacagcagtatctattcaaggcaatggaagggattcagggtgattcaagggtggggttcaaatggactaacaatgtgaagtaaggctgaagaagaaaggcaaggactggattagctggagtctaggatgtcatgctaaggctttggattttatcctgtgaaccatagtaaggacttgtgatagattttgatcagaggcctgacatccagtttcttttactgtgacaatggtatggaaagcaacttgtttagggtgtgggatagggtcagactagaggaagaaacattagttagaggccccagtagtgagggagtgcattgaagaaagtagaggaggctgggtgtggtagctcacacctgtaataccaacactttgagaggccgaggcaggcagatcacctgagctcaggagttcaagaccagcctgggcatcatggcaaaaccccacaaaaaatacaaaaaactagctggacgtggtggtgcgcacctatagactcagctactgggggtggaggggggcctgaggcaagagaattgcttgaggcctggagggtgaggctgcagtgagctgtgatcatgccattgtactgctgcctgggtgattcagggagccgtgtctcaaaaaaaataataataaaaataaggggaagaaactaccgtttgattagtcagaagcattcaaataattcctccatgagatttttctccttgatttttttggctttatctccttgaagcattttccaaacatatataatccctgtgtatcactggctatgtctgctaaaagtacagattctcaggcccctccgttgatgatcctgattcaattggtctagggtagaacccaggaatctgtatatgtaaccctattctagttgattcttaggattagtcatgattaagaaactgttttagagaatgacttcttcagtgccgtttaattgctaagtaggtttacttctgtcatatttgtgtaaattaatttgtcaaatttctcctaagggagtaggttaggacccatagaaaatgctaaggttgatgcttatcattatttttcttcaagatccttagactgataatattggcatctgaaataatcttcaaaccaatttgctaatttgtagtactcatcactgtgatttctaccccacagcctcagcatagaaagtaagatgtgaaatgagctgtcctcttctggggccatccccttctgaagtgtttcgatggtaacttcacaggcctccattccattattttctaattgtgtgacagcccagggaaatgagtgggattccccccttctaggctccatgagtaggacctgatggtcaaaatcagtgggtcatgcattttagcttccatcagaatcacttggaaggcttgttaaaacatagattgctgggccccacctccagagtttctggatcagtaggcccaagaatttgcatttttagtaagttcccagatgatgttaatgccactggtcagggagcatactttgagaaccactgttctgaacccattgacatcacttccccccttagctactgtaattggtttaagggcctcagccagtcaacctatgaccttcctctgttggcattgattggatgcttcagccttaggcacattacaaaagctagctcagttacgacgaagctcagggcttttgcttggctagaaaggcattatcttctaagtaatgagatgtgtggacgtaaggccagaactgcttctgccattttgccaccctgaaggaagccagttggaagacgaaactgacttatggagaagaggaaactgaaataaatggcactcatatttgtaagcccaagcccagatcagcttgtttcaaaagctgccattccatcggacttcttgtttacctgcaccaaaaaattccctttgttgctgaagtcggtttagattgcgttttctcttacttgctacctaaatgacagaggtgccctcttgagggatggaatgtgcttacctgaaagcaataggcaaaactctgcacatggctaacccctcctggagggcattcagaagaggaatacaggtattagtaaggacagttttgaacaactgtattcttgtgtaacctggccagatgaattccccactctaaatcaggggttaatgtggacgtattataagtgaatgccgattgagggttacaatctggtaacgacaaggtttttgaaattccaaggccaaagacaattttacacactgcttttgaacaatttcagaaagtaaaaaatgtggccaaatgtaaaaacagtggaaattccaaaatgggttgaata

SEQ ID NO: 12268 - DNA, 66887 bp, Homo sapiens
acctggccgtgttctgggtggagtttgtgatgaggcacaagggcgcgccacacctgcgccccgcagcccacgacctcacctggtaccagtaccattccttggacgtgattggtttcctctwggccgtcgtgctgacagtggccttcatcacctttaaatgttgtscttatggctaccggaaatgcttggggaaaaaagggcgagttaagaaagcccacaaatccaagacccattgagargtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaagtgttttcactggtgtcgcatttatttcttgttaagttgcattttctaattacaaaagtaatgcatgattatgacagaaagtttggaaaatatagaggttcacacacacacgccttcattgcgtgtgcatgcataaatgcatgagaaaagaaaaataaccagtaatcacatcgcccagaaataaccccagttacaattgtggcaaatacacatacttataaatattgcagatatattaagtatacctagtatttgctaacactctttcttctactctgtcatgaagattctcccaaggtgtttttgtataatatttaattcattttcagtggccaagcagtattctacttcatggatataccaggatttatttaaccataacttctggttggattcactcttattattttgtttaattaaaaaaaaaagacctcggctgggcacagtggctcatgcctgtaatcccagcactttgggaggccgaggtgggtggatcacctaagatcgggagtttgagaccagcctggccaacatggcaaaaccccgtctctactaaaaatacagaaaattagccgggtgtggttgccagcacctgtaattccagctaattgggaggctgaggcaggagaattgcttgaaccggggtcagggggttcggaggtcggaggttgcagtgagtccggatcatgccactgcattccagcctgggtgacacagccagactctgtctcaaaaacaacaacaacaacaaaacaacaacaacaacaacaacaaaaatctcactggacatcctagtagctaaggctttccacatattcatgattacttctgttggaaagtgctttacaacaaattgctagttgtctcagtctgggttcccctgagatgaggattcaagggccaggagtttatttaggaagtaaaggaaacactgatagaggagtggcagagtgagaaggggtgatggtcatccacagctggctctcttgtggtcaatcggagcttaatcctgctgggtgactctgggagccagtggagaaaagacaccccagacttatcccaatgaggaacacggctgttgggtgcctgagtacttgcctcgtcagggattgaaacgtactcccaggtagtagtaatttctctgcccttccattaggccacaaagggggctctgacagagagagctgacgagaaaaaacacacgcccttgtcactgaagaggtacacaggggatctgtgtggggcaccacctgcactgctaccctggacaaatagcttaagaaatccccacactgcatccccaaacttactatcagcgtgtgagggagacaggttcccacaccctcattagcacaaagtactatcttgaaaaagaaagcctgtcagtttgataggagaaaagcaggatcttgtttacaatgtgcttttattattgttattattagagattgtatttcttttcaagctgatgagccgtctgtgtttattttttggaggataccctttgcccactttcctattggagtgtattaccctgaggatttggtaagagtgcttattgcattcaccagaatgtcctttttgtcatttactgtattttctctacttttttttttttgccttgttttactttttttgttttgtattacaagcagaagttttaaatttgtaagcttcaaattggagctggggtggtgcagagcgaagatttcagctggttccctgaccccagctccatctccttccctaggcagtggctggaacacattctgtccactatttccctctctacatccttgaggctgtgcagtcacccctcaactacgttcaccctccttcaaagcccttcctggtccacccggggaccatctcccggcctcactgcccctagctccttgacgccccaacctctctcagggaccccaagttgccatgacctctagccagctcatgttcatttgcaccttcgtgtctgcagcactgaggcactcttgtttacaagtgagagaacccaactcgggataccttaagcataaacagtatttttgtaaggagacaggcttctgacgacgcgaggctcatagccaggcctgcgctgggtggagcctccccttctcactcctgtccctgttgggtcagagtgccagctttcctcttccctctcctccgggtcttttcggcccctcagtccccatattcctctgccctagctcccaagatcccacaagagacagactggattctctctggcctggagtgccaccttcctgaaagtcagaatctgattggtccagctggatcaggtgtcctctccctgtccaatcatcaatgccgagagggattacggagagaaaaacatggctcccaccatcccattgctgtggctgcttgggccacgggagagggaaccttgtgagccgggcagaatccaccctgtagagactgcctctgggtgagtcatatggtttggctgtgtccccacccaaatctcatcttgaattgtaattcccattacccccatgtgtcattagagggacctggtgggaagtgatttgaattatgggggcagttatctccatgctatttgtgtgatagtgagttctcacaagatctgatggttttatagggggcttttccccctcttgctcatacttcctcttgcctgccaccatgtaagatgtgcccttgctcctccttcaccttctgccatgattgtgaggcctccccagccatgtggaactgtgagtccatgaaacctctttttctttataarttacccagtcctgggtatttcttcatagcagtatgaaaatggactaatacagtcagcttctgcacaatatttccattttcccacattatgtcttgggccttttgtgtatttaagctcacaggatgctacgaataaagcgttttcttatttcctgggtagttcccatagaagtagtggtgcaacgtgccatagagtgacagcacctaagagaagctgattttgtgagtggattgtgagttcaatattgttgtcataatcagaaaaaaatgtatttactttttttttttttttttttgagacggagtctcactctgttgcccaggctggagtgcagtggtgtgatcttggctcactgcaacctccgcctcctgggttcaagtgattcttcctacctcaccctcctgagtagctgggattacaggcacatgccaccccaccacacccggctaatttttgtattttttagtagagacagcgtttccccatgaaaaaaagtattttcaatttggaaagccaagcagagcccccttcttcctccttggtctcactgtcttcatgtcctctgtagataacatgctcaggggcctcttacttttggccatggcttacacactcgacctgtgtgtaatttaaaaatgacccctttctccactcctcctgattgccatatccttcacaatgtgactttgcaactcttctcatgaaaaggaggaatctatttctccagcctgtgggtcctggctggcctgtgacctgccctggctgacagagtgtggcaggtgatgagcactggtttcaagtctaggcctcaagaagccttcatattcccgctcactgtctcagaaccctgtccagctgctatgagaacagcctgggtgagccctgctgcacaatgtccccatcaccctagtcatttcagccaatagcgagccaatggccagccctctagctgtctgagatacatgggtgagactctagttgtgcttggctggacagagcacagatccacagacccacgcaggtgactcatacacttgtgaactataataatcggttgttttcagtcattaagttttgaggtggtttgttacacagcaattgctgacacattcacttctggctctaaatgtatcacttttcatgtgttgagtctgaagaccttcagaggacagagatgtgttccacctaccctatatccactgcagcatggaaagccatgcttagctgcacacagtaggcgtgcagtctgggcctgtggaatggacttggcaaccacatcacctcagtgatctttcaaacggaaaagaaggctcagtggggagtgggaggaggtagtgcagaggggcagtcctgtgaaagaaggggcatgggatagctgcttgtgtctatttcatgttgatcaatgtatctccaagtgcagaacaaggaataacgcaggaattttatgaggaagaaatgttgggcatgataagaaagctcattttctaaccatctgaattccatgaagtagaaagaggctggtcctgagagtaatgagctccctcgtattggaggtgtccaagcacaggctgaggaactcccatttggctggatgggcaaacttggagtggaaattccacwtaagcaaccttggccctagatgtctctgagttttgttcctgttgtcttgcagtgcatagaaagatttcccaaaggccaatatttcattgttgtacctatgatctggatcatctctcctagctataaatgacagggaaatcctttgggctccacttttggtttaggaaatcagggtgcctcctctcctacctgtctttgatgttctttatcttgtaagtattgtgctagtggaaatccaatttcttatcctgcaagtyatccagtccccgggaaggaggagtgctctccccagggcctctcagtctgcccctcctctcctctccaactgtcctgaccacacctccccacccagggctcacatgactgtgttcccctgggacttggttgtaagccatccccacttctaccatctccctttcccaaacaggcccctgtacttcagcacacacatgtgaataacagaaatgttgaatgacaacatgatgtggagttttcaccccagagccctgtgcactcttcaaagacctgggttgatagagactcagggaggcagttggatctcaaagttccgagggtctgggatctaacggtgatagttctagtgaaaccctcccacccttccaggagacccattcctataagaaatatgactgaagagcccagctgtctcactttgataaccaattcttccatttgcatttccattgatgtgtattgggccaagagcagagctttttcttgtggttaatatctgtttaatccagaagaagaccctaaggaaaggtcagtatttaggtcccagagtagctctttaaaatcctttaaaggaaaagagagtatgggatagtaaagggccatgggatgratctttgaggatcaaggaacttgggacaggaggagaaaggatctgagagcctttcttccaccatctcgacatctatgttggtgtttctcaatttttaagaagctgtggatgttgagagaaccccttaaaggagttatgagagatrctgatatgaatttctcattagccattaattatcagtgtgtagaagagagggcgagagggctctwttaaactaaggatattatctattgctgtgtaacaaattatcataaactcagtggcttaaaagaacatccattgattatctcacggttccactggccaggagtctaggcatggctttccttggtcctttgtttagggtctcagagactgcagtcctttctggagtycagcttcctcttccaagctcatgtgcttattggagaattcagtttcttatggttgtaggactgaggccctcagttccttgctacgtggccctcaccacaggcagtttgcatcatggctgtttacttttcaaggccagtagaatgtttctgttcaatctgataagagggaatctcatgtggcatagtgtgatcatgggaatgacatcccaccatctttgccatatgatgtaatccactcgagagagggtcacccatcacctttgccatattctgttgattagaaggaagtcacaggttccacccacacaccctcaaggggatggctttatggaagggtgtgggtcgttggggtcatcttaaggtgtgtgtcacaccccgtattttacaaattctgttgatctcaaaagagcttgaggaagagatgactgaagccattacagaagcagcagtagmctcaagtgaggaggtgtcagaggaaagagacgacctggggcctcttgaattacatgacagtggtaagaatgtcatccacatttctgctttcctgccccatctcagacactaactctttgactgcagccccagcctaggtctccctttctccatctgcacagtggacatcataccacacatgaagctggagctgcgcaggtggaggcaaggccagggacacaagggcacctcctgtcatggtcatttccacactgcacctgggtggcgtttgttttcataggtacctttcaacaagtcgtgaaccttctggacatcattgacagcgagtcagcaaagacggacacaacaggggcaggccttgacatgcggaagaccctggcctcggtgataatcatggagaaggccaccactgagccttctgtagtgataaacactctcatccgctgcctgcaggtgccagaggtagggccatcttacccactgggctcagccacctttagctctgtgtgcatccatccaccacccagcacatagttactgactatcagagatgtgatgtgtggtactgggatacagagatgggcaagactgtgaggtgcttactccctgaggaccaattgggacctgagatgttcataatttttaaaagttcccttgtcttctgacacagtgggtttgggagccattgtcctacagcacatgagctgagttgcaaagatgttgagccagtgggcatgggagagtaaagatacaccagacacagtgtgcagggatgtttggctagtggggagatgcctagctgggttaaggggctggggtagaggatgttggagggagtgatacaaagtgcaaccaggggacctggtgggcttgtacagacaaggtttgcatcacgtggtaccagacaaggttttggactagacaagggtttggaacagagctgatccaaaccttgctgggcaccacccccagagtttctgattcagtaagtctggggtggagcctgagaatcagcatttctaacaagttcccaggtgatgccaaggctgatctrgagagcctactttgagaactgttggattttagactacccttttgtcttggagtgggtagcaaaggggtgctatragcagaggagcttatttataaaaakttttattatttttgttggatttggatttgcatttgcgttttcccccttttatttttagttgacacataacaattgtacatatttatagaatacaaagtgatatttcaaaacatatatacaatgtgtaatgaccgaatcagggtaattagtatatccaacactgcaaacatttatcatttctttgtgttgcaagcattcaaaactgtttcttctagttttttgaaaatatacratcaatcattgttgactatattcacaacctacagtgctatagaacacaagagcttattccttctctccagctgtaattttgtatcttttaatcaacttctccctatcctcccctgcccttacctttccyataccctaataccgaaattctactcttgacttctatgagctcaccatttttatagctcccatatatgagtgagaacatgtggtatttatctatctgtgcctgactcatttcacttgacataatgtcctccagttttattcatgttacggtaaatgacagggtttcttttttttatggttgaataatattccgttgtctgtytataccacattttctttatcccttcatacattgatgggtacttacgttgattccatatcttggctattgtgaatagtactgcaataaacatgaaaatgcagctatctcttagatatattgacttcctttcttttggatacacacccagtagtagaattgctggatcatacggtaaatctagttttactttttttgagaaacctccatagagttttccataatggctgtactaatttatagtcttaccaacaatgtgtgaggtttcccctttctccacatccttgctagcatctgttattttctatattttggataaaagtctttttaactggagtgagatartatctcattgtggttttgatttgcatttctctgatgattagtgaggttgagcatttttttatatccctgttggccacttgtatgccttcttttgagaaatgtctgttcagatcttttgcccatttttaaatttgatttttttgctattgagttgtttgagctccttgtgtattctggttattaatcccttgtaggatggagagatattctcctattctgtgggttgtctcttcgctttgttcactgtttcctttgctgtgcataagttttttgcttgacataatcccatttgtctatttttgcttttgttgcctgtgcttttgaggtctcacacaaaaaatctttgcacaaaccaatttcctggagcatttccccaatgattattttctagtagtttcatagtttcaggtcttggatttaagtctttaatccattttgatttgatttttgcrtatggtgagagataggggtttagtttcatycttctgcatatggttatccagttttcccagcaccatttattgaagagactgtcctttcaccattatatgtgcctagcacctttgtcaaaaatgagttgactgtaaatgcatggattgacatctgggctctctattctgttccattggtctatgtgcatgtttttatgccagtaccatgctattttggttactatggctttaaagtatattttgaagtcaggtagtatgatgcctccagctttactctttttgctcaggattggtttgtctgtttggagtcttatggttccatgtaaaaattgtctgtaaagaatgtcattggtattttgatagagatttcaatgaatctctaaattgcttctggtagtattttgataatattaatttttctatcagtgagcatgaaatagctttccattttttggtgtcttcttcaattcttttcatcagtgttttatagtttcccttgcatagatcttycacttctttggttaaatttattcctaggtattttatatttttgtggctattgtaaatgaaatggatttcttggtttctttttcaaaatgggtgaagtgttctgttgtttgccatttggcatatactaatgttactgatttttgtatgttaattttgtaatctgcaacttaactaaatttatttatcagttctaacagtttttggatggagtctttgtatttttctagtatgagatcgtgtcatctgtgaacaaggataatttgacttcttcctttctattttgtatgccctttgtttctttctcttgcctaactgctctggccaggacttccagtattatgttgargagcagtggtaaaagtgggcatttttrtcttgttccagattttaggaacaaggctttcgatttcttccatctggtacaatgttagctgtgggtttgtcatatatggcttttattatcgtgaggtatgctctttctatgcccagcttgttgagtttttaaaaaatcataaagggctgctgaatttatcaaatactttttttagcatatattgaaatgatcatatgattgttgttcttggctctgttaatgtgatgtatcacatttattgatttgtgtgtattggaccatccttacatccttgggatgaatcccacttgatcacggtgaatgatctttttattgtgttgttgaactcagtttgctaatattttgttgtggatttctgcatctatgttcatcacagatattggcctgtagttttctttttttgttgtgttcttgtctggtttttctatcagggtaatgctggccttgtagtatgagtttggcagtattccctccttatccatctctttttttgaatagtttgggtagaattggtatttgcttttatttaatgtttggtagaattcagcagtgaatccatccggtcctgggcttttctttgataagaaactttttattactgtcaatctcattattcgatactggttcatcggagttttctatttcttcgttgttcaatcttggtagtctgtatatgtccaagaatttatctgtttcctataggttttcaaatttgttggcatgtagttgtttgtaactctaataactctaataattctttgwatttatttatttattttggtgacaagagtctcacactgttgcccaggctggagtgaagtggcacaatcttggctcactgcaacctctgcctcccgggttcaagcgattctcctgcctcagcctcccaagtagctgggattacaggcacgcaccaccatgcccggctaatttttgtatttttggtagagacgggccatgttggccaggctggtctcaaactcctgacctcaagtgatctgcccacttcggccgcccaaagtgctggggttacagacgtgagtgccgggattacagacataagccaatgtgcccagccagttctttgtatttctgccagtctcagttatgtatcctttcatttctgattttatttatttgggtcttcactcttttttttttatttatttactctagctaaatatttatyaattttgtttgttttttcaaaaactcaacttttcttttgttctcctgtattgttttattactcttgattttgtttatgtctgcactgatctcttgcccttctttaaattttgggttgggtatattcttgctttttttagttccttaatgtgtatcattaggttgcttatttgaattctttctacttttttgagataggcttttattgtcgtaaacttccctgttatactgcttttgctgtatccaatagatttttgtatgttatatttctatttccattcatttcagtaaaattttaaatttccttcttaatttmtttattgaaccagtggtcatccagcaatatattacataatttctatgtgtttgtgtattttccaaagtttttttgtggttgatttctagttttattccattgtggtcagaaaaaataatgtgatttatagttttatgaatttgttgagacttgttttgtggcccaaaatatggtatattctggagaatattccatgtgctgatgagaaactaatgacgttgaaatgtgacctcagagttggaggtgaggcctggagggaggtgttcgggtcatgggggaagatccctcatgaatgtcttggtgccctccctgtggtaatgagttcacatgagagctggctgtttaaaggagcctggcgcctcctctgtctcgccttctccctcatcacatgatgcactggctccccttttgccttccaccatgggtaggccttactagaagcagaggccagcagcatacttgctgtgtggtctgcagaaccatgaaccaaaataaaccacttttctttataaattatctagcctcaggtattcctttatagcaatgcaagaacagactaacacgggcttttaaaaaatgtaggccaggcgcagtggctcatgccactttgggagcactttgggagccaaggcgggcggatcacgaggtcaggagttcgagagcagcctgaccaatgtggtaaaaccccatctctgctaaaaatacaaaaattagccaggcgtggtggtgcacgcctgtaatcccagctacccgggaggctgaggcaagagaattgcttgaacccgggaggtggaggttgcagtgagctgagatcgtgccactgcactccagcctgggtgaaagagcgagactccatctcaaaaaaaaaaaaatgtaggctttgtttttattcagctatgatgagaccaacagctcaggagacacttgctcttgaaaggacagtttattggctgggtatggtggctcatgccaggagtgcaagaccagcctgggtaacatagcaagaccacatctctaaaaaaattaattaattgggtatggtggcacctgtctgtagtcccagctacttggcaggccgagatgggagcattgtttgagcccagcatttttgagtcaaggctgcagtgagccattttgcaccactgtactctagcctgggtgacagagcgagactttgtctcaaaaaaaaaaaaaaaaaaaggagaaaagacagtttgttacattcccaagagagggggccaaccaygccatgcagggtcacacaggggaagcactagggtctgtgaggaggcagagggagtcaggggaaattataggcaacaggctttattgtggtttctgtagaaagaaactggtgaggtagggtaagaaggcttagaattagctaatttgaatattctcagtggactctggggcaaagtagctgtccctggctgtttgatacctcccctgtgtgattaggacaggtggatagtggcccagagtgtgagagcccaataaaggaggtgattgggagaggggctctgtgttggttggaatactgtgttcaggatgccctaatggagtactatagtatgggtggcttagaaaacagaaatttattttctcacaattctggaagctggaagtccctgattgaggtgcgatatggtttggctgtgtccccacccaaatctcaccttgaattatagctcccataattcccacatgttgtgggacggaacaattgggagataattgaatcatggggtggtttccctcatactgttctcatagtagtgaataagtctcacgaratctgatggttttataaggggtttcccctttctcttggctctcattctctcttgcttgctgccatgtagaacatgactgtgttccccctttgtctcctaccatgattgtgaagcctcccaaccacgtggaactatgagtccattaaacctctttttctttataaattacccagtctcaggtatgtttgcattagcaatgcgagaacagactaatacaaggtgccagcaaatttggtttctgtaaagccttgcttccttgctggctttcttgtgtgactgccctctcactgtgtcctcacgtggctctcctgtgcatgcgcacagtgggagaaagcactcttgtgtcttctgcttcttttataagggcaccaatcccatgagattagggtcccacccttgtgacttcattcaaccctaattacctttcgaagggctcatctccaaatactatcccactgggggttagggcttcaacataggaatttttagggtacatkattcaatctgtaacagttgttttgtacttaaaaagcatgctgatggacaacttgttactatctctaggaactggctagctctgggaggagtagtctctctagggtcagcaaggacccaggtgccaaagcatcaggaaatgaagaaaataagaaaccatgattaacacacaggtcttaatcagtcatcagtggcaataaacagacaataaacaaataggcacattttaaaattaacatgcatcaaagattttattttctccttaactagttaaggaactagtaagatgttaaaagctgttcaaatgagaattttacctgtgctttaccagacaaaatccatttgcactgccatgaacaggaatcattttcattcctatgtaggaaacacgtgcattgttatcagttttctaggatttaacttttttccctacagagatgtaaagtagccttggcaatcacagatgcacactctacagaatccagtaattccacagcatctgccagacagaaccaagctctgctctggaaggccactcagtgatcgcttttgttatttccaagtctttgacagtttttctcttgtgactataaatattctccgaagattattcttgatcacaaaaaaggctgatcttcttataatttgcctggctatttgtacagggtgcagtaagagtgttaattaagcatattggcctccttgagtttactgtgaaaatctagagcttgcattctcaatggggtgatattgccccccagttaagtaaaactagttcttgggggacaaagaaaattttactttttcattataaagcatggatatgtataacacacacacacacacacacacacatatgtatatacatatacatatatattatatatatatacacatatacatatatattatatatacatatacatatatattatatatacatatatattacatatatcatatatacatatatattatatatacatatatattatatatatcatatatacatatatattatatatatcatatatatcatatatacatatatattatatatattatatatatcatatatacatatatattatatatattatatatacatatatattatatatatcatatatacatatatattatatatatcatatatacatatatattatatatattatatatatcatatatattatatatattatatatattatatattatatatatatatatatatacatatatatatattatatatacatatatattatatatacatatatattatatatacatatatattatatatacatatatattatatatacatatatattatatatacatatattatatatacatatatattatatatacatatattatatatacatatatattatatatacatatattatatatatacatatatattatatatacatatattatatatatacatatatattatatatacatatattatatatatacatatatattatatatacatatattatatatacatatatattatatatacatatatattttatatatatataatatatattttatatatacatatacatatattatatatatacacacacatatacatatatatggcattaaagtctcgttggggtgtgattaggaaaaaagtctaaatgtccttgggagtaataataataataataataataataataataaagattgagaaacactggtcttgagccacacagcactgagcagctactaaggccacatcattaatttctgggagctgtcatagggatttctgattggagttttacaaatccctattatttgctatcccaaaagtaggaaaccaagaccaagactccctgtactggatttcaccagtagaacttacacatttgggtgaattcctctcttcttaaggtccccaaatttgctaaggattctggactgttgggagtgacctccctaccaccagaggaggaaggacattttttcctgagggctttgcaggcagtggctccacctagaaagtaaccctcattccttaagagtggcttgtcagccgggcgtggtggctcacgcctgtaatcccagcactttgggaggccgaggccggcagatcacgaggtcaggagatggagaccatcttggctaacacggtgaaaccccgtctctactaaaaatacaaaaaaaattasccgggcgtggtggcgggcgcctgtagtcccagctactcgggaggctgaggcaggagaatggcgtgaacccgggaggcagagcttgcagtgaggcgaaatcgcgccactgcactccagcccgggcggcagagcgagactccgtctcaaaaaaaaaaaaaaaaaaaaaaaaaaaaaaagagtaacttgtcatgcctgattaaaagtattctcaaatacgaccctccaggtgtgatctgggatgtgcaatctatctgcccaatcccatcctaaaccaggtcattttcagtggtgataagcgctatcatgcaggaattggaagagagtaagaggcaattttcctgggcccacagactccctcaatagggcaaaggcaaggtgagcctgccttctttgggctttcaagatggccaatgccccatgcatagagaaccttgtgtgttgatcacttaacacctgccttgccagatatttactgaaatcgggcaggaatacagatacgcaagtcatattgacagggccagtgggatgagaagggcaggagaagcgaagcaggaggatttagaaatggaggaatggggatctaagatttgtgtgtttggaggctggtggtttgggtgtagggaaggaggacagtgggagagagaggtggacttgtgctgggggcagggtgaggtccattccacccaccatacttgtttcccagatttccacccagcgcaaggtcaacatttacaacatcctccaggacatcatccagcaggagggggagctggaggagcagtgcgtgcagaggctggtggccattgcctccaaggagatgagggagatcccagaggtaggaccccaagctccatcggtgccttccctctgccagcccaggagctgggccacggggggcctggcccaggatgcccacagccctgtgcagttacctctcagagcaggggtaaggctgagcccaagggaaccaggaggggtggagagagcctggggtaggaaggttttcctggaggcccggctggtggtggtgccatatgtccctcttctgtctcctgcagatggagggctatatgaaggcagaggtggccagcgacacactggtggctctgtcccgaaaccacttcagcttggtcatgtacgagctgcagcaccacctcaagcccctcaacctcactgatgaatttgtcatcatcacactggccaagctggccaacggcaatggtaggggcttgagggccctcagccgggcccagtgtgcccttctggtctctgcctctctctgcccctcccatctatccctatgttcacctcttcctcttacctttcatttctctctttttccctctaaaaytgattcattttgtgtctgcagtccttttgtctcttagctgttaagattctgtgtgttctgtctctcatccttcttccccctctctcctgctcccctccacctgcattgttctgtctttccatctctttcttttttaatttccttccttccttcctctttcgtttccttttttattacctgccttacttactccttcctctccctccccctttttctccttcttccctcccttcctcccttcctccatcccacccttccttcctccccttttcttctctccttcctccctccctccccccttccttccttccttccttccttccttccttccttccttccttccttctccatcctccctcccttcctttcatcccagaagcatgcgctgagctcctactccatgcaggccttgtggcaggtacctggccactacaatacataagacacacatggctccggtgctcagaaaggaccaacaggcaaacaaggaaatagacgtttataacaggaggtgacgggtatgaagagagcagccaaatgggcgtttgagatctggctaagggaggggacctcatctctgcagcccttgttgaggtagcgatatttcagctaagacctgaaggcagagaggaggatgtctgtgtgaagcataggaccgggagagcattccacacggagagaacattgcagaggctctggggcagagaagagcttggaatctctgaagagttgagaagtggctgtggctggagttaaggagtgagagagagatgagggggagcgtcaggcagggccttggggacgtcacctcgggcactaggaagctatcgaaggacattaagctgcagggtcgcctggtgaatgcaggttgtgggaaggcctttctgactgctgcctggatggagagtactaggaggtgggtacttgtgatggtggctgggctgggaagcatgtggtgaggggtgacaggtgggaaggggctctgagacgggacctgctgaggacgggggaaggagcagaggtagcaagccactgggagcgtgttggcctcctttcccgagctagaagcactgagagttgggagctcaagtgaagaacttcatgctgtgtgtggagctcatgttgcctgtgggagcccccaggggagaggtgaagggggcagttgatttgtggcgcggagttcagagggcaggtctgggcttggctttggttcttggtgacctcagagtgcaggtgatgttcaaagccattgatatccgggagtgaaagtagagagaggacccagcccggaggggtcctggcattggcaaggctcgggaggagtcgtaagagacagcgtggaatgtgaggcctggcacagggagaacaatctcaaggggtgmaggcccccgtgatgcccatcctgccaaggggtccagtgagataaggctggagaaggcgggaggtggaagagcttcacggcttgctggggataaaggcctggatggagtgggaggggaggaasggaaggcaggcctggaaagaggacaagggacagcagcgagggggattattatgaagtctgaagatgggggtgcactcagggtgggtgaagtggaggggcctgcctcctgttgcagggtggcctgttacggctcccttccttcatccgtctgctctttttctctgctggcctcgtgccttctctcagttccttgctctcacctgctgtctccctgcttctgtgttcgcccaagaacgtttgtgggacccctgaaggaggctggcctgtgtccgggaggatggacgcactctgggggctgcttctttctgcttcttgcccctccttccctggggctcctctgtcctctcttccctccctctctcggacctcctcttccttctcctggtcctctctcttcttccctttcctccccttttgcctggctttcttcctgtgtcacctgcttctagctcactttttttttttttttgagatggagtcatgctctgtcgcccaggctggagtgcagtggcgcgatctcggctcactgcaagctccgcctcccgggttcacgccattctcctgcctctgcctcccgagtggttgagactacaggcgcctgccaacacgcccggccaattttttgtatttttagtagagacggggtttcaaccgtgttagccaggatgacctcgatctcctgacctcgtgatccgcccaccttggcctcccaaagtgctgggattacaggcgtgagacaccgtgcccttctagctcactttttaatgcttttctgactcctggactatttcctgggccccagccaggacagagggctaagccagctctggactgttaggggttggaggtggagggcagcagggttgtcctctctgccttctctctgctcacccccagccccaacttcctgtaatcatccctcacaacctcacagtgtttgagttcatgccatacatgggcatcaccctggctaccatattcaccatgctgagacttgccaatgaagccaagatacgccaggcgatctgcagtggtgagtgtcccacttgagcctgcaggtctggctcgatcagggcgccggagggagactgctgggtaaggagcagatggaggggttgttgaaaaagaggtgcactgttcacttgttctccaaaggagtttgcttaatcttttacttcgtgtggcctctgattggctgcctggggcacaagaggctgagacatggtgggggccttttagaagatcccggcttagagggaagaagctgcaacggtgactccatttagcttgctttgtaattaagcacttcagttcrtgagaccacagaacagcaatgagcattcacaggagagggagaccggggaaaacggctccatgtggagcttgacggggactggtcttagatgctatttcaatctgatcaccttgccccagattttgattacttaatgttcttgtgggcttataaaaagccctagtgcctgagaaaaagagggccacatgtgttcactgttcactgccctctgacctggaatccccaggatgtgggcagggtcatactccaggcctcgcccttgaccccgtctctgtccttgaaggagagggacccagacacccccgagtgctcagttctcacacacacaggcacgcagagtaaaaatgaaggtgctgtggggggttggaagggcagggtgcagcctgctcsctacggcaaggcatgagcacttccactcgggaagctgggctgggaaggcttggttctgcttccagcccctctggcgccaagtgcattcccctgttgctgttggtagccatggagaccttctgtgagacggtgcagttttatctgaagcacctggaggagagcgtgtaccccgtgatgactgaggaggagtttgccctgaaggtgttccccatgtatcgctacttcgtgacagtgtggctgaggcacyacaaccccgaggtgagatgcacccctcttaggagggcctggtggtccccaggccacagctccccagcctgtggggccgggaggtgctgagggaccgtcgggtccacacttactcccaggaccctagagggcagtgacctgactcatggcagagccggggaactcatggatgctgaacagctgggacctaggagcctcatccacgaggccaggcttgatgaaggttggtgataatcctgagagcacttgttacatgctgggcactctaccagcgtcttacccatgggagctattttcacacccactctgtgatataggactagttgacaaatgaggaaactcaggcacagaggggttaagtacctgctcaaggtcatgtggctgctaagtgggagggactcaaacccggccgcctgtgcaggaaagaccttgctctgcttctgaggygccttctgtcctgtgtccttggattctgtggctggggctgaggtcactggccttgctggagggtggtgagacaatgcgtcccagagctggtttctggtggcaggtgaagctgggggtgatcaagtccctgaagcccatgctcggcctccttctgcccaacgatgacctgcgggagcaggtctacgactacatccccctgctgctggcggagtaccagggcagtctggaggygctcttcgtcacgcaggcgagtggccaggcagccacggctctgggcaggaggcttagggaattgggggctcccaagtgtttaaaggggatgagtgggagccggggggatgtcagatattttgacactgtgtcaggaacccgacatctgtgccctgcgagggaggggcgtggagcctggcacccgtgggactcatgggaatgaacactgcccttccgggtggaagggaccaggtgctggtccctcggaggctgcagtgaggctgtggcctttgcattagtttgttagggttgctgtaacaaagaaccacacatgcgtagcttgaagcaacagagatgtattctctgtacgtcctggaggtcaggagtccaaactcagggtgtcggcagggctgtgctccttctgaaggctctaaggaagcaagctctcttgcctcttccagcttctggtggccccacatgttctgtgactgtggcagcatcactccaatttctcccttcctcattgcgtggcctttccctgtgtgtccctcygtgtcctcttcttacaaggacacctacccaaaatccaggatgatctcacttcgaaatcctgaactaattccatcacaaagaccctatttccaaataaggtcacattatcagattctgggcgagcctgaattttggaaggacaccggtcaactcaaggcagccttggtagaggggtgagatgtgtgagatggagccgttgcagtgttccgcgtggagctgtggatggggctggtgcccatgtaaagggatcactcatctataaggagggtgtgggtctcagctcttaaagcaaggagtggaaagggatgtgactgatttaggagccatctgtagatcattctggctaaataatgggattcacttttaagtgaaggaggccttgaatgccacactcakgggcctagcgcagcacttcccaagccttgctgtggttaggaacaacctgggggctgggtgaaatgcaggcttggattcagcaggacyggggtagggcctgagagtctgcatttctaatcagctcccagggaatgctggtgctcagtgggtcagtgggcccctgagtarcgagggtctagagtttgaccttgagttggtagaaggtcacctgccaccatttgccaatccactgcaggtcttgaggcagatcctggractgtcagtcaccaccaacacccctgtcccccaaatgcagctacacaccattttcacagaactgcacgtccaggtgaggccagcaagctcagctggacaagggcattctctgggtggatcagcaggaagctggcggcgggaggtggcctggcccacaactcactcgcgtgcttcctktatcctgatggggtatgaggctgtggtgcccatgcagccccaggtatggtcagctgggctgcccctgcacctgtgtccctgtgatctcctccagcctcactgcacgtccctyaccaggtgtgcaacaaggccccggcccagcatcagtacagcagccagaatctgatggagatggtgcactgcttcgtagccctyggtgaggctctgcggcagggtgctccctgcctgccccgaggcctgcaggaggcctstaggagtcccggcccctctgagcgctgggcctgggactgccttgctgggcctgctctggacccggtgagcatgactaaagctgtccttccaccctgcagctcgctcctaccccaaggagctgatgaagttcttcttcagccagatggagacaaacaaggaggccgtccgcgtggggactctgaatctgattagggctatagtgagcgcagatggtgagcaaggcagggtgggtggggtgggcggggagggtggggtaggcagggtggagaacaagggaggcaagtttcattcatgttcgggcattgccacttcctagacactactgggtgggccaagaaagccaaggttcttggctgctttgcattttctaagctttaacctaatcagcactgtggcttaccctccccacacccaaccctctgagtccgaattgttaacccgaatcctcctgctaacctccaaagctcaatcagaggctggatataaggccaaactacaccacataggcataactctgaagccccgtggactcaatgctcaaccatagtctacacatctgattccaattcctaagcccaaactctaaacctagccctgagatttaaagagaacccctgtccctaaccaaggcactagctcacrctctgcctttgtgtgaatttgaagaaggcccctgttgacagcatgcagccctacaggtacataatggttagaagagcatgggcagctcccgctcagccctaaagttgggtagctttgttcagtgcacaaattgggcaactgtatgtaaagggccttgtgctgccattaaacctttctcttgaagaaatgcacatttaagcaacaatgaaatcctttttacctattcaatgaatagagatgataatggctagagttcacctggtcatttttctgtgaaaggccagagagtaaaaatatttttggctttgcaggccatatagtgtctttgacaattactcagctctaccattgcagaccaaaaacagctgtggactcctgagcatggctggttttgtaaactttatttacagaaacaggctgtgggttatactttgcttattgctagtctagggtgacaagaaaccacctgtgatacttcagtgacagagatgtaaatcaataaatgattttgggtgctcaattggatacggaccaacatttgcactcaacaatccaactttttgtcaaccatccaaaggacataatttcccaaaagtaattggacaaaggtgctcattaaaacattgtattaaaagcaaagcatgagaaacagcctaaatgtttttctgtagggaatttgtggaataaacaatatatctgcataatggaatattatgcagctattaaaaagtgtgtagtcaatccactttttgtggaaaagctgccctctttctattgrgtgtattaagtgtagcaatacaacgtggggcagtatttatagcatgacyttagtgatgtggaagaaatctatgttcatttatgcataaacaggtctgaaggacaaaatctattaaaaagtggttattttttattttaattttgcaatgaacatatgctattttttctttcattcagggaaattagtatttgccctaatgctctccctcccctttcccccaaccctctagcaggcccctgtgtgtgatgttcccctccctatgtccatgtgttctcactgttcaactcccacttatgagtgagaacatgcactgtttggttttctgttcctgggctaatttgctgaagatgatggtttccagcttagactggataaagaaaatgtggcacttatacaccttggaatactrtgcagccatatactatttttataatcagaaacagtttgcatcttcaagatgaaaactctcaattgtctcatgctcacttggtgcctgactgccaccttgtacctgctctcatttcctttttcctactctggggttgacttagtaacacctagccttgagtgcagtatcatcctggatgtctaactctacctccatccacaccagccctctccagaactttctcatggctctttcttgcccctcttaagcttcctgctttagttgggtgtgctgtcatcagttgtacaactagcaaacacttgcccagcccttacggtgtgccagactctgtgttaactctgtgagagaggcactgtcattatccacactttacaggcgaggaaactgaggcgcagaggggctacgtaattcactttacgtcccacagctgggatgtggtggagccaggatttgaacccagggaaggcctggtgtcaggacccatgctcttcacggtggtgctttgcaacctctgtgtgcccactgcatgcccacttcatgcccagtgctctgtgcccagctgcaggacactaaagagctcgtaggcagagatcttgccctcaaggcgagttcacctgggttcaaatgagatacacacaaagcagtggccaagggaacgaggcrtggaaacaacagaggggagggagatggccagggagagcatggccagggaggctcctaagaaagtgcccctgagcttggagaatgtgggaggagacagaacgygaggcmctgatgtgggacgagccacctgacctctccctgagccacagccctccagcccacccagttttcctctttcagagcccaggatgagtatcagggccatctacctggctatccgggtagtcaagaacaccatctctgatacccggtccaaggtaacagggcagagacctggaaatggggggcactcaggggaccctgccagggaggcaaagggaagtctgggctctgggaggcagaggcttttgatggaaaacccggctttccatcgggtctcgactggggctgcagaatggtgaggccagtgaaagctgaggttccactctcgagacctcattctctccatggatctagagtttttgagtggtgtgtctcaggcaccaccttggacccaacagaggccgagtaaatccagctgcagctagagtcacttggctgtcaagggttttgtgaggtctttatcgcatgtgaaaaaagcaactaaggggtactcctctacccatcctcaaaaggctgaaaaccacagtcccaggctccatggcagccacatccaccttggagtggagcttggttctggccrtgggctggggaagggaggtccggcatagtgaggggtctgcacagcagttttgaggaacatcagagagggaatggaggagaatgggggctagagatttaggcagagctgtcttcagtccctggaggctgtggagggaagcgagaagaggctcgttctgcatctccttcacatagtgattctcatcaatggagcaagccccagggggtccaggataacagatgggctccccayggcaagggctgctagaatggagcagccgaggttggaagggagggagggagctttgtgtctctccaaggctcaattaggctcccaggtgggcatgctgcagagtgggacccctggatgaggcagggggaggtggacagagtgggcagtaatcaggtagtccctgaggccccttctagcccagagcacccccaattcctagctctctatgtcacaggattgggtgccttggagcccaccccaacccccagcatgtccacggtcctgtcccctcaggtraggatggctattctccacatcattgggcagttggctctctgtggctaccaggagagaatcaaaggctggggcctgaagtacctgtctgtgcagctgaccttatccacctacaaactggtgagtggccctgatacgcagaccrcagagcagctggacttggaaatggtttccacagtgctgaggggagaatgccactcagcrtacctgtgttcaaacctgcgtatccattcatgacaggagttcatagacacagtgaacctgcaggtgacaatgtgtggggtcctagatatakgcacagctctgagcattctgtagactcagtatctgggcatggagcccctggggagtgaggagaccacacctgagaccacgacaaacctctgctaggccacaggtgggaatcccttggttctttcttccagacaaatcgccgggagaagttttatcagagggacttggaggagaggatggtccacaaagtcaccatggacactgtgaagatcattacctcttctgtcagtgggatgaccaccgtgagtgggccctgccccacccgcacagtgggtcaccacgccaggctgggggtgaaccacacatgcccagaattccacatctttgcttcttccgttcctgctgtctggagtgttgaggggccttcctcttccagttgcctggaattactcaaaacccagttccaaagccaggtccttgatgagaacttactcttcatctctgtacccctagaggctgggcagtgcacgacctcagcatggctggcagtatcagtctgtatcatttgagcaagtacctgaaatgtgtccattactttaaggcccgtgtgtgtgtgtatgtgtgtgtgtgtgtgtgtgtgtgtgtctgtgtgtagaccaatgattttcatggtttaattttgtaaacattcattgagttctaactctgtgaaagacaggacagaggagtgtgcactaggaggactcagtatgacgggaaggagtggaaggagttcacagactatgggagaaacaaatgtgtcaacttttaattgcaacaaaatgtgacgtagcaataagaggaaaaatgtaccatgagaacatcaaggagggaatgattaytcactgaggctgcaggctagatgatccctgtccagcgacagctttttttaattgcagaaataataataatcatcatcatcatcatagctacagtccatgtggcacccacatatagcaggtatactgtactaggtgtgcaacctgtgcaatcttgtttaattatcccagcaactacctgcatagagggtagttattatcctgattttgtagatgaagaaacagacccagagggattcattaatttgctcaaggcctcatatctggtaaacaatagatccaggattgaaattcccttggaattcaccatgctgtctttatggggaagcccaggaactgggagattctagtcctggtggctacaacaggttaagccattgcacttgatggttggtagcacaagagcctcaccttcaactcctaggggtgggggtggggtggagagggattataattagtcgggggtgttgaacggtcacccagggagagaggagatggtggggtgaagttggaaacacagctccaagaatccatatcagtcagggttctccagagaaacagaaccagtagaagacatatatagcctggtttattttaaggaagtgactcatgcagttgtgggggctggcaagtctgacacctgtgtggcaggccagcaggctggagactagcaggggcggatgctgcagccttgtggctgaatatcttcttcctcagagaaatcccagcgtttcactcttaaggcgtttcacccacctatgttattgaggataatctcttttatggattatgcactttcgtcacacctacaagctaccttcacaacaacacctagattggtgtttgactgaatgactaggtacagtcgcctagccaagttgacacacaaaactgaccgtcataccaggcatgcacaactggatcatctgcccggggtgcccctctagaggacttgggatcagagggagggccctggatgagaagggtttgatgagtgtgggtttgtatgaggctggcagtgataggagttgggcaacagggatgctggccccagcagggactagcagactctcttgccacatcagggtgggtgacacttaaatgcccctgacaaagactggatttggcggtggagccagttcagggctgagactgtcaggggacatctctggggaagcagggatgggatggcaccatggcagagcctgactgttctccttagaagcccagggcttgggctaattctgagcccctttctctcccacccctaccccaggagttttgggtgaggctgctgtgctacatcatggagacagactacgtggaagctttgactcctatctgtatcagcctcacaaacctggcagaacaccagctccatggccaggatgtggatgtcagcgtggctggcaagagcaggcaaggtgggcaaagttcctgtccagctgattggattgggcaggtgggctgkctccttgtctgggaatgcccacccctctccacattcctcccaccctcattcccccttctcctggaaacatccaagtccaaattaatactattaatgcctacctggatattaatgcctacctgatcatatctaggtcatgttagaattgtgtaaacytcctttggatagctcactcctcatgtcctgtccccycagcccacagccctggtccagatcccatccttgggagctcctggcccagcctttcccatgcatgaccttactgggcctctgctctgcctggcttctctgagccagctagagtaactataggcatcccatcctctgtagactaccctcactgtggtccactcagagtgggcactgttaacaccaggctctcaaaacaactatgcccacctaccatgcttgctcctgtccccttccctccaactctggccccaagggcatcgctggtgatgtaggtgattgatggggtcctttaggatccagggctagcaaagggcagagcctgctctctgactttgatctaaacaagctggccagtcaatcctctgaggtcttcctcatgcccctctcactcttgactctggttgagtcctctccaggtcccctgcactggcatcttctcagcaggcctggccgtgcccttgtccatttgtttgtgcsctgttggtttgcttttcctgggctcattggctcccaaagcctgtggagagagtcaggagtgggtagaatggcagtgtctaattacttttggctcaacagaggatggggttcacagtaggagacaaaacactgtcatggaaagtcttggtgtccactacaaaatgcgcatggcctgaaaagagcatcttctaaacctcaacccattagcacgattctcccctcttcccaggataagtgaaatgtaatgatgttcttaggaaattccctgtgccaacccattctccattctgggggtttggggaacaagatcatgttggggaggaaccttctagggtaaagttcctagatggggacataggagcatgtcctggtacaagccaggaaggctcagctggggttgcatttccttcaatcagtggacctgcctgcacctcagaagctgctggcccgtctcctggtgagtggctgacctgcaccatgccctggcctggcaaggccatgccctgtggcacctcttctttaaactcctaattcccagagccccaggggtatgaggaagctgaggtgcaatgagggagtttgatgcttggcaggacagatcattccatgtccctgaaattcctctcgagtttggtagaagcagtgcacttgtaataactggggagctgacctggacctgcttttagattcctctgcccaaagcatccccactacactgccaatgcctgcctacccctgggggttggctcagtccaggacccatgagttcttctctttatgttaactgtggacactcatccatgttgcactgaagcctggggtggggagggagcccaggtctagcccccatcccccatccttcctgtagtgtcctctgcaggtgcactctctatttgaaatccctatttgaaaaccaccgatcttgtccagctcctccctttaaaaatgaggacaaagagctccaagacaaggagcaaggtgctcaggtgctacttcactggagccttggtgccctccaggtgctgatgtcatcaccttacaagggggagggtcgtgggatagccatgctcaacctcttgaggaccctgagccagagcatcgcaccctccatggccgacatgtgggagctggagattgcgctactggtccggtacctggaaggtgaggttcctggggagcccatcccaagccaaccctccaatccgtgtatgtgctggggttctaatcacatgacttgaataacgagagctgaggctcacagttgacccacacagccagcccacttttgtcctgagaactggttgagcagcttgggaaggtgaggagtgcaatgcaacgtgtgatgtgttcatccatggagggcctcaaatgccacgctaaggaggcatagagggccttgaataccaggcttaggggagcagtggaagaaagtggcatgtgtgaccatacatgtgttcctgcagaacatactgagttcacttgggatcagaaagcctgggaagacaagctgattcaggtaaacgggtaacaagtttgctgaggcctgggaggaggagaaagatgggagcagatggaaaggcatttggtgggctgggcacatgaggagtttagaagcccctaaaggacatgttctccttctgtcagagaagacttgggagttacaaagtctatagctgtgtccatccccaggggagaactgagagaaccttccatcccgagagccaggtggccaggagggcagcagggagtgayaccccttctgctagccgccagagccacagccattcctcagacccacagatcattattagcactggatcagggatctatggacttagtgatctggagatgtgggcaagggaagcgagagagggcaagtcagtactcaaggtcccgtagcattcccagagcccaggcaagaacaaggatgaaggcctttggcccttctcaccaacgtcttgtgcctccccagtttctgcgaaactccctcaagaagacccgggggtctagctggagcctgcgcttgagyaaagagctgaacaaccagattgcgagctttgacagcccctctctggagaaggtttgtcttcatagggacaggagagtttggacaaggagtagactccaggggtgakggagtggagaggataacaccgtgtgtgtgagatcagctggacctgtggctgtttacagggtcctgggaggagaggagcgtggtctggattggtggttttagttttgttttggtttatttttttgctttgttttgttgatcctccagattctggctagcaatcacatgtgtgtatttctttgtaaacacaaaactataccacattgctacaaaattctaaaacatttttgaaagaaatcagtgagggtctcaataaatagaaagcaccccatgttcatggattgaaagatgctatagttcaaatggtgatactctccaaatttatcttcagttttagcatgacacctatcacaatccaagctagttcttttttttgatcctaaaattgatcctaaaatttatatggaaataccagaggctctgaatagccaacaaaattatgagaagaagaataaagttggaggactcaaacttctcaatttcaacttcttacacaactgcagtaaaactccttacacaattgcagtaaacaagacagtgagatactggcataaggatagattgataaaatagaagtgagagtccagaaataaactctcacatttatgggtaatttattttcaagaagggtgccaagacaattcagtggggaaagaatagtttttttcaacaaatggggctagggtaactagaaatccacatgcaaaagaatgaaattggatatcttcctcacaccacacataaagctgaatcaaaacgaatcacagacctaaataaaagaactaaaattataaaattctagaaaaacacaggataaatcttgtgaccttgggttaggcaaagccttcttagagatgacaccaaaaagcacaagtgacaaaaagaaataaattggacatcatgaaaattaaaacctcttgtgctaaaaataatacaatagagaaagtgaaaaagaagcacattaaggaagaacatgttcttccataacagatcaaagacttaagtgtacaaaataaaatagaaccatggaacaactagaagaatatattgatgaatatttttataatgttaacatggaatagcctttatatgcttgcaaagaaaccaagaaagacgagggaaaagaggtaaattttatagatattaacattttttgtgtgcttctactacttcctgtttgttttctcatctccaraaacaataatatttaccttatggagtcgtggtgaggatttaatgaaatatggatggttgctcttattatgtctccaaatataaaacaaaattcttacaaataacaaagaaaaagcccaccaaaaaatgggaaaaagaatatagccagaaattcaaagaattaaaacggatcatgagaatatgaaaagatgatcagcacaactaaaaatcaaagaaacacatcacagtgagaatgttccacttctcactgatcatgacgtatgttggggagtaggtggagaaattggtgcgcttaggtttgttggagggagtgtaaattggttcaacttacacagaagttgaacaaacttacccctccccctttaacacgtataacatgcctgcccttatgtagtctgacctcccagaataacctgaacacttattttatttatttttttgaaattttttatttccataggtttttggggaactggtggtcttcggttacatgaataaatgggaatttgcaagattttggtgcacccatcgcccaagcagtatacgctgcacccaatttgtagtcttttatcccccacccctttcctaccctttccccctgagtccgcaaagtccattgtatcattcttatgccttagcatcctcatagcttagctcccacttatgagtgagaacatacgacgtttggttttccattcctaagttacttagaataatagtctccaatctcatccaggttactgcaaatgccagtaattcattcttttttgtggctgagtagtattccattatatatatatataatatgaactgatatatgtatatataaactgatatatgtatgtatgtatatatcagtttctttatccactcattgattgatgggcatttgggctgcttccacatttttgcacttgtgaattgtgctgctgtaaacgtgtgtgcaagtatcttctgcacattaaaataaattgaaaaatacgtagaaaactctctacaacagcaccccctgaaggctggctgtagggaggcctgagctccttcctcccttctgcctctccagggctttctgtaccgggccttgggcttcaccttggccacaggcctggaggccagcaaggtggaggtcctgctgttggagctgctgtacaagacggactacagcaatgactttgacagcgaggtgagggtgcctgcagcctcctcctgtccaccagatgcctctggaccctcggggacatgtgtgttcatgtggctgcatgcgttttgtgtgtgtgtgtgtacatgtgtgtgtgccttgcacgtgtgtgtgtgggatcctcctctgcccactggcccctgccctcaccctggctggctgggtctccctgcagggtgtgattatgtgctttggcctgtgtgcccggggccaggtaaaaacggtgctgaatgtgcttcatgacttcgaggagaggatccaggagtcagagcagtcctggcagatcagtgcttggcgggtaagccaccttccctccacaactgggtcttgggatctcttagcacagtgctctgggcactgacacaaagtcctttctagatctcagtaggaaacttgcctcacacggagtctcctgtcatcaaaatggctgagacattgtcttactctgagacctcctggacagagcttttgctattggatcatcttaaaaatgcagggtgggcctttccaggacccagatactgtcacggagtcccagccccttgctactcatggtggggttctcagactggcagtgggggctccctgggtgctgattggaaatgtagagtcccaggccccacacagacccacaggatttgaagaagctgttcaggtagtgctcagtgggtgcttgacactaggagctctgcctcagtggatggacggtgctgggattgaggggctctagccactgttgcagggtgagaacactgaagcttgtccattggcgtgcggctggttccctggtgaagccagtatttggacccagacagcccatggccctatcctctggaggctgcccctccctgccacaggagatggtcccaccagctggctgagctcctagtgggaaaccatctgaaaccatcacccatgcctcaggctttgcccttgacctggaacacttgccctggggtctggttgtttggatgaagaaaatcgagagagtcccaggctttcttccagcttttctgcaaagaggacccgacacctagatttctactcagtctggcagggcactggggcccctgctccccatccacagtgggtttggtggcctccaacatctcctcccactcagagattgttctgagggtgtgagcaccgtgagggcaaagtggaggctgtcggttcctgctggctctccagcctcatgtgtgcctgacccatagccggtgcctggtaggtgaaggtatgaggtgtgcaagcagcctctgtttaggggtgttcacttgagcacctccccccacaggtgatgggtggtctgggcgtctatagccctagtctgtcttgctcattactgcatgcccagtgcctggtgtctagtagatgctcagtaaagatgcactgagtgaatgaatgcatgcatgaaaatacgatgaacatttcaggcacccagaaaacagtcaggtgaagcaccgccggctgactcaatggatcctttggttgtgtggccagagaccatcacctgcatctggagcagcccctgctgcccccagtggttctttttctctttggcctcgtagaaggaccatccctggaggcgggagacagtgaaaagtgccctcatggtgatgtatagctgcgtggcctcctactgccacccccagttgctcctcaacctcgtggacagccccatcaccgctaagatcattcaccattatgtcagcagctgccaggtagccccatctgctgcctggggggatgtcttctggaccaggctggtgggtagtagccttctggcactctctgggctcctgcatccctacccaggggacatccaggcatcttacctgatgcccagcacgtgggaagcccattgcccaaatgtgctgttctctgtgctttggtgtcatgcagaggggctggggggcgggttgaggatagcccctcttccagagtgctgggtggggtctccagaagccacaagatgagccccacctcttcccagccttacccactccctctgcccttgcctctggccctctctgacactgacccagaccctttcataaggaacaagaggtggggttgtcttcatagacatgyaaaggaactggctattttcttggaatggcaaggaggggaaaacacagagaataaagcaaaaactgtttttattttttaaaactatggcaaaatacacmtaacataaagtttatcatcataaccatttttaagtatatatatatagttcagtggcatgaggtacattcacgttattgtgcaactgtcactgccatctgtctccagaattcttcattttacaaaaccaaaatcctatatccattcaacaccaactctccattcccttctcctcccagccctgrcaaccacctttactcttyctgtctgtgtggctttgactagtccaggtacctcatctaagtgcaatcatatgatagttgtccttgtgtgtctggcttatttcatttatcataatgttctcaaggttcatccatgtaaaagcaatcattttctcaataacctctcctgcctctatggtaacacatagggctcggggcccctggtcactgaaggcggcccctgagctgctttgctgccctcaggaggcttgggaaggtggcatcttccgtggtgtattagttcgtgttaacgctgctgctaaaggcatacctgaaactgggaacaaaaagaggtttacttggacttagagttccacatgactagggtggcctcagaatcatggcgggagacaaaaggcacttcttacatggtggcagcaagagaaaaatgaggaagaagcaaaagtggaaacccctgataaacccatcagatcttgtgagacttattcactgtcatgagaatagcatgggagagactggcccccatgattcaattaccacccgctgggtccctcccacaacacatgggaattctgagagttacaattcaagttgagatttgaatggggacacagccaaactatatcacgtgtggacccaggtgctgcacctcacctcgtatccccgccatgtgcctgtggccctgccatgtggcaggtgctccattcatgtggtcgaaggacagagtgaggctggccatctctcagagcattcaacattaaacgctttcttcagagcagagggagtccaggagcagaagctgcagcttggattcttctggggctgctcacaaacattctctccctccttttccccttctgggctcaggacatctgtctcaaaatggccttcatgaagagtgttgtgcaggttaccaaggccatcaacaacatcaaggacctggaggactttcactttgcccagaagacgactcttaccagcattatagtggtaagctgggtggggcacctccttggtcctgttcctggttttggggtctaactccctgcggtgagaggttttcaaagttcctgagggcatctgcagagctctctgaagtccttccctgtcttggctctgctttgtcctaacygtaggagttctgagaatgatttttgtatctgataaagagtttcacagccagtcaactgtttggaaaccagggtgggagattctggctgtcctgggtcctgcagtgcccagggcagctggttaaggcctgatagacagagattccctgggccggcttggctgtagcttccctgtctctccgtgggagggccttaggggcagggatctgctggaagcaggacttagagtgaagccctgaaggatgcacagaaggatgtaagacaaagaaaacgtccactgtccaaaggctgatggaacctgtggggccgccaatgtccttaatccccaggcctccccactcatgtcattgccagtgccttggcctctcaaagctgcttgggttgtgctggaagtggcccttaagggacatgagattgggtggaacagaaggcaatgaggaggaaatgggatttatttggctctcactggccaggagctttgaacctgtactttcacgctagcctggagcagccctgtaaaatgggtctccaggtcttgttttacagagaaggggacttgggctcaggcagaggaagtgctggcccaggggcacacagcaagtagatgagcagcgcgagctgggagcccaggcccactttgggccctgctcccactctgctgcctcccctaagatgccaaaagccaaatggccctaaaaagaatgaaagagatgtggggtgttagacactttgggaagtgccaggtcttcctcatgctaacactggggagtgctgccgccatcatggtcaccaaaagccaccaccccctgcttgtgttggacaggcggtcatcaaggcagaaccgactgacaacctggtttctccagtgcgagccttggcgatggaggccctctcgcacctgaggtgagctgggttcccaccctcaccccatcccaaggggtagggaaaagttcaagaccattcctcggtgctccttcaggggttgtgcctcctttttcctctcctccctctgtagcaggggtctcacttggmggctccccagggcaatgggccagcctagatgatgggggtcggcctcagccactcttttctataattctcagccagatttcaagttgggtgcttctccttggatttatggcacatgggtgggctgctcttccattgattggggatattttgagcaaaataacagtgataacactgaagagcattgcaagcatccttcaagatgagtcaggctcagtgagtgagttgaagggctyagtcaactatttgttgataccactggtacaaaatgatctaaagcccaagacttaccttcctggagatgccaatccattggtggggagggggaaaggggaagaagttatggatttataaaattagtatttaaagagtttgggtcatctctaagaatacctcccctataggggaagattcattacttaggcgcatagcagaactatctgttactttaagctgcatcaaacaggcagattttaaaataaatgtcatgaacatcaactaagcacaatgatatgctgagtactgaagggacacagagatacataagacctagtcmcagccttttaaggacttagagataagacagacacatacaaacaggattataggtcaaagctgactaacaggactgtgtttacaggtaaacccacacacacatcagcaaaaaaatatctgagaacaaaaaaaaaggggctactaacaaaagcaactcrgtttatacaaaaggagctatcaagaggcttggtgcaaagttggcatttggcttttgacctgggcttaggcagaacgactggacttggcgcttcctaggagagtgtaatacaagacactttgggggagcaggagtttaaagcaggatggtggctctcaactctaggggcacaatagaactcatggggaacttttaacagtatggatatccaggtcccaccccagatcctggggcttggacgtggtccctgggggtccttaaaaaatcctcgaggtatctttaatatgcatcaagcttgagaattgttgatgaaggagctagaagaagaatgagctagcatgcaccaatcactagcaacttcctctggagggcttatcaaaacacagatggctgcagtccacccccagaatttttgattcagcaggtcttggctggggccatagaatttgtgtttctcataaattccaaggtgaagctgctgctgctgctgctgctggtgatggtggtccaagcattacccttgaaagcccctggactagcaccagccagggagggcagattccatagttgcagtcggcaaggagcaatggaatgtttctgagcagattaacaggttcagagtagacaacagcagataggagagatggccttggacccctgcatctccccttcaatcacaagcaagagtcactggacactggttactggtcagagccagggcccctggggagggatgcttgccagagcctccaactggagaagtaggcctcttcctcttctaggatgtgtttccgtgcccagattgggcagtggggcagcagaagctcaactccccaatgactgttcctctcttgtcactgcttcttctccagcaagctgaagcctttctactccacagaggaaaacagtgagctgatggatatcagcatacattctgtaatttctctccaactcccaggagaggacaatgagtccattaaggtaggtccctctgggatgcctcatttgctgggtcaggacctgggagttaacattaacatgggccatgctgagagtccaccttcctgaaccacctttgagtgtttagaggcagcggagtgtagcaagctctatcagtaaatgtaaggtaatgctagctgttgaaacataaaccctgaaatctcagtggattaacaacataaaagtttatttatcacccaagtcaagtcaagcccagctgtcaatgggagtggaaatggagctgctttgtgcaattattcaggaacccaggctggtggagtcctcctgcccatcctcagtgcatgaatcccaagatcccaatcaatgggtattgatacccagcatagatagaagaaagagaaagtctagggaagacttgagagtcattttgccctccttctattggctgaaacacagtcacatggctccacccatgcaaggagtcctgggaaatgtagtccctgatgagatggctgtttccctgacaacactgtggaagaggagaaggaatcttttgtggacaggtagccatccctgcctccagggcttggccctggatgaagaatcagaactgggctccaggagttcagtatcctgctttgtaaagtgaatccctcttaaatggttgtcttgtacttcacttgagaaaataagtgtcaagagctcagactgaacagaagttagtggatgactgccagacccctccctggcatgaactccctgcagggaggggggttgtgggtgcccctcattgccgcctatctctctctccctcttggctgtagaccctgtatgcaaatgccctgagctccctggagcagctgatggagagcctcctgcagaggcagctggaccccaaggggctgcaggagatggtgcaggtgagttgcctggtggcgggccagagccagggatggccactcctccccagaagctggactgagggccagactctggggaacaggggagtgcatgcaacattgttttagtgatttcattgttataaaattccagatctgctaaaaatttgcaaggatagtgcaaagatactcttcatgcagattcacagttcttaatactttgtcacattttctttctcggttttcttctgcctctgtccttccacacacacacatcttttgaaccacggatagctgcagacatccagagtaacagtactctcttatataacaacagtaccatgatcaaattcaggacatttaatgttgacacgatgcatgtattaaaactgatggcccatattcaaatttcatgaattgccccagtaatgtcctttagagctgttttctcctcgatccaggatataatccagattaggcagtgcatctacctgtcaggtctctttgttctcctttcatctggaacagcttcacagtccttctttgtctttcataaccttggcacttttgaagggtgctggttaggtttttaaaaattgggttgtttgctttctttttatagaaccttttacaggttttacatattctggatacaacccatcagatatgtgatttgcaaatattttcttctagtctgtggcctttttattgatttcccaatatcttttaatgagcagaagtttttrgttttgacgaagtmgaatttatctttttttcttttatggatcatgcttttggtgtcaaatctaagaaaccgtccaaagattttctcctatgttttcttccagaagttttgtattttcagattttatgattaggtctatgatatattttgagttaatttttgtatggtctgaggtacaggtcaaagtttattttaattttttgcacatggatagccaattgtttcagcaccctttgttgaaaagactgccctttttctgttcaattatctttgcacctttgttgaaaatcaaaggctatgtacgtgtgggtgtatttctggacacttatttggctctgttgatgtgtttgcctatggtacaccaatactgcactgtctcgattactgttatattataataagccttgaaatcaggatcagataatgtaagtccttagattttgctttttttttttttttttttgctgcatctcacagatcctgatacgttgcgttttaattttatttcggttcgaaacattttaaatttcccttatgatttcttctttgacctgaaagttatttagagattttcaaatatttgggagtttccgagaatctttctggtttggattcctaatttaactgcattgttctctgatgacatacttaaattccgtattttaaatccttttaaattgactgagatttattttgttgcccagataccatctatcttggtaaatatttcatgtgtatttgaaaaatattctgctgttgttaagtgtagtgtttcaaaatgtctattaggccaagttggttaatagtatttttcaggttttctgtctcctttttgatgttctgtctttttgttctatcaattattgagaaaaaggcactgaaatctctgactaatagtgtgaacttgtttatttctccttttggctctttcattttttgcttcatgtattatttagctatgttattaggtgcataaacatttaggattgttatgtctggttgatgaactgacccttattgtgatgacatgaccctgtttatctatggtaatgtcatttgctctaaaatgaacttttatatcagaacggcctctggggccatctggagtgcagggtgggctgtgctcctggcccttcattacaggcagacatttggagccaggccaaatgcaacagccaagcaccatcctggtgagaatgctggggatgctctttccctgcctacagcctcatctcccttcatgatggggcctgtctagaaccacaaggaagcattgaaagtcgatctgagtaggagggtgaggtgggcaaaagctggccaggaaagggctggccccaggattttaacacccactttggtgttctgggctctacccatagctcctggaaaagtggatcttgtcggagaaagaatgggagcgggaaaaggccgtgagcctccatctctatctcatgyggatttatgtccacagcactgctgtctgtgtgagtccaggagtccccagcccccagcctgctgctctgacatgcacagaaaaattcctgtgtctatctggaagatgagggaacacttatgaaatcaagttctgtccccagagggccccttgggagaggctgcagtgacctagtgccctgggctgggtcagggagggagagggtgggattgtggttggcagagctccaggctttgtggggcctgtggcttctgtagcggtgagagccctttttaagaaaaaagatacatagttatgaaccccacattggctaggaaartgaatatttactttgagaaaatcaagtgctgcaaaatcataaattttgcaaagcttgacaagtaccgcaacccttaaaatgtctagaacgacgtagtgtttttactgattgaccatctgacacagcctgatgagacttaattgtctacactttttggctccatgctgtttgactgtcttgtcctcaggatggctgtggcaggaggatgatggagtcagggtctggggcgcagggatggtcgtctggtgcagggagagaagygggctgggcaggaggaccctggtcctgggcacctggatggaggtggggatgaaggctcagcaaaatgaggcaggggccaagtccaacactcagtaacatgtgaggccagaggctgtgtggaaggcttcacctgggctctcatgacattccctgcaagaggaggtgccatcatcatctccactgtgcagacaggaaacatgagactgagaggcagagtaccctgcctggactgctcagctagtgagcaggaagctctgatttgatccccagggttcgttacaggwacaactgggcccaagttcagagctgtgaactgagcagagctgagtcagagggagtcctgatccagggcccacagatccaggctgctcagcctccaggggcccagctgtgggcaggggaggctgatgcttggacaggggacagacagtggcaccctccccttccccaaatgggtgtttcagagcagggtttgccctatcaagttgtcctttacactgcccctgggcagccccaggtgtgcatgagagcacagwggtgtgagccccacggtctcctgtccctcagatccacctaaagctggggcagtttggcacaatggtcggactcattgccccgtgcacctgtgatgcccatcaaagaacccgcatggcctcaatgaatgtcctgtccagcctgctagatcttcacggtatgagagggcaggacatgaggaccagctcctctgggagggagagagggctgactccaggagtatgggctgcggcctgccctggagggaaggatggcctctgtgcaggcaggcatggagacaaacacaggtgaccatcagagggagcagtgaggggagagttcaccaacaggccatggaagcttccagaaggagaggttcattagcccagattgacccatggagggcatgtgctgggcactgagggcctggctgggagaaagtcagctcccagatgccaagcatgtgacagagctggccagagctgagttcaagggagagcaggcctctgagctgggcggagaggtggtgcgggcagaggccgccacagggaaggaccagtgagagcaaaggtcagaacgcctgggacgttcacatgctggagggtggctcaggcctgcaaagccagggcaggaggtagccacgaagggggggtggckgggccttttgtccctgctggtcatttctgaagttgtattcccgacagcaagccagacctgctccttgtggggcccttccaagsagaaggagcttgagaaatgtaagggggacctccagagcacagatgtggagaagatcttctgtgcatcctccagaatcgccaaggtgacagccggggagcctgcctgggctgccaggctggtctcagggcccttggccgtctctcrgggagggaggccttcctgggctggcctcacagcccaagttttctggggtctcagcttccacggcctttggcccaactgctgccctctgtgttgaaagggcctgcagtatgtcatgtccctactttgtctctggcacrcagtaggtgcttaatctgctttgctgtcttctccctgtccctgtgatgtgccacactgagtgctgaaagggccatgggaatgatctggacaggccctgcacgtggtgtgggcacgtgggcaggctcatggcacagtgatgaatggaagtgcctggagccacccaaacaggggctggggacttcaggagaccagccccttctggctcagcccaggaggaggccatggccatggtctgagagaggataggagcctggagtggggccatggggtgggacaggggaggagagagtgtcagcagtcatggagtggcaggggagggcaggggagtcacccgctctgctcctaggtggtctgcatggagtttagctgygatgaggtggtctcgctcatccagaagctctgcgagaacactggggccatgaacctgcagcatgacaaggcctctgtcacctggatagcctycttcctccagatgcgggccaaggagctggaggacaaggtggcagagccgcggcagggccaccagagagaggggctggggctgcctggtgtgcccagatgagagggaaggacgagggcctcaccagcactcgctgagaatgcctcccccaacccctggctgctaaagaggaggaggaaacagagttctagagctagaaagaagcgtgttgaaggtagcctcgttagttaagtgcacgctgacctggagatcaaggttctcctccccagagcacaccacctcctgcactgaaagcctgggaaaatgagtttgaggcagagaccagaggatgcactagagagggtgctgggcgcttaacctccccattgtccaactgggccagagcccttagagcaggggcatgtcatggggttagtgcaggaggccataggggcctgggctgccccccggtgatgccccatccctacctaggtggccgagatcctgagtgccatcctggtgcacctgccggtggtggaccacccagaggtgcggcgccttctcattgacggcatcctgctgctggcgcaccaccaccaggagaccatcctcacatcgctcctgaggcagccactgcccatggagaggtgggtgccctggaggaggtggccccggcctcctgtgccatttgaccatgcccaactcaccaccccgatgtgtcccagaagcctggagccttgggcagtaccctgccccaccctgaaggaggtcgaagccctcttcctgtacctcctgcaggaggtgccagcctccgacgagccactgacagagcccaggcttgtagaacttcgccacatggagctggaatctggacccgtagctccccacatgcccgggacagtgtctgtggagttcattctctcccagagtagccctttccttccctgtgaacagagctccagcagatgggctgcagggtgcggctccaaggcatgagcaagccctggatatattccaggctgtccctatttctttcaaaatgtgtcctaagaggggaagcgacttgtcccaktctccaaggggagaatggcccaacctccagccccagaggtggccatgagtgatgcagagccaccccatctttattggtgtttctctgcagacagtgcagagctcctgtgtgtgctacagcatgatggcacaggcagctgggcatggtctccccacatgtggggagtctgtttggggtggtaccagaattcatctgggaggagccagaaagagctagacagtcatccccagagcagtggagcctgtgctggtgcagggacgtgaggagatgtcaggctaagtaagaggcttggaacagagaaaagagttttaaaaataggccccggctccagagccacaagggctgacctgcccgaaatgcaggcatgrctcccctgtggagctgcttctcataagggcagccctgccgtgggtccagctgggagggtggtgcaggtgtcatgatttaatgaggctcagtggctcatgaggcagtgctgggtgggggtaagggggatgtgcggtgcagccctgggtcaggctggcgtacttggtggccacgtcacactggctttcacttagtttgccaaaatctgtattggtttgctattgctgaataacaaattatcacccacttagaagcttctaacaacatccatggattagctcacaatttccatggttcaggagtcaaggcatgggttagctgggctttctgttcagggtctcacaagcctgtgatgagggtgtcagctgggctgcattccagagcctggggttgtcttccaggattgtgtcattgttcgtagttgcttcttgccattgtaggactgaggtgccccttcttgtttccttgcgccccatggcttctttacagagggtgctgatgagtgcactctgccccctctccatttactcctgcccccaggcccccaggcacatctcccttcagacccaaactcaccaccctgctcttgtgcattggttttgtgggttccaatagtcagtttacacatctctttgttcaacttgaccttgttaaattacatttagacttgttagactcacattagccttttagaacctcccagatgccccgctctctgtgcctctgtacctatcctgggggacatcccttctcagcagggccatgggcttggacttggaaaccaggaaggcccttttccaactgtagtttggcaggtggcctgactgctgcaagcctcacttccctcttctgtggaatagggagacaaaataccttcctcaaagatgtgttgggagggttaggtgatataatatcagaaagctaccgacaaccaacctgatgcaaattgggcactaggaggtattgtgggacatgtccgtacagtcatcaaacaggtgggggtctctgtggtcatctagcagtggaggtggggcttccgtgggggccatggctttcccaaaggtaccgtgagcccgtgcagagaaagggggttgagtatagtgtcaggggcctgggttctaagcacgcaaattttggcggctccctccgcctccctgagattcagtccccagagtccaacccctacttagggggctgccaagggtttgaaagggattcttacctgccagggcacatgccaggaaactcacagtccttgtgccctgactttggttagccacctggcagaggtgtggctggcagtgtcggagaacrtgcccttcgcccggaccatgctccacagcctgatgggccggctgcagtcacggctcagccccagaatcagtgccacctccaaggctgacatctggcgcctggctgcggtggaccccctgatggtgagttgcaggcgcaggccccaaggctcctcaggggtctctgggtaggagcccgatgccctggaccttctctctgcagaccctgtgcaccatccaccttctcattcagaagctggatgagaatgacaagctcccggacttcctccctgacctcatctacaccctcctgctgcagcttggaagcagccaccgaccagaggccgccccgccggtcttgaagatgtggaagctggtccacaccactcctctgccggaggagatgaacctgcaaaggtgctctcgagggcggtgggtgcaaggcagcaggcctgggctggctgtagccacgggctgccccttagttgccagtggactccagtgaggggccctctgtctcctcctggtgggatctgatcttactcaaaatgccgttctcatgtgtgtcaagcacggtgtggttttcagagcttgcagatccactccctccctggacctttccctcagtcccttgggctgggcccggcaggcactggggccccacttcacagattgcagcagcctccccaggccatgcgctcccagcagggcagcgcatcacaagctcccacctcccttcagggtcactatcaagtccatgcagctcttgttcaagagagtcaagagccagcacctggcacataccctggacgagcaggcagtgtgggacctcctgcaggacggcgggacattcctggagggtgtgagcctgctggccaggtgggccctggctcccacagggtggcagggggacctgcagaggcacctccttgctggatggaagggctccttgtgaggacatggtccagtcatggctgaaggccttctttctgggggaactgccacgccaacctgtgactctaggatggcagtggtgtgcaagagaatgagaaccttttattcgaacccttcctgctcagagcagatatgagggcagaragaggaggggctcgcccccagggccacacagggtctagagtaggccagggatgggagttacttctggggtcctagtcactccggagccgccctcactctagtcccctttgtaaaaaggagatagacattgactgattcactgacaacctcaaccaagtccccaggaagaggagggagaaacccagagatgttacgacatctttccggggttatcttgccaccagggtccaggcaccgatgtggccctgcccagctcttggcaaacgtcaggcaggggtggggccgcctccacgacctggcactgtctctcctctgcaggctgtgcatgcagcacgtggagggccacaggcagaggctggccgagctggtgctcaggggcatggactcagaagtcctgagctgccgcatcagcagcacagcggtctgcrtggaartgaggcaccgggtgtgggcggggtgcaagcggaggggatggggtccctggattcttctggggatggcttgtctccaaggcatgggagtcggggggacaggcgagcgcccctcctctgagtgctcattctctcatctgctccttcattcattcatcacatgagtagtgcagggcaggccctgctggaaagacaggctgagccctgcagcattgcagttaactgatgtgtgacccaggcaagtacagtgacccaggggacccagggagggcacctgggttctcgctggggcaggcttcctgcaggaggactcagagaggccgaggggctttgctaggtgggaaggcagggcccagcgaccctatctcagagtgagtgttggagcgtcctgagggcaatgatgcccaatgcaccctaggaaccaaccacagcccaggccagaggccggccagtgttttctgtaaaggactgcagagtaaatttttggctttgtggccaactmagctgtagcaggaaaacagccacagccaataagtcaaccagtgggcatgacggtgtcaacaaaaccttattgatggacactggaatttaaacttcatggaattttcatgtgccatagaattttcttttctatatttcttttccccaacacttaaaaatgggaaaatgagttttggcagtgggctgtacaaaagctcctggaagtacaagaccagtctgggaggtactcaccaagcttttataggttcttcaggcccctccctgtgttcaggcctctgtaaatcttcaaaatgaggatgggaaggagaagtgctccctcgttgtctcacccaggacctgtcctttgatgtgcctgagtttggaattttcagcggctggaagccacacagggccaggcgcaggtgctggaatccgagggcctggttaagagcctccgctcagttgctgattggctggagatgaagttacttagcgtctctgagcttcaagctctccatctgcccaactggggaaagcagtgccttcttttcagggctttggtgagagctaaatgagatagaccgtgtatgcattgcttgcttgggaggtaagtgctcattaaatgctagctaattatggcagtttaaaaattaggttcagcttttttggttccatatgaattttaaaataatttttttctaattctgtgaagaatgtcamtggtagtttaatgggaatagcattgmatctatacattactttgggcagtatggtcatttgcatgatactgattcttcctatccatgagcatggaatatttttccatttgtttgtgtactctctggtttctttgagcagaggtttgtagttctcctttgaagaggcccctcacttcccttgttaactatattcctaggtattttattctctttgtagcaattgtgaatgggagttcatgatttggctctctgcttgcctgttgttagtgtgtaggaatgcttgtgacttctgcagattgattttgtatcctgagactttgttgaagttgtttatcagcttaagaagtttttgggctgagacaatggggttttctagatataggatcatgtcatctgcaaacaaagacatttttacttcctcccttcctatttgaatacgctttatttctttctcttgcctgattgccctggccggaacttccaatactatgttgagtaggagtggtgagagagggcatccttgtcttgtgccgattttcaaagggaatgcttccggcttttgcccattcagtatgatattggytgtgggtttgtcataaatggctcttattattttgaggtacttcaatacctagtttgttgggagtttttaacatgaagggatgttgaattttattgaaggccttttctgcacctattgagataatcatgtggttttgtctttaggtctgtttatgtgatgaattacgtttattgatttacatatgttgaactagccttgcatcctgggaatgaaggctacttgatcgtggtggatgagctttttgatatgctgctggattcagtttgccagtattttattgagaatttttgcatcgatgttcatcagggatattggcctgaagttttcttttttttgttgtatctctgcctggttttggtatcaggatgatgctgacctcatagaatgagttagggaggtgtccttccttttcaatggtttggaatagtttcagaagaaatggtataaactcctctttgtgtttctttttcctttttttttttttttttttttttgagacagggtcttgctctgtcgccaggctggagtgcaatggcgtgatctcagctcactgcaacctccacctcccgggttcaagcaattctcctgcctcagcctttcgagtagctgggactgtaggcatgtgccaccacacccagctaatttttgtatttttagtagagatagggtttcaccatgttggccaggatggtctcgatctcttgaccttgtgatttgcccgcctcggcctcccaaagtgctgggattacaggcgtgagccaccacgcccgaccacctctttgtatttcttgtagaattcagcctgtatagccaagacaattctaagcaaaaagaacaaagctggaggcatcaccctactggacttcaaactatactataaggctacagtaaccaaaacagcatggtactggtacaaaaacagatacacagaccaatggaacagaatagagaactcagaaataagatggcacatctacaggcaactgatcttggacaaacctgacaaaaacaagcaatggggaaaggattccatatttaaaaaatagtgctgggagaactggctatccatttgcagaaaattgaaactggacccctttctcacacattatgcaaaaattaactcaagatggattaaagacttaaatgtaaaacccaaaactataaaaaccctagaagaaaatctaggcaataccattcaggacatgggcatggacaaacatttcatgataaaatcaccaacagcaattgcaacaaaagcaaaaattgacaattgggatctaattaaactaaggagcttctgcacagcaaaagagactatcatcagagtgaacaggcaacctacagagttgaagaaaatctttgcaatttatccattcaaaaaaggtctaatatccagaatctacaaggaactcaaacaaatttacaagaaaaaaacaaacaatcctattagaaagtgggcaaaggacatgaacagacccttctcaaagaagacactcatgcagcgaataaacatatgaaaaaaagctaaatatcactgatcattaggtaaatgcaaatcaaaaccacaaggagataccatatcatgccagtcagaatggccattattaaaaagtcaagaaacaacagatgctggcaaggttgcagagaaataggaacacttttacactgttggtgggaatgtaaattagttcaaccattgtggaagacggtgtggtgattcctcaaagatctagaaccaaaaataccatctgacccagcaatcccattactgggcatatacccaraggaatataatcattctattacaaagatatatgcatgtgtatgttcattgtagcactattcacaataacaaagacatggaatcaacccaaatgcccatcaatgatacactggataaagaaaatgaggtacatatacaccatggaatactatgcagccataaaaaggaatgagatcatgtcctttgcagggacatggatgaagctggaagtcattatcctcagcaaactaatacaggaacagaaaccaaacaccacatgttctcacttataagtgggagctgaacaatgagatcacatggacacagggagaggaccaacacacactgggcctgttgggagtggggtgggggaagagagagtattaggaaaaacagctaatgcatgctgggcttaataactcggtgatgggtcgataggtgcagcaaaccactrtgacacacgtctacctatgtaacaagcttgcacttcctgcacatgtaccccagaactaaaaataaaaattaaaaaaaaaattaggttcaggtttaagaagcaagctatttaaattcttcaaatttgatagggatggattataaatgatttttttttaatgcttgctgacaatagtgtgggggctttactcttcaggaattttccctgaagagcatttaaaataggttgtgatcgttgtattcactgctctacctggccctgaataggtgctcagtatatgtttaaatgaatggaagtgctgtaggaagctcctgtgattgctgatgttggtgtctgggacaggctggaggtggactgaggtggagacaaaacatttggaagcttagagcaactgcgcctaatgggggtttaaggaactagatgtggggatagtcaatagatgctcatttctcctgtccctggactcaccaatttggtgtttagttttcaggcctctttcaaacatactcaggtacttgcatgcacacatgtacacacatgtacacacatgcatgcacccacacgcataccagtgaggttttggcactcagaatactaggccattagtaattctcctgaaagtgaaattcatgttttttgtgcctttctgttcagatgcaggtgggcgtggctcttgcatttggcagtggctgttatgttacctgaaaaaataaatgacgaatttatatatatayktaacacttatctagcattccccccatatttccttattaaatccccacacagaccctgaggcaggtactagcatcacccgctttttatagagaggaaacggaggctctcagagcccctcccctcctgtccacagagccaccaatctgcattacctctcctcccacgtcccaccttgctgctgagaaatgagcccgccctggggataactgcccaatgtcctcccttccagttcatgagcggcccagttctgtaccaggagaagctgctgaagccggcagctttgctgctggagaagggtgccgaccaggaggaagacgaggccctgmgggtgctgtccctgcgcgccctcggcaacatggccctgggcgcccccaagaaggtactgtgcctggccctgggcccaggtcccgggagctgagggtgcaggccgggtgccctggtcagcctgggagggagggtgcaggctgagggctgcccatgcccctccaggtgaagcagtaccggaaggtcttgctggagaagtgcctgggccccctgagggagcccgtgagcaacagcgtgactgccgagggcatggaggccctgaccaagatcctggctgagctccgggaaggggatgtggggtcctctttcgacgccatgtctgagcagtgcaggatcttcttcgacaacgtgagtccgatgagagcctccctgagcttgctcagtgaaggaggggcacttctcagaccctaaggaagagatgggctctagagcagaaaagagccgaggctcctgctgggtgtcagtttagcgactggctgatcacgggatcttgtgaagtaaaaggtattcttctaagttccagagaatcagtgctgtcaagtgacggctcctgggcctctgcagccctgctaggagggaagggtctcccccttttattccttgcasctacaaatacccccagggcacctgtgtcaccctgggcctctgctaggcagggctgtgcactcagatcctgcacaagccctcacccagggaagaggcgggcacaaagaccagagcaatgcccagccccttgagggctacgtgatccctgccaaaggagagactacaccctgacggaatgatccagaaggctctgcagggrccaaggcattgggtattccttggagaatggctggggttttgctgggcttcctgctgcctgcatgtcagcctgtgtccatcctggccacaggagagcgagctgctgcgtctgaaagccttcatcctctttggaaagctggcaagggtggtcgggatgtccaagaagcatttcttcaaaggggaggtgaagaaggcctggatccccctcatgctgcactcccaggacccctgctccaatgcagcccaagtaagatacatcctgggctttgtgtcccagtctggggcccgctgttccccraggaaacaggtccttgggtctgctggctcggtgagctgcaagcttttctctgcctcagttggttttctctgagatcccagaggccacagcctgctccctgctgtcctccatccctcacacaggctgaggagagaggccatccgagatgacctgcaaagccacctcactaagcagtctcagccccgtgtcgggggacatggtgtggtggctgcctatagccctcctctgcccaaaccctttcttctagcagattctgtaactggcaggtcacttttgagtattaggactcaaaataccccaaagtggtcttgtccactgcctgcaggcccatgttgggatgggagcgggcctggcttctccctctccacagcccagytcctctgttgctttggggcaggaggagagggagagacagatttgttagtaaatgtgccttctcatttgagttgctgcctctcaggctaaccccggctggctggggacctcaggatcctcactccctgcatggcccatgaccttgaccgccctcttctctccctagtctctgcttacagacttggggggtggggtcaggaagtggggaggtggctgatttggggaggttctgcccccgcctagtaagccttgggacgcagctggcctaacatgaaagaaatgcaatggtcattttcagcaggtgccttggactccagctctggggtcacaggacaagtmctgtcactatgagggcagcagtttccaggtggggtggagcgggtggcccagatggcctgggtggcccaggtgggatggcccwggtggcccaggtgggatggccctggtggcccaggtgggatggcccaggtggcccttacaggcagtgaggggkattgagatgcacactccctagacctgggctttgcactcaccaccccagcttctggactttgccacatccctctgccacaccatccctggccaccctgggcacaaggtgtcactgcccagaggctccttttccttgccagtcctcaccaccctctgtcttcagcccacactgttcttccatgttttatcgacaactgtccagtggggtgggggggcttcagggaaggaaccagggtgcacccagcaatggtgaccgagagtgaggaaagggctaccgagacagaagcattttgtcttcctgccctgccgtctccagaagctgtggccagcaggcttggtcacaggcagatgctggtggactgggcctgggaggtgaggacacgtgcccagtcttgcctgctcaagcccggctcccgcctctgatcccatggagggctgggtcccaggcagggctgctgagggcacgaaggkgctggctgagggggcgggtggggctgcatctgcccccaaggggctttctataaatgtacmtgcagccatgttcaagctggcaggggcccaggtcccaggtggcctcccaggagccaccagccctgcctttctttggcttggtgaggcttttctggggctgccctctggcttcctgccagcctcacccctctggggaaccacgtggcctggctgatggctctgctgccgtcctgtgtccctgcaggcctgtatggctaccatgtttcagtgtgtgcacttctggggctggaagtccctggagcatccctcagggccaagtgataccrctactgatgacaagatgaccrttttccagacaaccatgtgctccatcctggtgaggaagccaaagggggaaccagcccgtcccaggtggccacacgctggcttggagctggggggtcgagattgccacagctctttcttggggccctatgtttaccttccacacatgccatgtygagaccrgcactgtgcagcagaaatagaaggcaagtcaygtgcctatttcagctgtctgatgtttcttttagtaggcacatccagaaaagtgcagaggtgaaactaattttcatgtattttatttcactcaaataactaaaacatgatcatttcaacatgtaatcagtataaaaactatkattgtgatattttacaatttttggggtaccatcttaaaacccagggggcactttaccttaattcagaccagccacacttgaagtgctgcagggttacacatggcttgtggctaccatgttggacagcacaggttctctggtcagatgggatatgaaaaatataactggtggccagtggtccttcacttgccagctactcacctgctgtgtgacgctgggatgggcgcttgccctctctgatgcatcttggtgatgggaacacgcttgrtgaatgacagcccattgtcagggtctcatcctccaaagcwaaaagtgtgtatcacttactttttgcagactcggaaaaagccggctgttctctaccgcttcttgctagaaacaatggcctatgttaaaaataacttgtcaagaatcagaatcgctgcttgcaacttggcaggtgagcagagagacgtctcctgactcaagatagactttgaaggccctctagtccaccccrgsactcgggggaagggtggatcatgagtgggaggcaygtggcaagctgagaccagagctcaggtctaagccctgcactgtgctttctatcccgttttgattttggcttcctccctgccaacgtgggctcaacaaaatctttcatcaatgctctcataacgtaaagtaagtaaaccacaggacgacttgcctgctgacctaatactcgcgtgatgagcatttctttggctattgttttaggaattattatgaagcagatgtctacacattatctgaaaaagctggacttcccagcattacggaattgtgagtagtggagagtgttagatgttgagtccacgactcaccaactcactaggggagcttagagaaactgcttcaagggaagagccagaggaccctttgctgtggggtttygggggggtgggagtgcaaccagggcagagagatgcacctggrgaggcctttccaggacgacagctattgatgggtggagtccctttcattccctgggctgtttctcccattcatagcttcttatgaaatgcttttggcctgatgctgctatcaggttctgtgggtgatttctgtccctgttagggtggttactgaagccctgagagctatgatgtgtgttgaaacagctccacctgcagtcctctgctttcccacacaggagtttccccgtctgcccctgcccaccttctgcggcccttgcctgccatcactgcccagggcatgcagcatgtggtcctgactgggcrgggcctgaaccttccctctttgtgttctctctcagccctccaggaactacagctggaccyggatcccggggtcaggagggcagccctggagacgctcacagtcttggatagctgtagtcagcatgggtttctggcttcaccccaaggaatgtcctaggtggtccaaacataagacgtaaactgtcttcttagtgccaaatgcaagccctttttaatttagtttgtaagaagtttagtttgtaggaaaaacacyattgtaaaataactagtatccttttgtttccttccgttgaaataaacctccactgtcgttggagtagacttgtgactgtaaggtggtgacagcccagaaccaagacaatgaggcaaagggaactttggccttaatgagccacttcatttccgatttccccccaagtacgtttgtctgacagcccactggcccaaagggtcggaaactagctttgtgtcttcactcggagttcatccacacgcatgctgacagcgtgcctaaggccaggcactgtgccaagcggtgaggggaggcctagagtgtcccatctgtctccagggactcttcttttttttttttttttttttttgagatggagtcttgccctgtcgcccaggctggagtgtagtggcgcaatctcggctcattgcaacctccacctcctgggttcaagtgattctcctgcctcagcccaggtgcgcagcaccacgcccagctaatttttgtatttttagtagagatggggtttcaccatgttggccaggctggtctcaaactcctgacctcgtgatccacccaccttggccttccaaagtgttgggattacaggcgtgagccaccgtgccaggccaggacacttcttaaagggaaaggcacctaaccacaacacacatcagagggaggactgcagccagggtgcaagtgctacagtggcacaggagggtgggtgtgcaagtctggagacaatccagaaaggccgcatggaggaactgacatttattccaggcccttccctttgcgacttaaagttaccaaagttaagtttggactgttgcaactggagcccagtgaggcctggaacagaatttggctgctggtcaaaaaggagaaattagccccatgtctaagaacatgtaggggaagagaggggcagtgtggggaaggcttttgctatgctcaggccatcagaatagtctaggtgtccccagagcaggtaaaccaggacttccaaactgttcccagtccaactgccaaaggaawtcaccatccggggtcccatcaacaggagagagctgctatgctgtccaaaatccaacccgtgctaaagccttctctggaacagtggtcttcaaactgttttgtggagcaaatggtgacttgatttcctgcccagtgataaagagtattgctgctaaacaagcttgaacaccactgatgcagtggggagagtgcaccattcgatagagtacaaggaggcagctgtacatctgtacaattggctctccttccatgcctgtgcagaaacatttccagatggtttatagacctaaatggagagagcaaaatttaagacagtacagtattttttttatcctgagagtatggtagtttttcttttaaaagtaacagcagaagccagaaaaaaggaggaagttatctgccttagtatgtttagcgttgctaaaacagaatacccaaggctgggtaatttatacagaaaaggtttgtttagctcctaattctggtggctggaaagtccaagagcatgatgttggcatctgcttggtttctggtgagggccttgtgctatctcgagacacagtggaaaagcagaaaggtgagtgggcaggtgcaaaggcaacccgctctcacagagagtgagaactcactccttcaagagggcattcatctattcatggggtgtccactcccatgacccaaaaacctgccactaggcccccaccccctaacaattacatgtgcaattaaatttcaagacaaatggcatccgaaccatagcattgtgttaaaatgtaacttccatacaataaaataacacaaagttaaatgacaaatgatagatgatagaagttaaaaactggattgtttcatatcattggatccagaatacatccaaatcaggaagaggcaaatataaaaccagtgtcctgaggacatttaaaaaaccaggactcccaggaagacatgctcaacaagtcatcaagagaaagcaaactgtgaagcaacacatcttacacctgccagagctcagactggcagcaactggcagcgataatgtggggaaaaggtacctcttatattgtgggacattgggcaaactggggcagccatttgggagagcaatttggcaataactatggaagttcaaggcacacccatccgtgacctgtaatttgcctctaggtgtgtgtgtgccacagatagttgacagttatgcacaaggatcacgggtggattttgcacccgtccgcagacatccaggacaataaaccacctagagaactcaaagtgagatgcccacatctatcagctcttgtcatattcagtctcttgatgaaacaaaactgtagcatatgtacagtattaatttactcatatagtttgaaacagagagactataccatatatagtttatggggcccttattggcagatctgtaagttggcaagacccatgcccagatccttccacctcaccttcctccactggatgacagaacaccggcctttctggcagccaggcctggcccgggcagcaaggtttcagctgtctgctgggtgtgggggaaggagaggcacaagcagttctgggttgcagtgatggttttcctgaagaggaaagggtgggtcgcgttgtcctttaggaagcagcaggcctgagggaaggctctagatctgtaggggccattctggccctggctgagcctgagccagcattacactgccggcctgttctttgaggaaatgagccgtctgtgaggtctgcagcacctggcgaggttctcggctctcagcagcgtgcaccctccttactgactcacaggctatggattgaattatgattaagtcctagcccctggcatgatggtattggagatggggctttctggaggtgattaggtttagatgaggtcatgagtgaagggcccttatgatgggattagtgccctcctaagataccagagaccttgctctctccagcatgtggggacacagcaagaagacagctttctgcaagccaggaagagtcctcaccggagcccaaccatgctggctcccttgtcttaaacttctagtcttcaaaaactgtgagaaaataaacttctactgtttaagccacctggtctccagcattgttatggcagcctgagcatgcaggtgcgcacgcacacacacacataacatggtcccaatgtaagacgcaggggggaagagatatggggcagggtatgggggtgatacctgacatcaggagagcaatcgcctggggcggcaggcgggaatgaaaaatgtgtaatttaatctcattttaaatctttcataaaaaaaaaaaacccaaactcatatggccatatattaactatttactccagcatgagtttcaccaatgtattctgaatatgtgaaatatttcattacaaaaacgtcaccatgatatcctgtcatcaacagcttcagtaagaatcatgaggagtcacaggcgctgtggctgcaggagcgtctgggaccaccaggactgtttattttccttcaagggtcattgcatgcagggctcgaacttacgtctcacaagcaaacaatattctcgaatgaaatgggaaacaggagagaggattctctggacatatctaaatttaaaaaagaacacacggctgggagcagtggctcacgcctataatcccagcactttgggaggccgaggcagatggatcacgaggccaggagctcgagaccagcctggtcaatatggtgaaaccccgtctctactaaaactacaaaaattagccaggcgtggtggcgcgcgcctgtaatcccagctactcgggaggctgaggcagaagaatcgcttgaacccgggaggcggaagttgcagtgagccaagattgtgccaccgcactccagcctgggcgatagagagagactgtctcaaaaacaaacaaacaaacaaacaaacaaacaaataacccccccccmaaaaaaacacacacatcagaaaaacaggcctatcaaagagaaccctaaaaattctaattgagcaactttattcacataatttctacaccaagaactcgaggttatctctgatggaaccaatttcactaatatttactttaagggcagagaagtcaaccaagtcctcacagtctcaagaatcaaaaacaaaacaaaaatacaaacagagagcaagtgggaagataaataacactccgaaataacctagctacacacttttagtttccaatttttctagcatgaaatcacttttctcttccatcctgtaagacgtgttctctcctctaggaaaaaaaaaagacaaagaaaatgatgttagcaaaattctagaattcccaatgccagccactaaaaggttaactgttttctacttattccattgcatgtataaaaatacttatagaaagtggcattacgttaaataagtaagttatgttaaagaaacaacaaaaatataatggcaaccccccgaccctgctccccacactcccccagggagcacaagctggtggggaagtccacatcccacaccctggcccagctagcgctgctgcacgagtgaatttaggagttctaagacttaagctacttttccatatctattaaaaggagagacagcctgcctattggacagaatcgatctaatcaaggggttctggtggggatgaaagaagataagacgtaaaaacggttcagcatggcctggcacacagagagcactcagacgttaggcatgaaaactccatatgtagttgcagctcatgaagaattggtctctttcctcaagaaatctatcatttaagcgggaaaagcagaaaaacataggaaaccagttaaacatgtttatattgtggtttaaaatgaaacctggggtgttcatgatttgacttgctatcaaattccagggtagctgggagggccctgcggggccaccaagggctgagtcctcaggatggtcccacaataatgcaacctcacaccattctctacaaggccgaggtccctcctgtgtggctgggccagaagaaagccctttagactgagcaggtgaaaaagcaaggcaggagcctctgcacggagcactggggcagatgtcactcatggaaaggggtctgcaggcgactggcacggtgccagatcatggaacaaggtgggaaaaggcacgagacaaaatcccaggggcaggatgatggtaaaaggaagagctggggcactatctgagaaaaagcagttaggtttagacaagcaggacaagcagagcagaggagctctgatgtgtgggagaccaggagaaacctcagatctctctctgggccggacagttgtttttggtgaaattctcccctttcaactgagaaggagactcttgagaggtcatctgttaaacagaacgcataaaytttgcctcaaagcagcctccatgaagtgtctgccatgaagatgtggctgagattcttgaaggcttcactaactgtggctgaaagtcacccggctggtggtttggtctgaaaaagccccaagtgggcacaggagtgggcatcaggcacacagttggagaccaagacccgagggaaagactgctgttagccgtgcactgccaggggaggagctccgagggccctgcccacacagtgcccctgaccctagctggggccctgcagagaaaaacctttcccatcacctgaacacttacgtatgtccatcctcaactgggaagacagatgacaaccaaggcttgtttcatctgcttctggttagctcacacagtatgactttatacacgaaaataactttgaaaaccaaaacatccaacaaaacctgggagcttctagaactgagccaaggagcctgagccgctaacccatgagactggtctgtgtccagacagctccccactgcagcacccaccatgtgcagcccctgggagggtgggggttacctgcacggagcaggcagctgagcggtgggtggagtctagggaggatgtccgaggatgcaatagcaaagaactggggagtagggggagaatgccagtgaaagttccctggaagggaagggc

SEQ ID NO: 12269 - DNA, 12987 bp, Homo sapiens
tggggatccttcaggaaccacccccctgagaaaatggaagggctccctaaatagctaacgtcatgtgccacatcttgcaattgtgtttctgtgtttggtgcatctgtttagctggttatagaatccatcccacctaacgcaggcctgcaaaagggttcatgctcaacagatgcctgttagatgagtaaatgaatgagtgaatttggagatgtgcagcttatccatgtcagagtccgaatttgaaaccgaggctctgattctgcatgtgttcccccagggggaatgggcataaagaacacgctggctttccccatttcaggtgaaaactgggtttcactgcctaggcagactgtgcccacagcaggatgggaaggaggccagcagcctgcagatgccccatacagttactcctgagcttcatgacaggttagcctttttaagaaacacagagagaaggtctccctccccgcccacccccaaaatgatcttcccacccccaatccaggccaagctggtaaaccaagtccaggcaggaaggaagatgctgttggggtaaataaagcaagggagcagtgttagcaggagggcggcctgggtggtgggagaggacagctggtttaggccgctgagtggccagggcccaggaggcttcttccgggctgtcccttccaccagcataatccctcgcacccagcccgaccctttggggccagaggtcctaccccagaatctccaccccctgcagactccagctgagctgaaacctgacccagagccaagggcatttcctgtctttgtagattctgtggctgccctcttggacctcaccccctcccctcacgcactggacacaggcagctcaaggtcccagcatggggattcctaggtgggcctcgtccccatctgccccaggtgtgggtcagcagcccagacttctgcactgaagaccaacaaaggggtgctctgccctcacttacagcccaccgtaggcaggatactcttgaagtcgttcttcacgtaccgaagagccaagctggacttacccacggagccacttcccaggagaaccagcttgaacacacggggctggctgggggcagccctgggctggggggtcctgtgtgcctgtgccatgccctgcaaagaatcacaaccgtctgaagcaagtggaacatcggagccacatcatctcagcaagctcaaccccggggctgcttctcggtcaggagcagatggcccaatacagagctcccaactcagaggccacctaggtccacactcctgcttccctctgcaccccatgccccatctccccatctgcaatttttaggtccatttttaggtctgtggtaaggaacaaaaggagctttgcttggaaagctccgggcacgggtcattgcagaccctgaaaagcaatgattacatgtgacggtctcagggcttgttgtcctccttccattactttcagtttttacaaatctattacttgtccccaaagtatctaatgcaaggagaggtaaaaagcatctgagcatttcttgggtggttgttcatggattaaagttggtgtttcagaaaaaatctacctaaaaaaaggttggtgtctcaatgatctcaaaacatcgtagacacattcccattgtgtctaaagcctcagaacccacagtaatatgccccagagaaaaccaacttcgtgatcaaaataaacgtgggcgacccctgcgtatttttcatcatagaaactttcatgtacacaccacaatagagagaacggtccgatgggcccatagacccacctcccgcttccccagtaatcagctcagccatttgtatcactcacactcccaaacctccccctgcagggtactgtgtaaagcagatcccaggcattctatcatctgcaaatctcagtagagatacaggtatttttttttctttgcagttcatgtgttgaagaaatcaggttgtcctgtagatttccagtacggatgttgctgattacacccctgtgttattgaatagagtcctatgaactctgtatttttgataccgcggtggttcaggacataaacctgattagatacaggctattttttggcaagattgccatgagagtgtgcgtgcacttcccacagaaggcaaataatgtccagttgtctttctgtgatgttggcagtcactgaagactattacttcgacccactattttactaaggggttgcaaaatggtgacattctaataatgttctaatgttatcactttgtgtttattatctaggaagagaagctccccacaaaaaatatgaaacccatcaggggcagctggtcctgggaacagagtctcttctcccttcctcaccacagtgggcaagagggaggctccctaaagggggaaggggaggaattttgaaaaggaaagaagaaaagcaggagtggttggaagcagcccacatgccctcactgccgccagtaaggagccatggccacagactggtctggtctgccctgcagggataagaggggagggaatcaagtttggaatcaatctcaaaacaaataggactgagtcctagataccaagaagatcgttctagagagaaagtgactgagagtcatggagtccagaacaggagggtttagggctctctacccatcagagaagaagggttccacatagtagactcgggtggttatcccaaacatgcctggaaccccatcttagctggaaatactcaagtttcaccatcaagtatgatgctggcttcagagacggataaaaaacataacattaagttttccatctgtgtttcttaaaaaaaaaaaaaagaaaagaaaaagaaagaaaaagaaaaagaaaagctctccaggtgatctcagtatgcagccaagactaggaatcactgctagaattctgttttccttggagctgggaacagtgtctagcacatagtaagtactaattcctaagaaatgaatgaatgaggccaagcatgaagagcacataacacagcacctgtgctttgaaatatccacctggattgaggatgatttcttggggccagctatggtttgcatggatcttccaaaaagcagatttggaaacttagtccccagtgcaaccatgctaggaggtggggcctaatggaagggggttgggtcatgaggactctgccctcgttaatccacgcccagcacagattaacactgctgcgtcttgcacatccacaagcctgcgtgttctcttgccctttcaccttccactgtgggatgacacagcaagaaggccctcaacagatgtagaccccttggccttggacttcccagcctccagaaccataagaaacaaatctttgttctttatacatttctgtcccaggaattctgttaaagcagcacaaacagactaagacagcatctgaggcacagtgagagtgcctggggtgggaacttagtccagcagatgatccgctcaagtcagctggggacaggctctcagaggtcaaggcacggcccagactttccaccctttggtggaaggggaaagggtagcgggggcggggtgagggaaaaaagactactcaatggctacagtgtacaccgctctggtatggggtgcaacaaaatctcagaaatcactaaagaacatatccctgtaaccaaataccacctgttcccctaaaatctattgaaataaaaaataatttaaaataaacagagataccccttcaagttctctttgctatttatttgcataggttaataaaacctttcctaagtcaaaaaatctgtagcccgaaacatgtctgaattaactgaaacaggtggactctgaaggaatgcaccatgaccactgggatgccggcgtctcattcctttgacaatgatatgtctctttgtttaatgaagttattttatttttgggctgggcgcagtggctcatgcctgtaaaggcactttgagaagacgaggcaggtggatcacttgaggtcaggagttggagaccagcctgtccaacacggtgaaaccccatctctactaaaaatacaaaaattagctgggtgtggtggcacacgcttgtaatcccagctactcgggaggctgaggcaggaaaatcgcttgaacccaggaggcagaggtttcagcgagccaaaatcccaccattgcactccagcctgggtgacagagcgagaatctgtctccaaaaaaaaaggttattttactataaacatacaagtgtcaatataaaagaagcagctacccataactccacccccgtaatacaaccacaaatggtatttttgcctacttctagtttttttctatgactcctaaaaacaaaccaaaacccatagttttaacataaaattattatccgatgggtaagaaatacttaataccaaaggcagtctcacacattgcttcaaaatcatgtttaatggacatataacatttctacaactatctcaacttgctgaaccattttcctaatactggatttttacttagttttaattttttctctgtaataagactgcagtaaacattttcttatataactttttgtgtgattgagtgttgtaagctttcaataatgagaggttggagccttctgtccaaagagaaaattaaaagtgtggcacctgacccccacctccagaatttaatcaagatggggttattagtagtgaaagatgttattaggttgttgaagacaaagatgttttcaggaacaccatattcaagactggcgcttctctagtaatcttaacttggggctttttaatctcttgcacctcccttccactaaagggaaaaaaaacggagagcaaatcccacattagtcttttttgcggggaaggggccattccagggaagggtctgattgatgagtctatcggcaactgtgatcctgtgtcacccttgcctggggcctgtgaagaatattgagattacgagaggtacacctgtacattgcattcagaatacagccatctgatacagaaaacacaatgtagattgtaaaaaggagtttacaagaaaacctgacaagcttcctagatatcactgggtattaaattgggaatgttgatgtcatttgaaatggatttctttaagagttcttctcattaccagaagttttttgtgtttttttttttcaagaccttaaaaccggaactttcccgaagaaaaatgcaaataagaatctccttctgggaatccgacttagtgagccatcagaaatctgaactaggaagtctccgccccagctttgtcctttgattatacacacatgggcacatgcacagacacaaacaaatacagacatgggtacaaacacgtgagcacacacacagacacacagagactcacacacagagaagcagagacacacacacacacaggcagacactccacaaagggcacagaggtttaaacaatgactcacctgttccccaggcccggtcacttgcagggagctgaagagcctgtcatcaccagtccacagcgttgctacctgtctccgctttctcctctctctggtccaggggaaggtttgcttccctccacaggcaggacaggacaggaggagcctctactccaatggaaaacagccgcagagcagaggtcaagagcagcagcctcggaccagagcaatgcccactggaccccagcgccaaggtcaggcctcttctcctcccagaaggtttcagggcaaagtccacagtggtcatgtggtcacctgaggcagggcaggaggctggacctcaaagcaggtgacccgggagcacctgcgcgctgccggaagtcaagtcacattccagtcctgcatttcctggcacccaactggagcccgtttttcagctttattccggggtttcacttccaggatctcactttggcacagaatgtttttcttggctccttccttggagctgtatggaatctttgttgcacttgaaaaaccaacagcccagaagagaaaagaatattccggtcagatgaattaattcctcccactgtcagctrgaagccatccctggctgagccctgcactggccagagrcaactgagtgtgagccagtccagggtcagatcctgggctgatgccacctgagggcggggtgggggcgtggcctccgtgcacatgggagactccaggtgcaggagagggggaggtggacttcctcttggtcttcccaagccatgaaayttcctggcttggtggtaacagaagagtctcctccaggtaagatttccagagcctctgagtatggctggggtagcagggttgggcctgaggctgaggagatggaaatctgttgccgtgaacatyrctccacacagccagtatacgggaagccagctcactttatgtcctccaractcaccctaacttctcgtttgggtctcatcccgcggggctgctgggaaataagctccgccaccacagtggttcctccgccctgtgggagtggggggctcttatgctggaggggggacactggcctggacttctgctgaggctctgcccctcatccctgcaggayggactagccagtcctaacacaggactagcgttgctctaccacgtccaagcctcctctgagattcttcctccatgcaaccacttcccctggggcgtggccacctccctggaagccgccagcatgctcggctgggcccccgcactctggaggcttgagaatctctctatttttgaatgacgtccttatcctctgcccccaggctggtaaccaaaggtctgggggtggtgacgtgctgggaatggtgtaactcgtgagatggaggctgaatgtggaaatacatgaatgtgcttctcttctctccagttcccttgaagaatccaccttcctgcagggttgggggagcgcagaatgggaggaagatacaaataccaattttatagcaagaatgcaaaaagaggccagcgcggtggctcgagcctggaatcccagcactttggaaggcgagctgggcggatcacttgaggtcaggagttcgagaccagcctgaccaacatggagaaacctcatctctatgaaaaatacaaaaaaaaaaattagccaggtgtggtggcatgcacctataatcctagctgaggcaggagaattgcttgaacctgggaggcagaggttgcagtgagctgagatcatgccactgcatgccagcctgggcaacagagtgaaactatctcaaaaagtaaaaaaaaaaaaaaaaaaaaattaaaaagacaaaatggttaagaaccagctttttacacccaaaatgggaggtttgtacctacagtcagacaacaggtttgaaagccaggccttgtgtggagaagggagttttggaatcagctaagctcaactgtgattatgtcacagcccatcgctcatgttagagagggtcccgactccctagaaggcgaaaacccctcaaagaccccaagccagtccccaaacagcacagagctgtgccacgtggcaccccagccaccctttgagcaatgcacatgcgtaagatctcagaagtgaccggtgacggtgcagagaggccctgagggccaggcacgggacagcagaaggagacaccaagacaggcaggctcaggagctggtgcaggcagggccaaggtgcctcagaggctggcggtccaggcagacattttcagcagagaccacggggaagcgaggacctctcacagatgtaaggacacacatcccctccccacactgccacgaagtcaccggccatactcccaacccaggcaccagtgtccatgtgagagagaggggcaaggtggcggcgtccgggagaagcagcgttttacctggtgatcctttacgttactgtaggacagcagatctacagggttggacggactgaaatttaaaatccccccctcctctgtttcccactagatcaagcccctggagaagatctccttcattaacatgaggtaaaacacatgaagaaagtctgtgacttgtggcaggggacagggcacagagcttctgcagctcagaggagagagccctgtgttcacagtggctctcaccatggcctggagtaaaaccagcacagcccctctagcatccccgggtggacagggtcgatgcctgtgtagttatctctggatgtgtaacacatacccactgactcggcggcttacagtaacacgcagttatggcctcacagctcctgcggcccggagtcggggctcagcctcgctgctcagggtcccacaggctgcagtcaagacactggccaggctggggtctccttctgagttcagggtcctcttctgagcccacatgtttgttggcagaattcagttccctcagtaggctgaggtccccattcctgctggcgtcagtgggcagctgctgtcagctcttcaaggccccttcacacagggcagcttgctttctcaaggccagcgagagatgctctctgacttctagatcctcttttaaagggcccacctgattggggcagacacccccagcacaatctcccttttgctcaactcacagtcaatggacaagggaccctaattacatctgcaaaatcccttcacctttaccatgtaatataacctgatctcaggagtgacaccatcacagtcccagccctgcacacactcaaggggacagacatgtccaccaggggcttggaatcttggggcccatcctagagtccgttgtccacagtgcctgaaccaaagctcacacaagggaggcccccccagcccaggtgacttcacagcccactggcacacgcgggcgggtggcaggggagccagtgccgaagcccgcctcctgcttggccagtgtggcaaggcctggtgctcatgctgatctcaagcaacctgacaccctcctcatgaaggcccaagggtacagtgaaaggccagaactcggatacttaagagggtctgggggctcacagcttcccctcctgcacagaggtcatctgggagcaacctgccagatcctccctcgggaaccagtcagctcctcccaacaccaatttactcgcctccaaagtaagggggctgagccagatggttctaaacctccctccgcttccagcctctgtgacggatcactctatgcactaagggccatccagcgtgagcaggaagcctgtggtgcgctcgtgtaaatcagaaggtgcattcccatggggacatgggatgtcaagctcagacacaaacctctcgtggaaggcgggtcaggactcaccgcccagacagtatccataatgccacatagatgtggtatcgtgcacaatcatcattgcttgtagtggaaatgaggcaaaacggaacataagcaatttacttacaggaccagaattaatattattttaacacataccaatttttaagtttttctctggccattttatcaacttttctgtgttaccattgacagggagaatattcgcaatgccacttacacaggccacgtaggcaggcatgcacacattctccttccaaaacatgtaaaattatatcattgtggagcaggaagggccccctggggaggatgtggcctgagtgcccgcccaggggctgaagaatctctgcaactctcctgccacctgatgtctcgggttctgctcaaatattgacagtgatgggatttcctctgagagtttatcccatgtgggttcctttctagccaagtcagtcctttgtaactttccactctttactgccctggggttgcgtggagagccaggcctactgctgcataaacatttcagagatgttgaagcagctctcaaggcttgcaacaggcattgctaacggcctgccccagatccgtgccccccttgttccttatgaggagattccccactgtggttcaggttgttagtgcctctccgtatcttctttcttgcagatgtgaccaggtgacccccctctggccagggaacaatgggccgaagtcctcaggggatttgtggggaagcgcgccccctcctccttggggttttcttgcggagctgctgtgaagactcagctcagctgtgataattacctgaggtcagcttctccagaatgcccttatctcctaaggcctttgagataagcaggaattgtggtgtctgccttgcctccaaacctttatccttgcttatctcagtggaaaattccagcagggatttctgaacaccaagttaaattcctccactcaacaatcagtttggcacgtggctgcccgccagtctgggcagaacagaggggagccaagggaataaacccaagtcctgcccccaggtgcccagagcctggcggggatgggacagttgcctgcagagcaagaggctgccacccagtttcacacaggccagagaggctgacctacctgcccagaggcaggggaagaatccagaggacctctcccggaggaggcacgagaagcccacgtggcagccaagaagagggagagcatcctgggccccggaagcacaatgccaggggcagacatgcactgggaggcacggggccagggacaccttcagtgagcacagggtctgggtaggcttcgggaggggtgagggcggagaggcagccaagccgggttgtgggaggccctgcctaattctgtaaagactaggattagaaacatgacaaaaatgggttaggcacggtggctcacacctgttatccactttgggaggctgaggctggtggatcatctgaggctgggagttcaagaccaacctggccaacatggtgaaaccccgtctctactaaaaatacaaaaattagccgggcgtggtggcgcacacctattaatcccaggtactaaggaggttgaggcaggagaattgcttcaacccaggaggcagaggttgcagtgagcccagaccatgccactgcactccagcctgggcaacagaacaagtctctgtctgaaaaataaaataaaataacaaaaatgaagggccgggtgcagtggctcacacctgtaatctcagcactttgggaggccgaggtgggaggatcacttacactcaggagtttgagaccagccagggcaacatagtgagaccctcatctctaaaaaaaagttaaaaaattagctgggcatggtggtgcatgcctgtggtcccagctactagggaggctgaggcgggaggattgcttgagcctgggaggttgagactgcagtgggccatgatcataccactgcactccagcctgggcaacagagcgagatcttgtctcaccaaaaaaaaaaaaaaaaaaaaaaaaaaatacactgcttttattgagcacctactatgtgccaggcactgtgctaagtccttggcttaaaatatctgattcagtcctcacagcaacccttcagaggagccccaccctgtgaccacaccctagagggccccacactggccttcctctggccatgctctggcttctaggtgagcagtcctccaggccaagggacaacacttctagatcacactgccagattcgggaagcgcagaattgcccacccaagcccacttctgaggcctgcaggggcctctgttccgggtccactccccaagagcaaaccacagcaggccccacggcaaaggcacagctgtcaataggaagcatggctggaggctggatgtgtgggccaggcacccacgtgcttatcctgagctcctcccagtgtgagacaggcccagggaaggaggctggctggggctgggacaccccattctggccaaggagccccagggttctaagtgcaaccctaggcttccaggctgtcaggaacatgtttctagcaaagtagcgcgtggggcattgtgttcaacaaggcatttgcttggcttttttcatgaatttatttattcacatggtgcacggagtaccatttgtactcctgtcccaagccctgcaaatgtgagaggggggatcccttatttttatcctattttatgagtgaagagtctgaagcccagacccactccaggccacagagaggaggacaagggtaggaaccctgtggtccgtaggagtgaacgggaggaactgatcagacctggatcagcctctgaggaggtgcacagcttcacgctactgctgtccctcggggaggaaccttagctcttcctgcagaggcctcggcgcttctcccagaaagggggcagataagctcggccattcttgccctgggctgcacagcccctggccactcgccccctaggacggatgctgctctaacattctcccagccaaagctgtcctttctattagggggttcccatgggcacgcacctgcactctagcttctcttgtaattaaatttaaaagcacggctcccggccccacacccccagcaccatttcgccctttagagtggcctccgccctcggtctacacttcctctctcctgggtctctcttgaatctactccaccggggctgtggcctccttcacttcacccagaaggctcctggacagtcacccagggcctctgtgttaccaaaccctcagtccccgctggcatagccgtgagcaccacgcggcctggctggccaccctcttgagcaggaccccgagaggcttccgacagcctgtcctgatggcccagtaccactggctcccctcctcctcctcccaaaacttctcaacactggggcaaaaattctcaggcctgtgcctcttccctcctcttgctccctgccccccttggagatccacagatgaaaaacacggaccgacagacgatgcttggacacaggcctccatccaggccaccctccggctccagaggcccaaatccgcctccctcccacgagaggcatctcagatgcacaggtccacactggcgctcctgatgcccaaaacctgccccacctgcagccctgcctcacttcacggcaacttgatccttccaggtgctcaggccaaaatcccagagtcacctgtgtcctctcctcctcacacgtctcacgtctaacccac

SEQ ID NO: 12270 - DNA, 28679 bp, Homo sapiens
  misc_feature (1)...(28679): n = A,T,C or G, or insertion/deletion polymorphism (see Tables 1-2)
ggctgatccaggtctgatcagttcctcccgttcactcctacggaccacagggttcctacccttgtcctcctctctgtggcctggagtgggtctgggcttcagactcttcactcataaaataggataaaaataagggatcccccctctcacatttgcagggcttgggacaggagtacaaatggtactccgtgcaccatgtgaataaataaattcatgaaaaaagccaagcaaatgccttgttgaacacaatgccccacgcgctactttgctagaaacatgttcctgacagcctggaagcctagggttgcacttagaaccctggggctccttggccagaatggggtgtcccagccccagccagcctccttccctgggcctgtctcacactgggaggagctcaggataagcacgtgggtgcctggcccacacatccagcctccagccatgcttcctattgacagctgtgcctttgccgtggggcctgctgtggtttgctcttggggagtggacccggaacagaggcccctgcaggcctcagaagtgggcttgggtgggcaattctgcgcttcccgaatctggcagtgtgatctagaagtgttgtcccttggcctggaggactgctcacctagaagccagagcatggccagaggaaggccagtgtggggccctctagggtgtggtcacagggtggggctcctctgaagggttgctgtgaggactgaatcagatattttaagccaaggacttagcacagtgcctggcacatagtaggtgctcaataaaagcagtgtatttttttttttttttttttttttttttggtgagacaagatctcgctctgttgcccaggctggagtgcagtggtatgatcatggcccactgcagtctcaacctcccaggctcaagcaatcctccygcctcagcctccctagtagctgggaccacaggcatgcaccaccatgcccagctaattttttaacttttttttagagatgagggtctcactatgttgccctggctggtctcaaactcctgagtgtaagtgatcctcccacctcggcctcccaaagtgctgagattacaggtgtgagccactgcacccggcccttcatttttgttattttattttatttttcagacagagacttgttctgttgcccaggctggagtgcagtggcatggtctgggctcactgcaacctctgcctcctgggttgaagcaattctcctgcctcaacctccttagtacctgggattaataggtgtgcgccaccacgcccggctaatttttgtatttttagtagagacggggtttcaccatgttggccaggttggtcttgaactcccagcctcagatgatccaccagcctcagcctcccaaagtggataacaggtgtgagccaccgtgcctaacccatttttgtcatgtttctaatcctagtctttacagaattaggcagggcctcccacaacccggcttggctgcctctccgccctcacccctcccgaagcctacccagaccctgtgctcactgaaggtgtccctggccccgtgcctcccagtgcatgtctgcccctggcattgtgcttccggggcccaggatgctctccctcttcttggctgccacgtgggcttctcgtgcctcctccgggagaggtcctctggattcttcccctgcctctgggcaggtaggtcagcctctctggcctgtgtgaaactgggtggcagcctcttgctctgcaggcaactgtcccatccccgccaggctctgggcacctgggggcaggacttgggtttattcccttggctcccctctgttctgcccagactggcgggcagccacgtgccaaactgattgttgagtggaggaatttaacttggtgttcagaaatccctgctggaattttccactgagataagcaaggataaaggtttggaggcaaggcagacaccacaattcctgcttatctcaaaggccttaggagataagggcattctggagaagctgacctcaggtaattatcacagctgagctgagtcttcacagcagctccgcaagaaaaccccaaggaggagggggcgcgcttccccacaaatcccctgaggacttcggcccattgttccctggccagaggggggtcacctggtcacatctgcaagaaagaagatacggagaggcactaacaacctgaaccacagtggggaatctcctcataaggaacaaggggggcacggatctggggcaggccgttagcaatgcctgttgcaagccttgagagctgcttcaacatctctgaaatgtttatgcagcagtaggcctggctctccacgcaaccccagggcagtaaagagtggaaagttacaaaggactgacttggctagaaaggaacccacatgggataaactctcagaggaaatcccatcactgtcaatatttgagcagaacccgagacatcaggtggcaggagagttgcagagattcttcagcccctgggcgggcactcaggccacatcctccccagggggcccttcctgctccacaatgatataattttacatgttttggaaggagaatgtgtgcatgcctgcctacgtggcctgtgtaagtggcattgcgaatattctccctgtcaatggtaacacagaaaagttgataaaatggccagagaaaaacttaaaaattggtatgtgttaaaataatattaattctggtcctgtaagtaaattgcttatgttccgttttgcctcatttccactacaagcaatgatgattgtgcacgataccacatctatgtggcattatggatactgtctgggcggtgagtcctgacccgccttccacgagaggtttgtgtctgagcttgacatcccatgtccccatgggaatgcaccttctgatttacacgagcgcaccacaggcttcctgctcacgctggatggcccttagtgcatagagtgatccgtcacagaggctggaagcggagggaggtttagaaccatctggctcagcccccttactttggaggcgagtaaattggtgttgggaggagctgactggttcccgagggaggatctggcaggttgctcccagatgacctctgtgcaggaggggaagctgtgagcccccagaccctcttaagtatccgagttctggcctttcactgtacccttgggccttcatgaggagggtgtcaggttgcttgagatcagcatgagcaccaggccttgccacactggccaagcaggaggcgggcttcggcactggctcccctgccacccgcccgcgtgtgccagtgggctgtgaagtcacctgggctgggggggcctcccttgtgtgagctttggttcaggcactgtggacaacggactctaggatgggccccaagattccaagcccctggtggacatgtctgtccccttgagtgtgtgcagggctgggactgtgatggtgtcactcctgagatcaggttatattacatggtaaaggtgaagggattttgcagatgtaattagggtcccttgtccattgactgtgagttgagcaaaagggagattgtgctgggggtgtctgccccaatcaggtgggccctttaaaagaggatctagaagtcagagagcatctctcgctggccttgagaaagcaagctgccctgtgtgaaggggccttgaagagctgacagcagctgcccactgacgccagcaggaatggggacctcagcctactgagggaactgaattctgccaacaaacatgtgggctcagaagaggaccctgaactcagaaggagaccccagcctggccagtgtcttgactgcagcctgtgggaccctgagcagcgaggctgagccccgactccgggccgcaggagctgtgaggccataactgcgtgttactgtaagccgccgagtcagtgggtatgtgttacacatccagagataactacacaggcatcgaccctgtccacccggggatgctagaggggctgtgctggttttactccaggccatggtgagagccactgtgaacacagggctctctcctctgagctgcagaagctctgtgccctgtcccctgccacaagtcacagactttcttcatgtgttttacctcatgttaatgaaggagatcttctccaggggcttgatctagtgggaaacagaggagggggggattttaaatttcagtccgtccaaccctgtagatctgctgtcctacagtaacgtaaaggatcaccaggtaaaacgctgcttctcccggacgccgccaccttgcccctctctctcacatggacactggtgcctgggttgggagtatggccggtgacttcgtggcagtgtggggaggggatgtgtgtccttacatctgtgagaggtcctcgcttccccgtggtctctgctgaaaatgtctgcctggaccgccagcctctgaggcaccttggccctgcctgcaccagctcctgagcctgcctgtcttggtgtctccttctgctgtcccgtgcctggccctcagggcctctctgcaccgtcaccggtcacttctgagatcttacgcatgtgcattgctcaaagggtggctggggtgccacgtggcacagctctgtgctgtttggggactggcttggggtctttgaggggttttcgccttctagggagtcgggaccctctctaacatgagcgatgggctgtgacataatcacagttgagcttagctgattccaaaactcccttctccacacaaggcctggctttcaaacctgttgtctgactgtaggtacaaacctcccattttgggtgtaaaaagctggttcttaaccattttgtctttttaatttttttttttttttttttttactttttgagatagtttcactctgttgcccaggctggcatgcagtggcatgatctcagctcactgcaacctctgcctcccaggttcaagcaattctcctgcctcagctaggattataggtgcatgccaccacacctggctaatttttttttttgtatttttcatagagatgaggtttctccatgttggtcaggctggtctcgaactcctgacctcaagtgatccgcccagctcgccttccaaagtgctgggattccaggctcgagccaccgcgctggcctctttttgcattcttgctataaaattggtatttgtatcttcctcccattctgcgctcccccaaccctgcaggaaggtggattcttcaagggaactggagagaagagaagcacattcatgtatttccacattcagcctccatctcacgagttacaccattcccagcacgtcaccacccccagacctttggttaccagcctgggggcagaggataaggacgtcattcaaaaatagagagattctcaagcctccagagtgcgggggcccagccgagcatgctggcggcttccagggaggtggccacgccccaggggaagtggttgcatggaggaagaatctcagaggaggcttggacgtggtagagcaacgctagtcctgtgttaggactggctagtccgtcctgcagggatgaggggcagagcctcagcagaagtccaggccagtgtcccccctccagcataagagccccccactcccacagggcggaggaaccactgtggtggcggagcttatttcccagcagccccgcgggatgagacccaaacgagaagttagggtgagtttggaggacataaagtgagctggcttcccgtatactggctgtgtggagtaatgttcacggcaacagatttccatctcctcagcctcaggcccaaccctgctaccccagccatactcagaggctctggaaatcttacctggaggagactcttctgttaccaccaagccaggaagtttcatggcttgggaagaccaagaggaagtccacctccccctctcctgcacctggagtctcccatgtgcacggaggccacgcccccaccccgccctcaggtggcatcagcccaggatctgaccctggactggctcacactcagttgyctctggccagtgcagggctcagccagggatggcttcyagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccrgaataaagctgaaaaacgggctccagttgggtgccaggaaatgcaggactggaatgtgacttgacttccggcagcgcgcaggtgctcccrggtcacctgctttgaggtccagcctcctgccctgcctcaggtgaccacatgaccactgtggactttgccctgaaaccttctgggaggagaagaggcctgaccttggcgctggggtccagtgggcrytgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacaggtgagtcattgtttaaacctctgtgccctttgtggagtgtctgcctgtgtgtgtgtgtgtctctgcttctctgtgtgtgagtctctgtgtgtctgtgtgtgtgctcacgtgttygtacccatgtctgtatttgtttgtgtctgtgcatgtgcccatgtgtgtataatcaaaggacaaagctggggcggagacttcctagttcagatttctgatggctcactaagtcggattcccagaaggagattcttatttgcatttttcttcgggaaagttccggttttaaggtcttgaaaaaaaaaaacacaaaaaacttctggtaatgagaagaactcttaaagaaatccatttcaaatgacatcaacattcccaatttaatacccagtgatatctaggaagcttgtcaggttttcttgtaaactcctttttacaatctacattgtgttttctgtatcagatggctgtattctgaatgcaatgtacaggtgtacctctcgtaatctcaatattcttcacaggccccaggcaagggtgacacaggatcacagttgccgatagactcatcaatcagacccttccctggaatggccccttccccgcaaaaaagactaatgtgggatttgctctccgttttttttccctttagtggaagggaggtgcaagagattaaaaagccccaagttaagattactagagaagcgccagtcttgaatatggtgttcctgaaaacatctttgtcttcaacaacctaataacatctttcactactaataaccccatcttgattaaattctggaggtgggggtcaggtgccacacttttaattttctctttggacagaaggctccaacctctcattattgaaagcttacaacactcaatcacacaaaaagttatataagaaaatgtttactgcagtcttattacagagaaaaaattaaaactaagtaaaaatccagtattaggaaaatggttcagcaagttgagatagttgtagaaatgttatatgtccattaaacatgattttgaagcaatgtgtgagactgcctttggtattaagtatttcttacccatmggataataattttatgttaaaactatgggttttggtttgtttttagragtcatagaaaaaaactagaagtaggcaaaaataccatttgtggttgtattacgggggtggagttatgggtagctgcttcttttatattgacacttgtatgtttatagtaaaataacctttttttttggagacagattctcgctctgtcacccaggctggagtgcaatggtgggattttggctcgctgaaacctctgcctcctgggttcaagcgattttcctgcctcagcctcccgagtagctgggattacaagcgtgtgccaccacacccagctaatttttgtatttttagtagagatggggtttcaccgtgttggacaggctggtctccaactcctgacctcaagtgatccacctgcctcgtcttctcaaagtgcctttacaggcatgagccactgcgcccagcccaaaaataaaataacttcattaaacaaagagacatatcattgtcaaaggaatgagacgccggcatcccagtggtcatggtgcattccttcagagtccacctgtttcagttaattcagacatgtttcgggctacagattttttgacttaggaaaggttttattaacctatgcaaataaatrgcaaagagaacttgaaggggtatctctgtttattttaaattattttttatttcaatagattttaggggaacaggtggtatttggttacagggatatgttctttagtgatttctgagattttgttgcaccccataccagagcggtgtacactgtagccattgagtagtcttttttccctcaccccgcccccgctaccctttccccttccaccaaagggtggaaagtctgggccgtgccttgacctctgagagcctgtccccagctgacttgagcggatcatctgctggactaagttcccaccccaggcactctcactgtgcctcagatgctgtcttagtctgtttgtgctgctttaacagaattcctgggacagaaatgtataaagaacaaagatttgtttcttatggttctggaggctgggaagtccaaggccaaggggtctacatctgttgagggccttcttgctgtgtcatcccacagtggaaggygaaagggcaagagaacacgcaggcttgtggatgtgcaagacgcagcagtgttaatctgtgctgggcgtggattaacgagggcagagtcctcatgacccaacccccttccattaggccccacctcctagcatggttgcactggggactaagtttccaaatctgctttttggaagatccatgcaaaccatagctggccccaagaaatcatcctcaatccaggtggatatttcaaagcacaggtgctgtgttatgtgctcttcatgcttggcctcattcattcatttcttaggaattagtacttactatgtgctagacactgttcccagctccaaggaaaacagaattctagcagtgattcctagtcttggctgcatactgagatcacctggagagcttttctttttctttttctttctttttctttyyttttttttttttttaagaaacacagatggaaaacttaatgttatgttttttatccgtctctgaagccagcatcatacttgatggtgaaacttgagtatttccagctaagatggggttccaggcatgtttgggataaccacccgagtctactatgtggaacccttcttctctgatgggtagagagccctaaaccctcctgttctggactccatgactctcagtcactttctctctagaacgatcttcttggtatctaggactcagtcctatttgttttgagattgattccaaacttgattccctcccctcttatccctgcagggcagaccagaccagtctgtggccatggctccttactggcggcagtgagggcatgtgggctgcttccaaccactcctgcttttcttctttccttttcaaaattcctccccttccccctttagggagcctccctcttgcccactgtggtgaggaagggagawgagactctgttcccaggaccagctgcccctgatgggtttcatattttttgtggggagcttctcttcctagataataaacacaaagtgataacattagaacattattagaatgtcaccattttkcaaccccttagtraaatagtgggtcgaagtaatagtcttcartgactgccaacatcacagaaagacaactggacattatttgccttctgtgggaagtgcacgcacactctcatggcaatcttgccaaaaaatagcctgtatctaatcaggtttatgtcctgaaccaccgcggtatcaaaaatacagagttcataggactctattcaataacacaggggtgtaatcagcaacatccgtactggaaatctacaggacaacctgatttcttcaacacatgaactgcaaagaaaaaaaaatacctgtatctctactgagatttgcagatgatagaatgcctgggatctgctttacacagtaccctgcrgggggaggtttgggagtgtgagtgatacaaatggctgagctgattactggggaagcgggaggtgggtctatgggcccatcggaccgttctctctattgtggtgtgtacatgaaagtttctatgatgaaaaatacgcaggggtcgcccacgtttattttgatcacgaagttggttttctctggggcatattactgtgggttctgaggctttagacacaatgggaatgtgtctacgatgttttgagatcattgagacaccaacctttttttaggtagattttttctgaaacaccaactttaatccatgaacaaccacccaagaaatgctcagatgctttttacctctccttgcattagatactttggggacaagtaatagattkgtaaaaactgaaagtaatggaagraggacaacaagccctgagaccgtcacmtgtaatcattgcttttcagggtctgcaatgacccgtgcccggrgctttccaagcaaagctccttttgttccttaccacagacctaaaaatggacctaaaaattgcagatggggagatggggcatggggtgcagagggragcaggagtgtggacctaggtggcctctgagttgggagctctgtattgggccatctgctcctgaccgagaagcagccccggsgttgagcttgctgagatgatgtggctccgatgttccacttgcttcagacggttgtgattctttgcagggcatggcacaggcacacaggaccccccagcccagggctgcccccagccagccccgtgygttcaagctggttctcctgggaagtggctccgtgggtaagtccagcttggctcttcggtaygtgaagaacgacttcaagagtatcctgcctacggtgggctgtaagtgagggcagagcacccctttgttggtcttcagtgcagaagtctgggctgctgacccacacctggggcagatggggacgaggcccacctaggaatccccatgctgggaccttgagctgcctgtgtccagtgcgtgaggggagggggtgaggtccaagagggcagccacagaatctacaaagacaggaartgcccttggctctgggtcaggtttcagctcagctggagtctgcagggggtggagattctggggtaggacctctggccccaaagggtcgggctgggtgcgagggattatgctggtggaagggacagcccggaagaagcctcctgggccctggccactcagcggcctaaaccagctgtcctctcccaccacccaggccgccctcctgctaacactgctcccttgctttatttaccccaacagcatcttccttcctgcctggacttggtttaccagcttggcctggattgggggtgggaagatcattttgggggkgggcggggagggagaccttctctctgtgtttcttaaaaaggctaacctgtcatgaagctcaggagtaactgtatggggcatctgcaggctgctggcctccttcccatcctgctgtgggcacagtctgcctaggcagtgaaacccagttttcacctgaaatggggaaagccagcgtgttctttatgcccattccccctgggggaacacatgcagaatcagagcctcggtttcaaattcggactctgacatggataagctgcacatctccaaattcactcattcatttactcatctaacaggcatctgttgagcatgaacccttttgcaggcctgcgttaggtgggatggattctataaccagctaaacagatgcaccaaacacagaaacacaattgcaagatgtggcacatgacgttagctatttagggagcccttccattttctcaggggggtggttcctgaaggatccycaggggatacaggggaattggcaggggtctgcctggcccgactcccagagctagtggtgagaagggccagggtgatggtgagaggctgtctgcagagggggaccctggggagagagtcaaggttaccctgtggtgtgcagtacaatcctcttctccattagcaaggagatctgtacccctcaccccccaagtcctgatattggacttggcttcctttaaaaatacatcaaaatgccaaggctggcctgagggtggcctcagttgagaatagagcacacagatgggggcctcaccaggcctggatgttgagagctttgtacctgggtggctggtattcaagatgcagagagaggcagcaggtgtcaggccaggtgagctggactggggatggatctcactctgacacggaggtctgcacactgtggctctctggctgttcttgttgttttgtgagtaaggttctgtggagacacaactctacctsttcaggtacttaccctctgtaaatgatattcttgctgttcctcctcctctattcactctaaaayggcagcagggttgagtggttgcagcagtgaccccatggccagtaaaacctaaagtatctgctacagggccttttacagaaggactccatgacgccaccctagcagagcctgcaggagccagcgcccaaaggcactcactaggtgagcgcaagcagggctgagagattccgagatgcccggttggagcgtaggagggtgctttggattcattgagacgtgcttggacgtgctcagcccacagagagctgtacccacagagcacccacctttcttgggtgggggtgggggggtgatgtgtggggtctgtgaagcttcagggtggtgccgggcattctgtattttacaggtgagggggatggaggccccgacaatgaggcgcgaggccctagttcctttcattccagcaagccagggtccgagcatccccctcacacctgccctgcctgtaccaattgcctgccctctcttcagggggcctaccagggtcggggggtgaacaaagctgggcttgctggggagtcctaggccaggttgggggtctttgcttggggggcaggcctgtatgtctcactctactcctggtcctctgtctggccccgcaggggccatccccctgccggcagctttcagatgaaagccagggcctcccttcctccaagcccctctcttccaggcctgggtttatctcctctctctgaggggaaggaccgttctacaggctgggctctgcctttcacccagaactggtgggtggagtctttgttcccactctgggtctctgtgatggggccggggtgggaggctgtgggctgtggcccgtggcacaacggggagaggagaacagccagattaggttagcctgtggctcatgagctgccttcatcccatcagcctccaaccctggggtccgcacttttgtattgagcacctctgtgtgtgggcagctgtgccgggttgcggggttagaaatgtggaagctccttcctttgctgttggctgagtcccctgtgggaaccatggtctcctctgcttccatccaagtgtctgcgtcacaccttgggataatattacagcttttagaggtagatattactgtaactatggatagatgtcatgcaatttattattatcattatgttaatttttttgagacagagtcttgctctgtcacccaggctggagtgcagtgtctcactggaacctctgcctcctgggctcaagccatcctcccaccttagcctccagagtagctgctatcacaggtgcgcaccaccatagccagctaatttttatattttttgtagagatagggttttgccatggtgtgcaccactgcacccggcctatgttaattattttattattattttttttgagacggagtctcgctctgttgcccaggcggagtgcagtggtgcaaccttggctcattgcatcctctgcctcctgggttcaagtgattctcctgcctcagcctcccgagtggctgggattacaggtgcataccaccatgctgatttttgtatttttagtagagacggagtttcaccatgttggccaggctggttttgaactcctgacctcaaggaatccaccacccttggcctcccaaagtgtatgttaattattaatcctcattataataattacatgatcacatattataaatgtggatattgccacttttaggatgaggagatgggatgtgctcactcctttaacttacgtgctttgggggaagagtgatctgtgttgcacaaaaaccctttgagagcagacactcctgcttcttttgtcacgtgtggcttcagcttttatcaagaacactgggctcctgtccaggggagagggtaggccaggagcagagcctcagaggagaatgggagtgctgtcctcacaggcggcctggaaatgcaggaggcagcacgcccagtgcttggctgcaggatccccgagggagggacaggatggatggccacaggcatgccactccttccctccgtctggattttttccctgtgaaacgggagtgtaaacaccttcctggagtggcctctccatgaaaggttgctgtcaccctgggtggcttaaggtcaccaaggccggccctgtccraggggtcagccttcaggaggattgactcaggtccctggggccctcccgagggtctggttcagtcgacaggtgtgtggggtggggcccacagcaggacatgacacaggtggtgggctcagctcctggcaagacaccgtccatccagaggaagcaggaagcagagccagaaagggacatggactcgagccctgaagctggaaagccaacgtgctggctggagccagaagagcaggcaggagcagaggcagaacggacgggagtccgagggacgggagtccaagtgagcgcagcctcccgcccacccccgccagggcctgctgcggaggtggcagctttaggagcccctgctgtgtcagggacgggggctggacctccccatggactgcccccactgtcctaacaggccacagcaggggagattctgtgcgctgctgactttctgcatgacatcttttggaaggatggtgacatctagtgcttgtgtgcacatttgccagctgaagccacaactaaccccagacttgttgggctttttccaggaaggggacggtgacaaacaggtactgagcacattcaacttggcaccagctgacttcccttctaaatcgagaacgtggctgacgtcctagagcccccagaaaataagtttccatttcatgttcctttcaatttgtcatcagctcactatttttacaaaacagccaagtgctacagagagggcttcaatgagcagaattggctgtttatttaaattaaaaggtaaaaaaagcaaaaccacttaaatgatattaacatttagtagagaggctgggcgcagtggctcatgcctataatctcagcaatttgggaggccgaggcgggcagattgcccgagctcaggagttggataccagcctgggcaacatggtgaaaccgtgtctctactaaaaaaataaaattaaattaaaaaaataaaatttagtagaggaacttttttttttttttttaagatggcgtctcattctgttgcccaggctggagtgtggtggtatgatcacagctcactgtagcctcaacctcctgggctcaagcaagcctccacctccacctcttcagtagctgggaccacaggtgtgcgccaccacacccagctaatttttgtgttttttgtagagacaaggtttcactgatcttaagctcctgagctagattgatcttccctccttggcctcccaaaatgctggggttacaggcatgagccactgtacccagccaaaactttattttttaattacattttggccttagccatggagatatagaaatgtggttagtgggtttctgaaaaaggttatgataataaatgcatgctgtcttccgggtcagagccacggagtgcacgagactaggttgcctcaaatacctgtccaggggcccacctgagggccttacatctctgcagggaagggaagggtctatgttctgtaaatagccaaacattgactattattatgcattatcattgcttggactaaaacccatgccctccttggaaatttgctggaattttacattagtgtaaattcaaccaccagccatcattttccctcccctcctccccccccttctttttttgaggcagagtctcactctgtctcctgctgcccaggctggagtgcagtggcacaatcttggctcgctgcaacctccacctcctgggttcaagcgattctcctgcttcggcctcccgagtagctgggactacaggggcatgccagcacacctggctaatttttgtatttttagtagaaacagggtttcaccatgttggtcaggctggtcttgaactcgacctcaagtgatctacccacctcggcctcccaaagtgctgggattacaggcatgagccactgtgcccagcctccagccatcattttcaacatggaaaaggaaaatatgagaggctaagattggtaaatggaggaagaaaacctgaattttatgctcacgtttcaccctgcgccagcttttaagataaaaccaaattcaaactgagaaatgtgatttgaagtgatgggaaacagaaagatgtggataaaaggcccacgttttaagacaacaagtccacaaagagcaaagaggacagaaagaagaagcaaaattcatatgccctttctctccttgctcaggcgatttaacagccaccnnnnnnnnnnnnnnnnnnnntgggcacggtcttcattctggcaccattgtcaatccagtggagcatctggtgtgttcagaggtttatagccggttcagtcccgacagttgccccatctaagctggaaatcactggtcctactgtctggatggagactgcagctttgtttgacctggggagttggtctgacttcaagttcctggacctgcagggaactgcaggacatgcgggcagaagagcccaggcagtggtttccgtttaggaagaggttgtctcatgatagagaagcacggtcttgctgcaccatgctggaaagctctgtccagcctcctgttctctgtccagcctcctgttctctgtctagtgggtgcaattgagtttctcccacccgtaaagaggcgattaagtcctaacccccggaacctgtgagtgcgaccttatttggagagagggtctttgcagatgtaattaattaaggccaacaagatggaacttaggatagcccttaagtccagtgactgacatccttataagaaggggagaggacacagccacagaggggcagccacgtgaagacagagccagagatgggggtgatgcagccaccaggaacaccagggttgccggcagcccctgaagctggaggaggcctggaatggattctccttcagtctccggaaggaaccaacccagccaacgcatcagttttggacctctggcctccagaactgcaggaagaaatttgctaatttgagccactcggctcatgggactttgttttggcagccgcaggacactcatgcactgtccttggagtgtaagtttttattttaaacatgtggctccatttgccagaatctccccaacagaccccaaacccaatccagggtctaggcagggtagcagctttgacaggagcctgtcggtgctggtggctcctccatgccccagacaccttgccttcccccgccccgtcctctccagttctgtgtataacacattcctgacaagccacacacaatggggcaaaacattttggagatctataaaataaccattttaaaatcatataactttggaaagcaaagggtagaaaatctttaaatgaacagtgcattgcccaatatgttaaagtgcttgggagtagttgtgtgtgtgtgtgtgtgtgtgtgtgtgtgtgtgttaagcaggtacatggctgagtaagacaaagcccctgccttcctgggggagacaggtggagaacgcaggaggccttgcctctgggtgtgtatggggtgcagggaggcttccgtggaggcagggggcccagcagcccttccggggttgccgctggaagatctcagaggatgcctaagagttttctaggtgaasaagaggaaggataccatgcagaggggacagtagagaagggtgttggtggggagcagcattgggaaagtggggaggttagcaggaggcgaggaaggccttggaggagcctatgcaatcgtgactgcctctgtgcaagatgggtctggcaggcgaggggccggtaggccgggggtgcccagggctctaggggttcccagagcccagctgcatcgctggaagctggcagggatgcatcggactcccagtaagtggagatccctttcacggcatatgtagcccagagcttttgtattaggtcctggagagatttatcttcccatccaaagcctctccaaaggccccatagcaatcactcccaacactttgctcgatgtggaaggctccatctcccagaagaactgtttgctcaacctcctggccatgcgggcgtgggagatgcatggccagctgtccctctgagcccattgctgtgcctgcggcttgccgtggtcccacctgagccgcatgtggcaacctcgtcctctgagtaagccctctgggcctccctgtttcaggtgcgttcttcacaaaggtggtggatgtgggygccacctctctgaagcttgagatctgggacacagctggccaggagaagtaccacagcgtctgccacctctacttcaggggtgccaacgctgcgcttctggtgtacgacatcaccaggaaggtagggcccgccttgagkcacrtcccaccctccttcccaagcacctgccttctggtttctccagtgcaatgatgccatggcgtaatcacaaggaacagagactccattagtgagcaacagtcacctcctccaggatggcctcctgacaaccccccatcctcctccacagtggggttctgctcctccgtggtccacaaagaacatgccgttgccatctgccactcagtagttcctggtgctgcattagggtcagggtttggggtggtggccagtcccccagactctcttgcacaaagtggtcctttgaggacagctaggcgtgggagattcaggagctcgaggcctgacctgaaataccccgtggctggcagtctcctgggcctggtcagggtgaaggatctgatgtgtgtcctagcagttttctgcctggccgcacaggtcacccaggacaggaacgtgccctcctcagaggaayggagcagccctgcaggtgcgcccatggccagttggattctgtgacattttacacaacgtgatcagcaacactggcttccccctcccggaatagctaatgaccacctataagttttgtttgatgttactttttttcttcttttctaggattccttcctcaaggctcagcagtggctgaaggacctggaggaggagctgcacccaggagaagtcctggtgatgctggtgggcaacaagacggacctcagccaggagcgggaggtgaccttccaggtaccgcccaggagaccctgctctgctcttccacagcaggagagagccctgccygcctgtgtcaagaccttggcactcacactttcatacacgcacacccacacacgcacacacttacacatgtgcacacacacctctacacgcccacatgcatttacacacatgcacacyccccacattcactctyacttgcacccacacacatttacaagtgaacacacacacacgcacacacacacagctttccacctgagtttctcttttagtcaaagatttccggtctttcctgaaaaactcaggcccagtgcaatggcagttcaagcccagtggccggcagagggaagggcagggcggcagctgcagggtgggctcggcttgaacgagaaaagtgatctagttcctcagcagggctcccttccctactctgttcccagaaggggcttctgtgcaaatgtagcctccttcactcgagttttgtcagtcctccttacaggcagaggcagcggtcacccaggtgtcgctgttgtttctcttccacggcatcccacctcccccaccacatttaggacgaagaccgtgtaaacagctgcagacaagtggctgatggggagaccccacacacactagaggctggcgcaggggaagacccaactcagggcttagaccgacgggcgcgcctcccaaagagaaaaggccccagcttcaatggaggctgtggagagatggagaagtggggtgaagattttggagaatctcgggggagagcaaggggagcaaagggagacagcgtcagtctgagccctcgttgcaagttggggtgggggagagaggatcctggcagcagagctgtgccctctgagagtgactacatgggctgtgtgcttgggcaggcacaaaaacatgggcacgaggttactcaaggcttggaggggcagtgggcggccagggtgggtttggagcgtctgtctggggagctggctggggagctcagtggggacaaatgcagggccggccgagggatctccgggccaggacaggaggagtgcactcacgatggtggatggtgcgagagctgggggcatggccggccacacctgctgccagctccatgtctggctggacagtcaggagcctgagctgtgccctctgggatccaccacaggctcctcttcctgggagagtcccggaggccaggggaggggcctgcacaggaaggcccccattcctcggccaccctcgactcctgggcaaggctgtggccttcccatgaatgctttctcctggtcacccgttgcaagcctgctgttttctggtttgcctttgctctgggacatccatttctccccagaggagagctgtgttggaaaatgagggttccccagaagaagggcccaggtgggtgccgtccaggggcctccctctgcctcatgtttcctgggttctcagttggttctttgcccagcatcaaagcccacaggtgccaacaggcatgatgggaggggaacctgggggtggggacttggctttccaggccctgcaggaggaggaaggccgcmcccygccagctagaggaagagcctcttccagggagcacaccccgcccctccctggtcctggctgctcaggagtgccaagaaacacaacttggacacgaaacgtggaggagtgcgggctccayggctgcagctttctcggatcttactgttggargtgaaccaggtgtccttaggaaactctcttataaacagcgctggattttgtggctgtttccttcaggaagggaaggagtttgccgacagccagaagttgctgttcatggaaacttcggccaaactgaaccaccaggtgtcggaggtgttcaatacagtgggtgagtcacgtccccgtgggccagacaagggggaggtgcttgtccctgaccaacttccctgggtccctgttgctggtgacgtggtatcccatagaatgtctttagggactggatggtgaccaggagggkcaggaggcccttgttctatggttcagggtaaacacaggaggggcgggtcctggggtggctggtctgcagggctgtgctgggctgggcgacttccctccctagccagccccctcctcttgctgttcacagcccaagagctactgcagagargcgacgaggagggccaggctcyacggggggatgcagctgtggctctgaacaaggggcccgcgaggcaggccaaatgctgygcccactaggtgcagcyactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcrcatggctcccaggaaagtgctgtgccctatccccactgataccatctgattccccgatgcctgtgcctgttccacctggacggtggccccctcagcctggcagcctctggacagagaggaaggaaggattggaaaagtccccgsagcacagcgacggtgggaagatgccttacgtctgatcttgatgggggcactggcctggagcctgggcccacctgcttctggggggttggggagcaggccagatggaggtggtggtgccaggaaraaatggagcgatgactgactgtggggtgggcccaggatttccrcatcttggtgaagttgcccctggraagggcagctgggggcagtggcgccagttcccttccatggtctcccggctggcaatgtggtgaagctgagtttctgtccaatgagcaggaagattytgagacatttcgcctgagatataagttgtactgcgtatgcagtttttcctccaaaaattaaattgcttttgacaatctggcttttagaagtttttgaggacaaggcagggcactgcgcctggtggatggttgtaggtatttctgtatagattctgggagggctcctgttaagtaaataaggaagcaggcccatgcggcaggctgtgactatcgtgggcctggcccagctctctggatgggatgcattcccagatggccacacttcttcatcctgcctgcctccctttacagagaaacccatgtctgagtctgtttttgtgttgctataaagggatacctgaggctgggtgatttatgaagaaagaggtttattgggctcatggttctgcaggctgcacaggatgcacagggccggtatctgtttctggtgaggccccaggctgcttccactcatggcagaaggcagtgagagctggcgtgcagaggtcacacggggagaggaagtaggagagggtagcagggaggtcccactctttttaacaaccagctctgggggaactcttacaggagctttggagtaagagctccatcattactgctaggatggcaccaagccatttatgagggacccacccccatgacccaacaccttccattaggccccacctctcacactgggggtcagagttcttcttcttttttttttttttttttggagatggagtgtcgctctgtcatccaggctggagtgcactggcacgatcccagctcactgcaatttctgcctcccaggttcgagcgattctcttgcctcagcctcctgagtagctgggactacaggcacgtgccaccacacccatctaatttttgtattttttagtagagacggggtttcatcatgttggccaggctggtctccaactcctggcctcgggtgatccacccgcctccacctcccaaagtgcagggatgacgggcatgagccactgcgtctggccctgggggtcagatttcaacatgaggtttggaagggacaaatatccaaactgcagcaacccagaccctgttttgggaggtaaaccccacatgatgttttcctgttgggtctctatctggacacctgatgtggcaaggttatttcaaaggtggccactttttggaaggtgatattggttttcatccttgtccctatgataagcaggtgtaagttttaaacaataagacattgttatccacctggaaaaagtggcatcactgtattggctgctgtaaggatcaaggaaggagaaagcaaaatacctcccgtttgacgctgagcttctcatcacacagaaggggaaagagctctgtgcctgaggcttccccggctcctccgggcttccttctgctctcactcactttgtgtagagatgccaggccttgaccttcagtggggcccagaccatggggagccctggcaggggatgggggaggggacacagaggccagccattgcctagggcctgtctggtgaggctggctgtgtcctggccagaagccactgcccctgtccaagaggcctcttcctcctgcaggttctggtggctgctccctctgctcatccattgggcctagggtgggcacagcccctccttgccagcctgggtttctcagtgttccaaccacagcttcataatagctcctccctcatgatccctggcttcgttttcctaactggaggagccacctgggtccactgggcccctggcagatccagctttcaatcttggggacaaggaaacatcttggatcttccttggagtctggctttcctggtgctagtgtgacctgaaatgaactcctcacgtgatctttactagacaaatgcagagcagatttcacacacctctgtcatgatctccaagaaaagctaaaggataaataaagaaaacaatagcttcctagagggcctgttcccttgattttcgcgaggactgtcctcgtttcttagacaatttcacaggtgaaatctgacactgtattattgctatccacactgcagtttccggctgcgagtaaagttggaccatttttcacgcgatgattcccttgccgatgaagaacatgaagtgtgagtccctagtgtgctaggctgtgtcctcgcgccctgtgcccccgcagcgggccctcagccggggtggggacccagcttgcgggcggcaggaggctgaggttgcccgtggccaccagatggcgctccagcattgtggaaggcaagccccacggtcctggcgtccggagtgcttgctctgctgaagggcgaaccaggaggctctcagaggagctgcagaggagcggcttgatgacatagaaggggaagaatacaagggaagtttgtaggatgcctgtaggtctgactgcctgcttccccctctgttttgacgacctcctgtgactatgccagcatttattattaaaatgtgtcctttgactccttcaggaatcatttcatggcctccccaagagtggacagatctgtggtggtcctggaaccctgggtctcccaggactgtgactgcccctttcccctcctccctcaccactaggcaggtggggctcaaccctgtgctggagtcacctgcggagcttcggaaagccccacacyggggcagggtgcggtggctcatgcctgtaatcctggcacttcgggaggccgaagcgggaggaccacttgaggccaggagtttgtgaccagcctgggcaacaaagggagaccctgtttctacaaaaagcaaaacaaaaaattagctgggtatgatggtgcacacttgtagtcctggctaccctggaggctgaggtgggaggattgcttaggcctcgggggtcgaggctgcagtgagccatgatcaagccactgcattccagcctgggcaccagaatgagaccccatctcaaaaaaaaaaaaaaaaaaaatggagcgcctcagctgcatatcacccagaggttctgattccatcagactgcccagggatttctaaatccttccaggtgagcataggtgaggctgagaacctcagtgagggcagggcctctgtctgtcctgatttctgtgggattcccagggtcctctacactgtctggcacacaccaggcactcaacacatgtgtatccaacaaagggaggaaagcatgttttttttccccagagacctaaagaacaggcaggctttcctgaaaacagcccccgccgcccctgacacctgcgtgtggaagactcacctgtgtcagtgctccaccaccttatcttcctgtcccgaaacggggctggggtggggcagcaggcaggaaggccctatttctgcaagcacacagggagaggccccagcagggctgcagacatttgtgtcgcagatgattcaggataaatgggtccaggaccccactggccccagatcctgggagaagctggtccatgtacccactgtccaggctgctgctggggaagcagctccagccctgcttagcctgagttcggacctgggtcttctcgtgagctgttgtttgcctgtggggggtggtggtggatgccggaggcatggcaatgttgatgagtggccctgggagcccctgccatcccagcctgtgatgctaaccttttcttctctctctctttctctttttttttttttttgttttgagacagagttttgctcttgtcacccaggctgtagtgcagtgatgggatctcagctcactgcagactctgcctcctaagttcaagtgattctcttgcttcagtcccaagtagctggcactacaggcgcccgccaccacacctggctaatttttgcatttttagtagagatggggcttcaccaggctggtctcgaactcctgacctcaagtgatccgcccatctcggcatcccaaagtactgggattacaggtgtgagccaccgtgcccgccctgtcttgtttcctcttgagtatgttcccatcccattcttctgatgggtctgcgtttcccagagtggctgactcacagaactattctttttaatttttttaaaatttattccctgtttaggactcccactggccaaatttaggccaattcgagtgtcaaaaattataaagttctgaaaaaaaagaaaaaaagaaatatcttctctggaagaatccaactaatgactgtggaaggaattagagaatcaccatggtgtgggggtgactggtggtgcagcagctgagcctggcatgggtagtcaggggacactgacatctcaggccgcaagctggctgggaaacaggatttggccatggggccctggccccagcacagatttcacattgatcacacagggaaaaaacctcttacaatgaagagatctgtctctaccacagggtcaaatagcactgtcagagagggagcccaggatcccatggtcagatatgatgcagtgggaaggacacagtttttgggtccacagtgcgcgacctgaatccaggcaagatcctggatgcccctctctgatgacaggaagtacagggaacggaagaacagggacatcaccttgggggaacaacttacaaatcacacaggtggagcattttccaagacgactcatctgggtgcttgaaaaattcaacaccaggacaacataaaaaattaactggtcggaaatcaaagagaaacaacggactgtgaatgcagattggagcccggtgggggaaaaaggagactgtcttgctgcatgtggggatttctgagtacagactaaaaactagatgatattgtgaaattactacaacggtttgttcaggtatgatgattttatggctatgtaggagactggccttattcgtgggagaaggatgctgaaaatatgcttctagtacattcactctgttcttcagccactgccgtggtccagttctaagacgtttcaccacctccaaaagggaacccccatatccattaagcagtcatccccccacccctcttccctatcccctgacagccatgaatctgcttccatagaatatgcaatgtcatacaacgtttttatataaacagaatcatacaacatttgaattcttgtgcctggcttctttcacttagcatgatgcttccaaggttcatccgtgttgtggcatgtatcagtggtccattccttttcctggctgagtaatattccattgcatggatagaccacgctgtgtttttctattcttctgttgatgggtgttatgaaatgtttgtgtccccgccactgcaaatttatatgttgaaatcctccccccattatggtggtattaggagatcgggtctttgggaggagattaggtcatgaaggtggaaccctcatggatgaaattagtgccctcataagaagaggctagagagcttgcttcctgtttctgctctctgccatgtgaggatacaacgagaagacggtgtctgtcaaccaggaagatggtgtcggatcaaggtgtcggatcagccagcaccttgatcttggacttcctgcccccagaactgtgaggagtgagtgtttactggctgagcctctgtgcctatgctatcttattagagcagcccgaactgactaaggcaatgggcattcaggtcatgtccaccctttggctacttggaagggtgctgctgtaaacgctgctgtgatgtgctgagcacctgccctcagttctccagggtctacacctggggcgaattgttgggtcgtttgataactccgtgtttaactttttgagggctgtggcctctttaaggcctgacccagcccctgctgccttcggaacagaccttgccccccttcctgttcctgcaggctcactctaccctggcgaggtggctcagggctggaggggctcccctgtagctggggaggtgcagtcaccccaactcagccccgtgtaggtggtctgggccttgccactggcccctctgagcatggatggccaagagggctgtggtcaggatgggctcctgagatcagcatctgcaggcagggtccagcaagagtccaggccaagctttgggttggagggagctggtgaagcctgttacatggctgggtg

SEQ ID NO: 12271 - DNA, 77848 bp, Homo sapiens
caggctggagtgcagtggtgctatcttggctcactgcaacctccacctcccaggttcaagcaattctcctgcctcagcctcccaagtagctgggactacaggtgcccaccactacacccagctaattttttttgtatttttagtagagacagggtttcactatgttggccaggctggtcttgaactcctgaccttgtgatccactcacctcggcctccaaaatgctgggattacaggtgtaagccaccgcacccagccaccctactaccttttttgtgcaaaatttcccactgttttatattttttctctctctcctttcttggcatgttttatgttgaatattttaatcatgccttattttatcttattttattttattttattttattttatttatttttgagacagagtctcgctctgttgcccaggctggagtgcaatggtgtgatcttggcttactgcaaactctgcctcccaggttcaagcaattctcctgcctcagcctcccaagtagctgggattactggtgcctgccaccacacctgactaaatttttttgtatttttagtagagactgggtttcaccatgttggccaggctggtctcaaactcctgaccttaggtgatccatgtgcctcagcctcccaaagtgttgggattacaggcatgagccaccatgcctggccaatcatgccatattatcccctctatcagtatagaatatggacactgtttctattttggtgattaccctagaccaggggtccccagtccctggggctgcagaccagtactggtctgtggcctcacagcaggcagcaagcagcaggagagtgagcattaccacctgagctctgcctcctgtaagatcagtggcggcatttgattctaataggagcacaaaccctattgtgaactatgcatgcgagggatctaggttgtgtgctccttatgagactaatacctgatgatctgagatggaacagtttcatctgcaaaccatccccacacccccaccccagtccatggaaaaattgtcttctatgaaactggtccctgctaccaaaaaggttggggaccactgccctagacaacacgatatacacttttaacttattaatattcactaccaagttcatttatacgtttactctcctcctgggaaatgcaatgaccttggaacacttcaacatgatttgtcatctttcaatgtatattattgtaatgagttttaattctatagattttttacaccatttcataaggcaatatatattatttctttatatttcatttgcccttctttccttcttgcatctctgatcttacatttccctctgacttgaagttgatctgttagcatctcttttagtgtgggtctgctgtttattatttatttacctgaattatctttattttgccttccatagtaaagggtattttatctggatataagactttatgttggcagttgttttcttttagcacgttgaaaatatgattccactgttttctggctttcattgttgtatatgagaagtcagctgtcagtctacttgcaatgcccctaatggtaacctgtttttttctttttaagattgtctccttgtgaataatttgtgcagcagcaatagaaaaagaaaaaaaaaatgaagattgtctccttgtcattgatcttgtgcatttctgacatttgttgatgtggctttgtttttcttttccttttttttttttttttttttttttttgagacagagtcttgctctgtcacccaggctggagtgcagtggcacgatcttggctcactgcaacctccgcctcccgggttcaagcaattctcctgcctcagcctcctgagtagctgggattacaggcacccaacaccacgaccagctaagttttttgtatttttagtagagatggggtttcaccatgttggtcaggcttgtctcgaacccctgacctcatgatccacccacctcagcctcccaaagtgctgggattataggcgtgagccactgcgcccagcctgtttttatttttctagctagtgaatcagtgggattgttgagcatatggcttgatgtctttcatcagttctggaaaattctcaccattgtctttgtgtctcctttccttctggtgctccaagttgtgcatttgtttggtcatcttactgttttccattatgtctcatcctttcttctgtattctccatctttttgtctcctttaaaattctggatagtttcttctgaccttttagttccagttcataattctttcttaatgcatcaagtccactcttcaatctatccagttagttcttaatttctgttatttagttacttatatcgtattcatttggttctttaaaatgtcttttgattaaataatttacattcctgattaatttttttaatctagtgcttttctgtcaagtttttcattgtggtaaaacacataacataaaatttaatatcatagccatttttaaatgtgtggttcaatgattaaagtacattcacattattgtgtaatcattaccaccatccacccacagaattcttttcatctttcaaaattgaaactctaatcccattaaataataagtccctattcccctcttccttcaacacctggaaaccatctttctactttctgtctctatgaatttgactctgctaggtacctcatataggtggaatcatatagtatttgtctttctgactggcttattttacttagcatagtgtctttaaggttcaactatgttgtaacctatgacagatttccctactttttttttttttaaagacagggtctcactctgtcacgcagtctggagtgcagtggcatgatcttggctcactgcaacctccacctcccaggttcaagtgatccttgtgcttcagcctcctgagtagctgggattacaggtatgtgccaccatgcccagctaatgtttgtatttttagtagagatagagttttgccatgttggctgggctggtcttgaactcctgacctcaggtgatccacctgcctcagccaccaaaagtgttgggattacaggcatgagccactgtgcctggccaagatttccttactttttaaggctaaataatattccattgtatggatgtgctacattttgtttacccattcatcctcagtggacactcaggttcctgccagctgttagctattgtgaataataatgctatgaacatgtgtgtacaaatacaaatctcttcaagaccctgcttttgattcttttcgttatagacccagaagtgaaattgctgggtcatatggtaattctgtttttaattttgaggaaccaccatattgtttttcacagcagttgtaccattttccattctcacgaacagtgcacaagggttccaatttctccacatcttcaccaacccttgttattttcttctgttttttttttttttttttaaggtggagtctcgcactgtgacccaggctggagtgcagtggcacgatctcggctcactgcaagctccgcctcccgggttcacgccattctcctgcctcagcctcctgagtagctgggactacaggcacccaccaccatgcctggctaattttttgtatttctagtagagacagggtttcaccatgttagccaggatggtcttgatctcctgacctcgtgatccacccacctcggcctcccagagtgatgggattacaggcgtgagccaccgcgccgggccaggtttgtttttttaatagcagtgatgttgaacatgtttccaggtgctcattggttctttggagaaatgtctgttcaagtcctttctcatttttgaaacaagggttttttgttgttgagttttaggagctctctctatattcaggatattaatcctttatcagatatatgatttgcaaatattttctgttattttgttttcaggctgcctttttactctgttaatagtgtattttgatgcaggaaaatttttaattttcatgaagtccgatttgtctgttttttcttttgttgcctgtgcctttagtgtaatatccaagaaatcatttccaaatccagcgtcatgaagcttttgccctattgtttcttctaagagttttacagtcttagctcttatgtttaggttttggctctatattgagttaatttttgtatatrgtgttaggtaagggcccaacttcatccttttgtatgtggatgtccagttttgctggcaccatttgttaaaaagactgtcctttcctcactgaatgctcttgacacccttgtgaaaatcgtttgattatatatcgaaggcttatttctgggttctgtttcattccatcagtctgtatatctgtctttatgccagtaccacactgattactggagatttgtagtaagttttgaaatctggaagtgtaagtcctccaatattgtacttcctttccaagattgttttgactactctgataaaattctaaagtttgcattgatctctttgaacctagttattttatgttctgagtctgataattccagtatctgctgtttctctcatttctgtctattcctcttggtggtatcatgcttccttgggtgcccgattatttttggctgtgtcctggactgcgtatttgtaaaattatttgcaggaataacttgaggcctaagatgatgccatcttcctccagagagggttttcctttgcctctgtgtagaaggcaggggtgctgccagtctgggacccccttagtgcccgttccaggcttcacccaaaggggaagtccagagggtcttttctaaaagcatggttctggtcacattcttcccagtagcaaataatgacagcgcagagctgaccactgtgaccagcaactcattcacctgggcccagcaccctgtcaggtcagagccagtgccctggtcagctcgagctgctgcagtaaaatgccttagattgagtggctcataagcaacagaaatatattttgtatagctcttgaggctgggaagtccaagatcaaggcactgtcagtcagcctcagtgactggtgagggcccacttcctgggccatagatggcatcttcttgtgtatcctcccatggcagaaggcagctctctggggcttcttttcttagggcactaatcccattcaccagggctctacctttattgcctaatcaccttccaaaggccccacctgctaacactatctctgtgggagttcggatctcaacataggaatttggggggacacaaacattccaaccatagccccctgttataagtaagaaaaccagagcacagagaggtcggcagctgaactgtgtcactgatggatgcgcagccagtggcatggagtgtggggccaggatggaagcatgtgtatctcactgcagaggtgctgctcagaaacgttatggggctccccgctgcctggaggccgagcacaggctcccctacttggcccctgcagcctccccggccatgctggcccctggccatccccctccgctctagtgggggcacccctccccgaagcccaccttgtgtgacccctgcccaccctttcaggcttagctcagatactggggctccgcctcgcctcctgcggccccagccggagcagagctgaggagcagtagctgctgggcaggcccaagtgccccactgactgaggccagggcccaaagggggactttcctaccccctatagcagccaaccaggactgggcactccacagggcatcgggtactgcacacaggtcagagcctgtgccctgagcacacagcatgacaggagggggtggagcaggccatgctgggcccatctcagggacggggggctgtcaggccaccctggggataccctgcccaggactggcttcccctcagagggtgcctggtggcaggggctggggaggctgctgggcccacccgcctgcccacagcccccagtcaatccccgctctggctttctgcctcccaggtgaacaacaacgggatcatctccttcctgaaggaggtttctcagttcaccccagtggccttccccattgccaaggaccgctgcgtggtggcagccttctgggcagatgtggacaaccggcgtgcaggcgacgtgtactaccgggaggccaccgacccagccatgctgcgccgagccacggaggacgtcaggcactacttccccgagctcctggacttcaatgccacctgggtttttgttgccacctggtaccgagtgaccttctttggaggcagttcctcatcccctgtgagtccaggcacttgtcctggggagggtgggtgtgtggctagggcccagggtctccccgcaccagggctccctcttgctgatgtgggtgtggtgcagtcactggtccatacccaagaggggaacacgtggtcaaaaccacagagccagagcagaagaggacacgtccccaaccttccccaatgctcctggaagccacttgcctccaggaaacaccaaattccccaaagcagcagctcacatgtcagagagaggtgttaggaggatttccatttggaatggcccagtactcaaaaggttagactggaaggttattctgttttatacccttccttgataatgccaaacatgacagaaacattgactcaagaataatcagccactttgcaggcttgatgagttatggtgggctgacactccctaacgaggacacctgcccactccggtggcagatgtatttactcagcacctactgtggccaggcctgcactgggcactgggtcatgactgtgcaagacagacagtgactccctagaaaagaggcgctgggtgcagaaccgccattttcagagctgtttgttcatgcatttaataaacacttttttttttttgagatggcgtcttgctctgtcgcccaggctggagtgcaatagcacgatctcagctcactgcaacctccacctcccaggttcaagccattctcctgcctcagcctcctgagcagctaggattacaggcatgcatcaccacacccagcttatttttgtattttcagtagagagggggtttccccatattggccaggctggtctcgaactcctgacctcaggtgatccgcccacctcggcctcctaataaacactttttaagagcaccttccaagtgacaggcaagtgttctaggcactgggcagacagccctggacgaagcagacaagacgcatctgccccrtggggtcactctagcaaggcatcaggaagtgctcagaagcataacccagccaggggcacttccaggagcaggttcattgacagaaagtggacagttcagcttcatgcatctcctcattgcgcctctcggctcccagagccccaccatgggcccttactggctctagtccgccctgtcccctagacggtgccaccaccccaattctacggccctcgcgtctttgtttgttttccgagtgttagcacttacgttcgccttcctgaagcagagcacgtagtttctctaatgttgacttttacataagtggaatgtacactgtatgatcacccatctttctcagtgactacaaactagcccagcaccaagcggcacgtgaatttgtttcacctgcaccccatgactggacagctgcaataccaggggcctgaggcgggcacggcatagcccaagtcgccttatgcatgatcctgtcctggtacacatgtttagaagggagattgccacctgcagaattccagttttcctctcaaaaatctacatattcaggcagggtgcgatggctcacccctgtaattccagcactttgggaggccaagtcagagggatcacctgaggtcaggagtttgagatcagcctggccaacatgacgaactcccctctctactaaaaataccgaagtcagccgggtgtgatggcgggtgcctgtaatcccagctactcgggaggctgaggcaggagaattgcttgaacccgggaggcagaggttgcagtgagccgagatcatgccactgcactccggcctgggtgacagagggagattccatctcaaataaaaaaaaaaaatctacaygttcatactcggagccacatttagaagtgccagtttccrttgttcagttcccacctatgagtgagaacgcttggacacaggaaggggaacatcacacaccagggcctgtcgtggggtgggggggtcgggggagggatagcattaggagacacacctaatgtaaatgactaggtaatgggtgcagcacaccaacatggcacatgtatacatatgtaacaaacctgcacgttgtgcacatgtaccctagaacttaaagtataataaaaaataaaaaataataaaaaaagtgctggtttccttgcaccccagctgtcattttccaactttgccaactcaatagacaaaacaatgagtgctactttttaacttacatatctttaatttctaggggtgctgaatttgttctaatattattggttacttgtattctactgtgatgtgtctcttcataccctctgacattttttctgtaatacttttggtctttttcttattgatctgtagttcttgaattaagggtctcgataattttatctgctgtatgcgttataaataggtttttcacattgctgtttgccattcaatttgatcttatggatttttttaagtattcggaagccctttgcagtcaaatgtttaattctcccttttggtttttgctgtgaacaaacatcacacttaaaagtcctttccctttcctgagttatacatatatgcctgtattttcttctaggacttttctttcactttaaaaccttatttgatttgggattactttttgtgtgtggtgaaaggcaggaccctgatctgattctttttcagggggtttcctgtttgtcccaagatcatttcttaaacagtcccgatcctttgcttgattctcatctggcgtacctcatctgtacgctgcctgccaatatttccttgcagtagaattctgtgaaaaccataaggcctgactgttaaacgctgcagcacggctcttccttgcttctttttacctttcctcttttcctttttgcaattttgctcatttcacacaggagattttgtggatctggctaagggcaggggacagtgtctgctcccatctgtgggccccgcacccaccccaggtgtttcactcaccccagcaatagttgtgggttgcagacggcctctgctgagtggcaggcgctgggagacagcagaggatgaggccaccaaggtcctgcctcggctgcccgtccagctggaagacacagacattgagcaagccaggggcccagtggacaatgacagtgcaccaggatggtggacagggcagggcttccctgggccaaggggagtgcagggccctgttcagccccctctccccggcaggtcaacacattccagactgtgctcatcacagacggcaagctctccttcaccatcttcaactatgagtccatygtgtggaccacaggcacacacgccagcagcgggggcaacgccactggcctcgggggcatcgcagcccaggtaggcgagtgcagtcggtgctctgtgttcagaacccctgctccccacagccaggactgtcatgagctgatgaggtaggcaggggctcaccataggcagatcccccagtaccgtgcagaggccaacgagagacatccacaaccatccctgaggcctctcactgcccaaaaacagaaacatcctcaggcccaaaggcacctttgtccccctgacctgccccgccctgcccctgcagtcccctttaacagctgcaacagcaacagaaatgtcctctgctccttgtgccctgcagtctggcctagccagtgacacaagggaccacagccggcaggaaaccccgggtgtggagggaatgaaacaggacaatggccacagggtcagtgctccccaggcccgagagtgcctttgggctgtgcgcacccccactcacctcctggccacctgctttctcttgggttcatacttgcccctggccccaggggaggcccaagagcccagaggtgagctgccggaggactgggctggggagccagggccagccctctccttggctcccaggaacggttggctgaggtcaggacctggctgggaggttgccgaccctggcaggaacatggtgggggcagggtaacccccacctctgtagacctggggaactggcctccctcactctgcccccaccccacccccaggctggcttcaacgcaggcgatgggcagcgttacttcagtatccccggctcgcgcacagcagacatggccgaggtggagaccaccaccaacgtgggtgtgcccgggcgctgggcgttcagaatcgatgatgcccaggtgcgcgtggggggctgcggccatacaagtaagaggacagaggagcagcttggggtgggagcgggctgaggaagggggttgatggcagaggagaggtggagacgaagggggctggatgctgacggggagagcaggagcacttgggtgtccagcccagcccacctcaggcrtgtgaaactaaggaaagcctggctggtcctgcagcctcagcttcccctagagaagaccccacacacacactgctctgggttggagggaaccctctggagactgtgccctagagaagatcccgcacacacactgctgtgggttggagggaaccctctggagactgcgggtttcgggggtaaagagttctgggtcctcaggggaggaggagcccagggacrcctctccctgggaccatgtggtccctactctccccttattcccacccagcctcctgcctgggctgggggaggagcagcatgtggtctctgaccctcagggccacccatgaggcaggtcctcttaccacccaggtcctcatttttgccagcgggcttgctgcttggtgggatttggtgwctgcttgacaaacccaagcatcacgtctacaggggagttccaggggtccttccagcccacagtgcacaaacggacggggtgggtgtccctcccaggggtgggcacgtggtttgtgggaacagccagggcggcagcagagccatagatggtagccttagccctgctgctgtgcggccttgggagccaaggagccttcagaaatcactgcttacacttggggcgagggcaagcgactgatccgctccactgagggcggcgcatcacaagccctgccaagcctggggccgcagtgaggctcgcaccgggacctgccccagactcgcctcccagccgcgagcatctaggctacgagaggggagaggggccgcatctccgcaacactgagtccccagagaacacgacaggggtagcagatgcgcgcgcaccactgtcggggcggaggcggggtgcaggcgcgccatggggtgggggatgaggggtagagagtgtgggggtgggggatggggtatgcaggtgcgccacagggttggggatgaggggtagatggtgtggggatggggggtgcaggcgcgccacagggttgggagtgaggggtagagggtgtgggaggtgggggcgtgccatggggtggggggtgcaggcgtgccacggggtggaggggtggggggtgcaggtgtgccacggggttggaggtggggcgtagtaggggtggggggcggaggcgcgtcacggggaggggagtggggggtggaggtgcgtcacggggtgggtggggggtggaggtgcgtcacagggtggggggtggggggtggaggcgcatcacggggtgggggttggggagtagaggcgcgccacggggtggggagagcaccgcgcgctcatgggaagaggaaagatgcagtcgcagggcgggaagacccatctgagggctgcaggtggtgccgcgacgaaggaggcccgaggagcccgagctacccacacactggggcacgaacaggcccccgcttgcatctgagcttagggagtccgggctcacggggcggggagcccagagcggccgcccagcatccgagggacacagccctcctgcagcccccagccacaccccctgcgtggcccgccttgtcccagaaacgctgacatgacggctgagtgccagcctcgggttttccacgccaggaaccctggaggggaggcggagtgtgccagtttttagacctgtccacggcagcgctgagagggatggaggggacggggtgctggtgtgagtcgcttcagggagtccgccccacacgaagccacctccccagaggccacgccaacagcaccgcccctgctcccctgctcccctgctccgacctaaagtgaaacctgaaacctggctgctttgctgcggtcacccgggcacccagaggccgaccttttgggtcaggggagggaagggagatgcggatgggagtggctctcctgccgagtccggaggcagcggctgaggctccagcccctccctatgtctgcagcgtccgtgtgcctggccctgcgcccctgcctcaacggcggcaagtgcatcgacgactgcgtcacgggcaacccctcctacacctgctcctgcctctcgggcttcacggggcggaggtgccacctgggtgagtgactggcccagggcgggaccacccgctggctgcgctgggctcaggaggagcactgtaggctccgccagtggccctgggcgcccagggtcccaggtcaggagtctctgtccccagggtgtgggtgacttgcttaggggaccactggggaccaaaggccatggccccctggagtgagcaccatgggcgggtgcagttgctgccctctctgagccaatctcgggcttgctcctcctccgtccccggcccaacccgagcccttagagaaaactcctcatccgggttcccgccgctgaggcctcagcctgccccatgtttcagacrtgaacgaatgtgcctcccagccctgtcagaatggtgggacctgtactcacggcatcaacagtttccgctgccagtgcccggctggctttgggggacccacctgtgagacaggtaagaggaacccaccggggcccacggggccctgctgggggcaggatagcgggagacacagctggacaaggctgaggtcttggaaggtccagcagctgtgcatgctgcaaggtagacagcccagagaagccaccctcgaggagtggaggagcccagatgcccagggaaaggcccatatctgggtagggggcaggagccatgaccagtcacacaggcttcctagaccatrgcattcggaccagggatggggcctcagaacaggccagtgcccaggtcccaaaccaggccaggatcagggtcagacaggcaccagagcccggatgggagcccgctggggatgtggtggggccgtcagaccccctctcagcccaggaccagcttgaggggaacgtgaagtgcttctggggtcagatgggctggctgtggggcaggaagggcacagccacacggtccctgccgctccctgcggctgctcctggacgctgtttctctcctgcccctgccttcagggaaagggggtctcacagcctaggtggggcctggagtccctctccatcctcactgctgctaccaaacctcagcttgccctcccagttcagagcccagctctttcgaagcagttgtcatcagagtcagcctctacttactgcccttcccccggcacctctttaggcccctcacccatgcccttcacccacctggtaaagaaaggtggacccccccccaattcctgctctccatctcaccatagggctctgctcagggagctttgcaaagggagcccctaaaatcaaagcaccgtgacctgctgctccccacccagctcagccaggtgtgcgtgtcctgtgtgacagtcgcttacaaaaacatgtaatagattgtttagatcaatgcrttcaaatagtgactatatcaatatctcaatctagaaaaaaacaattcttatcagatatttatggtcatgggaggttttttaaagtacttccttcctgtgtttacacatattggtattggagagagctatagttgaatggcagtaagggacttttgcacctgaaagtacattagaatgaagttctgcaggaatgcaatggaaatgtgacttcaaggtccaaagcagtgaagcacaattcccacctggcgagatgggcttgccagtgtgtttacagatcacacataggtgacagcacagtgaccccagttatcccttgctccccgagccctgccactgtcttcccacagccagygtcggagcaagctccattcataggagcctttcttcatccagaaactcctgccctgcttgcccacgtgctctcaacgtgagacgkgtgggagtcgggcttctgtggcattggtgccgtggcagactcagccctgcaggcgtctgtcccttggtaaaggccagggaggctggcaggwtctccttcctcttgctcagtgctctccctgtgcggtgctggccaggggcctggctgcgggaggacccaggcctatgatgagggtccccaagggtgactgggcagagcttcccaggaatgggctgctcctcggctatgccccaggctccaggagcccctctgtgatgtgcagcctggtgaggtcccctaagagggcttgaggcttggcgccaggaggctggttcaggtcttgggtctgcagcatgtcagttgtacgtgtggcctcggaccgtgagccttcrctttctcagtgcagctgtggcacaagccttgggtacaagccttcccgcctcgaccccccacaggggctccctgatcttggaagccaccttggcccccagaacccataacagcaggggcgcccgcaactaaaggctagggtgtgcatgctcctccacctagcggagttggggtcagggagacagggatcaccatgtcccatcagccaccaaagggctttcacacctcctgggggagtagtcaggccctcctgtctccttcctatgccaaagagagggccccaccattcccccatgactccagggagggacacacgctttggctatcactcttgtttctgagtttgttctgggtatgagctgtcagtaagacaggggatgtggttctcctctgcgtctggctctgctggccagggcaaaggagagacctgggatgtgtgggccaggtgctctggactcaaggagggccagcatccggtgaggagggagggcagagggtgggctcccctagctcactcccactcagtaactgggggccagagtccctttgccctggccgttcctgcacaggccactgcctgccccacccagcctctcgccccaggggccactcctacaccctgggtgctgcacacccttccaggctcagtcacagcctgcatccttgaccacagctcttctcacagtccacttggaataagagccacctagggagggaccatcccccaagagtgggagtgatttccatgcacccccatttgcccctgcccagcatacacacccatccctccatcccaggtttgctgaattagacccagttcagacagagcttcgggtggccagtcaggactgcctggccaggcctctttcttgcctgtcgcccgctcagaaacctgcctgccaggcccccctgcaatgtaagccagttgggggtggggctcagtgtacgtcccaggggtttctgtcccctcaggtaaccataactgggagtccatcgtcctgtctacacctcctcactctagcccaatccccctgtgacaccaaagagtgtcaacatggtggccagtgccaggtggagaayggctctgcggtgtgtgtgtgccaggccggatacaccggagcagcctgcgagatgggtgagtggcctggcttcggattggagaggggctcctgcccgtggccaggtgctgggcacagggtggttgtggcctggctcaagccaagcccgcacctctgctgcccctcagatgtggacgactgcagccctgacccctgcctgaatggaggctcttgtgttgacctagtggggaattacacctgcttgtgtgccgagcccttcaagggacttcgctgtgagacaggtaactggccaagtgcctgcaggccaccatggctgatggtggctttgtgccgtgaacacccccatagccactttccccttccttccttgccatctgactcacctcacacctgtctctggggtgggaggatgcctctgcccccttcccactccccagcgcttcccgctcagcctggatcctaagccaccaactgcagggaaaataggaagcaaaagatggatgctgcctccagggtgctgtgtgaggctgagcaaccccttcccctctctgggccttggtttccatctgtgaartgccaggagggatgacaaagttcacaagtctcctcttccagcctgggtgactcttgacttttttaacatcttcctctcctactctagaaccctcagcacacaagggaaagtaacgggaatcagaaagaaaactgacctttcactattttctattctattttgtgttgtttaactgctagttgtgacttgttagaggaattaaaaggccaactggagattgcagcctacagtataaaaatggctttcgtgtctgattgttgcacctgcctccagaggctcacccactgtgccgacttctgtggacgcaccaggtgctgcttctctccagggagatgctaaagacaaactattcaggttatttttagtttaaaaaattcaggaggaaattctgttttacccgtaagacacagagggtcatgggccctccatcagtctttgccgagtgcatgggaggccagggtgtgtcctgaggggagggtggggcaggagcgggaggaggcagcctcacctatttggctgctttaaagtcactgttccgtgtcacagctcactttgcccagattgttatctaaatatcaatgtatttcactaaattcatgtcaggaaacggataagtggtttcaaaaattttttgcaaataaaccgtgttttctacagaataatgatgcaagtagagtgaataataagaaacagactggccgggtgtggtggcttatgcctgtaatcccagcactttgrgaggctgaggcgggcggatcacttgaggtcaggagttcragaccagcctggccaacgtggtgaaaccccatctgtaccaaaaatacaaaagttagccagacgtggtgctgcatgcctgtaatcccagctactcgggaggttgaggctggagcattgcttgaacccgggaggcagaggttgcagtgagctgagatcgcaccactgcactccaccctgggtaacagaatgagtgagactctgtctaaaaaaaaacaaaagaggaagaagaaagaaacaacagactgacggtggtgctaacgtaatgactgattgactgtattacaaggcgcagatgctgacagtctaatcaggtctgacaggaagtgggccacaaattggacactacaaaaaagagtctctagtcttctgcttctggccaacaagaattaactgctcttggaatttccctctcaccatcaacacctagaaaaacagacaaaatctgtgaaacccttttcagccattagacaacagacagcacaagcctgtcacccctgagaaaagggaatcaaatgaggtgagccctacaattgccccagattctgcctggggcagtttccactccactgtgctgggaggaggaactgagagtccagcagtccctttgaattgaggagacaaagatcctagttcagtggctacaggatggtgctcctgaggcaggagggagcatgagatcaagaggagacctccctgaattttggcttattattatcaggctcaggatgaaatctgcaaggctggggaaagaaccactagaaagcagtaagtcaaacacttcctggagctcaaacagggctgggagtctattgcatagagtcctcagtggggtgtcactttagtagtgctgaactaaagactaatgtcgacctgccctaacagatcttaaagaaagcttaaaaggatcaaactgatcctaagtcattgagccatgtgccagaataaaatcctatactcctcaacaggagtatatcaataatacaacagaatccagaactccaaaatrcccagtcaaaaattatcaggtctacaaagaagtaacatataactcacagtcaggagaaaaatagatcaatagaaacaggcaccagaaatgacagaattagcagatacaaatgtttaattatctattatgaatatgctcctataatcaagattgttgaggggaaaaaaacctaatgagaagtagaaggtatttttaaaaacttgtagaaatgaaaaatatatctgagtttttaaaatacactgaatagtatttacagcaggttagatattgcagaaggaaagatcaatgaacctgaagagtgaaacagaaacaattcaatatgcatcacagagagaataagactaaaagaaaaagaagagatcttcagcaacctgcagaacgatattagggtaataggatccacgtatctggagtctgcgaaggaggatggagaacagtatcaagcagcctgggatccaygtatttggagtctgtgaaggaggatgaagaacagtatcaagcagcctgggatccatgyatgtgcagtctgcaaaggaggatggagaacaatattaagcagcctgggatccacgtatttggagtctgcgaaggaggatggagatgggtgtggaaaggagtgttatagaaaaagtatgtgaagaaataatacccaaacattttccacatttgatgaaaactaaaacccacatttccaagaaaagcatgaagaaaaccatgcaaagccataccataatcaaattgctgaaaactaatgataaaaaacctcaaaaacagccagaggaaaaagccacattacatacagcgaaacaagaatgaaacagacttctcgtcaaaaacaatgcaagccaggagacactggagtaacaccttcaaagcactgaaagaaaaaaccatcaacctagtgtactgtattaccagcaaaactacatttcaaaagttaagctgaaataaagacttttttacacaaacaaaaatgaagagcattcatcaccagcatacctgcattacaaaaaaatgttaaaggaaattatttagtcagaagcaaaaaaaaactggtaccaagggaaaatctggatctacacaaaagaatgaagagtgttaaaaatgataaatatgtgggttgaagactttttaatccctttaaagaaaaattttaaaataataaaacttayatgcagaaataaaatagatgactccaataacataaaccaagctgtgcaaactttttctgtaaagggccagaaagtaaatacttttggctttgtgagccatatggtctctatcacaactcaactctaccattgtaatgtgaaagcagccagccatagacaatatgtaaatgaataggtatggctgtgttccaataaaactgtacttttaaaaattgatggcaggcaagatttggtctgtgggttatagtttaccaactccaatgtaaaagataagaagaaatggaagtataatattgtaaggtccctatattacataaagtggtatatactgtttgaaggtaggctgtgtaagtaaaagatatacattgtaaacccaaaacaagtgaaaaataataataaagaattacagctaataaaccaattgtggagatagaaattgaatcctaaaaatactcratccagaaggcaggaagagaggaaaaaaagaaagaagtgggacaagtaaaagccgatagcaagatgataggttcagtctagtcatattggtagttacattaaaatgtaaaatgattaaacatacaaataaaaggcaaagattgtcaaattgaattgaaaagcaatacccaactatatgctgtcacaagaacccactctaagtataaagacacaggtaattgtaaagtaatagaatgggtttctggttctgaaaaagatagagtaagcacagtctacccctgtctctcccccactgaatacagctacaatcctggacagaatgcatggagtagctgtcagaggactctgaaaagtaaatagtagcaggtggattggggaagaagaccaagcttcgaagtaccaccaaaccagtggtgagtttaccattttttgttttttgctttggtatccccccagccaggactcaaagccacctcaaaaccagaagtgggcatccacacggacagaaagagtgctccaggagaagccctctagtccagcttaagaagcagggctgacagtgcagaagttggggaatcctcaagtgcccttaaactgcgaaggaagaaaccttcctctccagttggaggtgctgtggtttcaaaggggttgggtattgtttttccctttcctgttgtttttccctttgtctgtcatcccattacttggtcccagccatgaatgccatcattataaaagtggcaaggtagggaaataaaagccgcagcgtttttgccagaggactgaaaaaggtagccccagaaaactggaaagtactggggaaactggagggtgaatcttgggacagcaactccataaagttacttatgaactcctgagctcccccaagttgaaggaatctgtgtaatctgatctaaattgtattgacaataccatttataatagctcctctcaaattgaaagactttagtataaatctactaaaacattagagaatttgcatgctgaaaaactacaaagtgctgatgaaagaaatcaagatcaagtaaatggacagacataccatgttcatggattagaagactcaacgtagtaaatatggcagtgctctctaaattgatttatagatttaacatgattccaacagaggtctcagcagaatcttttgtaaatgtagacaaactgcttctaaaatttatatggcaagaaaaagaatttagaaaaccaaaacaattttgatgaagaataaattttgaggaatcacactactgagtattaagatttactgtaaagccacagtgatcaattcagtgtgatattggcaaagggactgacacatggatcaatgaaacaggagaggaaattcagaattaagcccaaacaaatatagccaattaatttttgaaaaagatttaaatccaatggagaaatgataatcttttcaacaaatggggttgaaacaattaaatatccttatatgtataaaaaaaaaacctcaacttcaacctcacaccttatacaaagattaactcaaaatggatcatagacctaaatggaaaaacataaactataagatttttagaagaaaacataggcaaaaaaaaaaaaaatttatgacctggtcttaagcaaagtgttcttagataagacagcaaaagcatgattcattaaaaagaaaaagataaattagacttcatcaaaatttaaaacttttgctttgtgaaagacatggttaaaagaataaaaagacaagctacagaccaggagaaaacgtttgcaaaactcatacccaacaaaggacttgtgatcagaatacaccaagaattctcaaatctcaactgtgagaaaacaaacaacccaattttaaaaatggacaaaagacttgaacggatacttggccacaaaagatacatatatggaggtgaataaacggatggaaaaatactcttgtcattaatatcagccattagtgaaatgcaaataaaagccactacgaggaatcacaacaaactcattagaatgcctaaaaaaaataatactgacctggtgtagatacagagcaactggaactctcacacatttttagtggaaatgcaaaatggttcagccactctaaaaacagtttggcaggttttttataaggttaagtatatgcttataatatgccccagcaatcccactccttgtattaactctaaagagatgaaaacttatgtttacacacaaatccatatacagatgtttatattatttctatttataatcaccaaaccccaaaactcaaatacccttcactgggtgaatggatagacaaattgtggaacctctgtatggtggaatactactcagtcataaaaaggaccaattatagatacatacgacaacttagatggatctcaggggaattatgctgagtgaaagaagccagtctcaaagattatatcctgtatggttccactaaatggcattcttcgtaaaacaaaactatagtgatgaacaaatcagtagttgccagggactgaggggtaacaggagctctgtgactctgaagagatagaccaaagaagtctttcagggagatggaatgttctgtatcctgactgtggtgggggttaaacaaatctatatatgtgttaaaattcatagaggtgtggtgaacaaaagtcaattttactgtatactgatttacaaagacacattttgaaagcacgtgaagaaactgaacatcttttaaaaaccaaaaagtagctggcgtggtggctcacccctgtaatcccagcactttgggaggccaaggcaggcggatcacgaggtcaggagatcaagaccatcctggccaacagagtgaaaccccatctctactaaaaatacaaaaattagctgggtgtggtagcacgtgcttataatcccagctactcgggaagctgaggcaggagaatcacttgaaccccagggagttggaggttgcagtgagccgagatcgcgccactgcactgcactccagcctggcaagagagcgagactctgtcaaaaaaaaaaaaaaaaaaaaaaagtaaattaggtaaactaatcaagataatgctgcagtggctatattaatatcgaataaattaaactttagaatggggaatactgctgggaattaggagggaccttttataacgatagaggggtcaattcatccagaagacataactctagatatacttgtacctattaacacctattcacatgaagcaaaagctgactgaactgcaaggagaaataggtccataattattggtggagatttcgacactcccctctcagtggttcatagaacatgtacacaggaaatcagtaaagctagaggagacttgggcttggcctacttggcatttatagagcactcacgttattctcaagtgctcttggccatcataggccatattgtgagccataagtaaggcccaatacattgaaaaggattgtgttttctgaccatagcaaaattaaactagagatcagcagaaagatatctggaaaatcccaaatacttcactgatagggatgcctgaccagaaacgtttggaggcccctggcccctgggtggtctctctggtccttcttgttctgtccattcctgggtggcttctctggtgcttcttgttctatccaatcctgggtggtctctctggtgtttcttgttctgtccattcccaggtggtttctctggtgcttcttgttctgtccaatcccgggtggcttctctggtgcttcttgttctgtccaatcctgggtggtctctccggtgcttcttgttctgtccaatcctgggtggtctctctggtgcttcttgttctgtccaatcctgggtggtctctctggtgcttcttgttctgtccaatcctgggtggtctctccggtgcttcttgttctgtccaatcctgggtggtctctccggtgcttcttgttctgtccaatcctgggtggtttctctggtgcttcttgttctgtcgaggaaggagctgggagatgctragctccatggggtgcagcgcagctacaaatccatttccagaaataagcttctggcttaaattccacttgggaatgacaacagaggtgaaaacccaaaggtgccattggagctgggcggggagaccactctccccacattccctgcgtggccgctggtgactgccgtctttcttgcaggagaccatccagtgccagacgcctgcctctcggccccttgccacaatgggggcacctgtgtggatgcggaccagggctacgtgtgcgagtgccccgaaggcttcatgggcctggactgcagggagagtgcgtctgggctgcaagggctgccgttttagggctggggcaggagacccagggagggccttcctgtgggtgcatgcaggaaacgccccgaaaagaaacgtgtgagtgcgcgtccactgcaatttgtatgggaagttggccaggagcagggcagggtctggagcgagggtgccatctttctgcgcccccacatgggaggctcctccctctcttcgtggcaggagtccccgatgactgtgagtgccgcaacggaggcagatgcctgggcgccaacaccaccctctgccagtgccccctgggattctttgggcttctctgtgaatttggtaggtgcccaggtcacccttcctgccctgtccctgagcatcctcataatcgggaaatgaatggtggcttcggccggggtccgtaggtccagactgtcgaccattggttctacccccacccaggagggactggccacaagagtgcctgaacctgttggggccactgggtcttgggaggccccatccttgacaaggactcgaggtctgctggaagacatgtggaatatgggatggggcttcctcctttctctctagaaatcacagccatgccctgcaacatgaacacacagtgcccagatgggggctactgcatggagcacggcgggagctacctctgcgtctgccacaccgaccacaatgccagccactgtgagtagctcggggacgagcctgctgggccgggggcccggacagaagccagggagaaagcggtggatgaggcaggcagaggccagagtccctacttcccttctgactctcgggagagctggcacctggggaagcctctctcaatagccttcctgtaatatggggctagacatctcctcttccccagtggagtaagctcacagggggaaaagcacttctgcaagtatacaaacaccatgtggtatcttacctaagccccaacacaagctattaaaatatttaatgcatacataattaggcatgtgtaatgaaatgtatcactactatacgtttgttagtgtatagatgagatggttaatcacttgcatcacgtatagttatatagaataatgatgtgatgctggcagtgatgacaggaaggcgtttctgtatcacagctcagtcctgcctcgtagaagacggaagggtgaattctgctaaaatcgagaaaaagagaaattccagggaggggccctagagcccactctgaggaatcaagatgcccacagagtgtattttcagtggccttggttccagacaggatgtcagggtaaccctggcaggcaaggtgcccgccagcctcttgccgcccgcacagatgcggcgtaagctccaggaccaccctctgtcccccgcccccagccctgccatcaccctgcgactcggacccctgcttcaacggaggctcctgcgatgcccatgacgactcctacacctgcgagtgcccgcgcgggttccacggcaagcactgcgagaaaggtatggcgggcaggggcgtccgggccggcgtcagcaccctggagagcgcccgcggtccgccgtcctgcttctctgctgtctctctccttgtttcgcgaattgctgacctcgtctagagccttgcctgatgtgctgctctgttctgtgtatttagaggtgagcacctcactgtttggatggttctgatctgcaccagtgccaggcctgctggtcattaccttgctcttctgaaaataggcttcattgcctgctcagcatttttccaaatagattttagaatcattatatcaaattttatttttaaaatttccataggattttgctcaatctaattcagcatggaaaatgtcgaattttattacatttagtcgcttgagaatagaagtgtccttctgtaagcacactgcaggcgtagctatccccgccaggccccacccaggactgtcccttctgtgcagtttgaagcaacagtcaggactcccatcagtcacccccagacctgttcagcatctcagtggtcagtgcccagagggggctgcctgaccgcagagtgacctggcaccctctccaggggctcagccccaggcacccccgcagcctggactggtgtggagccttccacggcccctcccctgctctgttccttgtccctgagggaaagaccctgaagtctgagccctggaccccgtggctcccccaaccactgcagcagaggtagaacaggtttccaaagagaagaccccaactgcttggttctttgcaagctctgacgaggtctttgtctctcaacacactcctaggaccaccctgaggcccttcatgggccctgcccagagctgactctggccctactccagctcacacctgccagtggtatgaagtccactgtacccaaggkgggggtcctaccagagcccacatctcctcactagaccagactgctggtacccagtgtccctgccccaaaggttctgtgcccgccccaggaactgcacagccctcccccagcatcccagcttccgtgagcacacaggccaccaatgtggacacctctgaccccggagggagtacggaagggacaaggatggctgtcctcaggggtggggcagccagagcttggacctgcagcgtgggatggctggcaggagaggagcgagcacagtggggcaggcccctcccgccactcagaacacccaggggtccaaggattcggcactcctcactggccctttgacagtgtgattgtcaaggtggcaggacagatgtgcttggtttcgcagacacctttaaatatgtgcttgcctcaagcacaggcccggccgtctgagctcctcgggttccaggaactgttaggacccagggaaaatgtggcaatgycaatgcaggtacagaacacacagaaatccagattgactgctggggaccctgatgtcacggcagatgagactcagctgcttcctgtcagatggggaatgcccgtgtgcaggagggagggagtgctgcgcccgctgcagtgttggggccggttctccacaggaagggcccagccattgccagagcctgggcagaaaagaggacaggcaagcaaagggcccacctgtgactgagttggggtctccagcctgtgagccccaccccagcccccaccatgtgtgcggacctgcttggcccctgctgcrgccaggccccagggcttcgtcgagaaggccccaccagcaccagaggactgaggagatgccaggagggtatagtggctctgtggggccagcagcctggccccgttcatctgcctctctgtccttccacacagcccggccacacctgtgcagctcagggccctgccggaacgggggcacgtgcaaggaggcgggcggcgagtaccactgcagctgcccctaccgcttcactgggaggcactgtgagatcggtgcggcccccaggggcaggggggagggcaggaacgacgggccagccctgagctggggcccctgatgcaccctccctgccagctgtgggtctgcttctcatgaagaggccccagctctgggatgttggggaacgtgggaggggcagtgggctgtgaccctgacctggcttctgtttccagggaagccagactcgtgtgcctctggcccctgtcacaacggcggcacctgcttccactacattggcaaatacaagtgtgactgtcccccaggcttctccgggcggcactgcgagataggtaaggtgggtgggaggccaggccagggcggccaggggtgaaccctctctgcagatgtgaaaacaggcccatgggcagggctggtccaggccctggaggcgcaggaggtggagctgggtgcaggaggcaggatgccccacacagtcccgagccttcagggaagacacagtggccaggaccttcctgcattctggcagccccctccccctgcttccggagcccgtgtgtgaatgggggcacctgcgaggaccgggacacggatttcttctgccactgccaagcagggtacatgggacgccggtgccaggcaggtgagagggtcagggggatcaagcagggtacatgggataccagtgccaggcaggtgagatggccagggcccaagcagggtacatgggataccagtgccaggcaggtgagagggccagggggccaagcaggrtatatgggataccagtgccaggcaggtgagagggccrgggggccaagcagggtacatgggacaccggtgccaggcaggtgagagggtcggcggggggggggggggtcaagcagggtacatgggataccagtgccaggcaggtgagagggccggggggccaagcagggtacatgggatgctggtgtcaggcaggtaaggcctggggggcccaagcagggtacatgggatgccggtgtcaggcaggtgagatggccggggggccgagcagggtacatgggataccagtggcaggcaggtgagagggctagaggggggtcaagtggggagcgtgggatttcttgctaatccctgcagagctgggcaaggcaggaatgggaagaaggaaacgtatcacggcaaccaggccccagaagtcgaggcacctttccccggtgaagggcagtgtgggagcaggacatccctgggccctgcagtcgggtcgggcagaggcagggcggtggggaggggccaggaaggcacaggaccgtgcgagacaggctgccgtgccttgcagaggtggactgcggccccccggaggaggtgaagcacgccacactgcgcttcaacggcacgcggctgggcgcggtggccctgtatgcatgtgaccgtggctacagcctgagcgcccccagccgcatccgggtctgccagccacacggtgtctggagtgagcctccccagtgccttggtgattctgtgggcccttggggtggggcaggtggggcccacaccctcctcatcctggccatgtggaggagcacaggggctgcaggcccaagcctggatgcccagctctgacctggtcctgcccctgctcccctcagtctcctgtctgtgaatgtggaccttggggtgacagtggtgatgatcacagtcaactttgctctggggcattcactaaaggcttccccatcctcagagcagcccggagcaggaggtcaaacacccaaatacccactctgcagatgcagyagctgaggccaagaggtagcccaggggcagagtcctaaagagccagatacggattcaggacctacctcttactcctggccccttgaagacttgtggaatcagaacaagatcccccttccccctgcaggcatttgaggagtgctgctccagagagcattgccactgaggtcccacccctgtctggcttgggagctgggagtgcacagcctagagacaaggctccctctgaccgaagcccctggagaagtagggccattaacaccctgcaggtgcatcgcattatgccagaggagtccaaactgtccatcagaaagtctgtgtgatgtgagctagtttttacgaagcaaggattttaaaacaagcttaggaacagtgggtgacagcacccagatttgagtggggcacataagcccatccctgtcccccacatgccccgcaaagccaaggccaacctgcgtggtctcaggcgaagggttctgggaacacctggcttcaagcatccctcctttccttctgggatttcaagccccagggtgagctcctgactgtcttggagatgaccccccctcccaatgctacttccccacctatatgttgccagaagatgagaagccgatatcctcagagaatatgagcaaccagccaggatatcgagacacctgaaaagtacgattgcctcagaaaacaataataaaagtccagaaaatatgtatgatcggaagcagaagtgtagaagacagactaacacaggagttcaagaccagcaagggcaacatagggagacctcatctctacaaaaaaatttaaaaactagcccggcgtggtggcacatgcctgtagtcccagctacttgggagactgaggcaggagatcacttgaacctgggaggtcaaggctgcagtgagccatgagcctgccactgtactccagcctgggtagcagagcaagaccccacctcatacaaaaaaagaaaatggattaacggtataaaataaccgtgacaaatttacaaagtaaacatggcattggccatccaaaacaggatcgataaattattttaaaaacagtgggaataagcagattaaaaactataatagttgaaataacagacataatttataaatggatgcagatgaagagtaagttagtgagttgaaagatcagcttgaagaactcttccagaaagaagcagggaaagataaataaataaaaaagaaaatgttggggccaggtgctgtggctcacgcctgtaatcccagcactttgggaggccgaggcaggtggatcacctgaggtcaggagttcgagaccagcctggccaacatagtgaaactccgtccctacttaaaatacaaaaactagccgggtgtggtggcacatgcctgtaatcccagctactcaggaggctgaggcaggagaatcgcttgagcctgggaggcggaggttgcagtgaggtgagatcgtgccactgaactcctacttgggtgatagagtaagactctgtctcaaaaaaaaaaaagaaaaaatatttgtgctgtagagggtagaaggtgtgctaaagctgagataatcggagcccaagaagaagagaaaatgaaaatgtaaaggataagtggctagggagttaaattcccagagttccagatgaacagcagattaaaagggcccacagaacgtcagacaggagcaaaggggaaacaaacaccagacacattatagtaaaatacgagaatatcctagacaaacagaaaaagttttaacttccagagggaaaatcaggtcatgtacaaaggaacaagaatcagcttgacatcaaacttctcaacagcaatatcagatataagacagtgaatttttttaaatactgaagagatccatttggttagggtgtagacagtcacagaataccaccactgtcactgtaatgttaaaggaacatcatgaagcctatgaaatcctatcttttcacctattaaagagttgaggaggcagagaagttgaggctgttggctgctttcatcctccagccaaatttgtcatgctgcaggggcaagcacaatggattgaaatcaagagaagccacagatgcagagagtaagttctcagcacctaccaggtctcacccacaggatcattacaaatgcatgagaagccagggactggtctgtaaagcagagatagatttcatagtctcacaaggattagattccaagtccacctggagggagaggcctgtccaaatccttaagcgtttaaaaccaatcttgagctgaaactacttaaaactgctctagccccaacccagctcaactcctaatgatatcacaggtcagctactcagcttcgctacctagtagagaatacagtatgttcatcctagtgtgaaattttctactttgatttccactgttcttatacgcactatgtctaagaagcaagaaatgatgacacataatctaaagaagaaacaatcgatagaaaaagaccttatggatcacccaagtgttggaatttagacaaagactttaaaattccatgaaaaattttctttatgttaaagaaaaacgagaggcagaatgattgagagaatagaaaatttgagcagagaaaaaaagtaacaaaatagaaaatctagaactgaaaatatatccgaaatgaataaattgttttatttgttatttatttttgtagaaacaggatctcatggtgttgcccaggttggtcttgaactcctgarctcaagagatcctcctgcctctgcctcccaagctgctgggattacaggcatgaaccactgtgcccagctgaaatgaataaattggataggcttaacaaaatggatacaacaaaatggatacaacagaagaaaaaaaaccatagaactcaaagacaggacaacaaaattatctaaactgcagatcagagagaaaaaataatttaaaaatgaattaggaattctgaataagtgaaattttttttttttttttttttttttttttgagayggagtctcgctctgtcttccaggctggagtgcagtggcacgatctcggctcactgcaatctccgcctcctgggttcacgccattctcctgcctcagcctcccgagtagctgggactacaggcgcccatcaccacgcccggctaatttttttttatatttagtagagacagggtttcaccgtgttagccaggatggtctcgatctcctgacctcgtgatccacccgcctcagcctcccacagtgctgggattacaggcatgagccactgcgccgggccaaataagtgaatgttttaaaaaacagcatcagagatctgtgggacaatatcaaacaggcaaacaagcacataattgaagtcccagaaatagaggacagaatgggcaaaagaatatttgaagagataataattggacattttctaaaaatgaagaaatacatcaacccacaaattcaaaaagctcagcaaatcccaaacagtataaatattgaaataggttgggtgcagtggctcacacctgtaattccagcactttgggaggccaaggtgggaggatcacctgaggtcaggagtttgagaccagcctggccaacatggtgaaaccccatctctactaaaaatacaaaaattagctgggcatggtggtgggcacctgtaatctcagctactcaggaggctgaagcagtagaattgcttgaacctcggaggcggaggttgcaatgagccgagattgcgccattgcactccagcctgggcgacgagcaaaactccatctcaaaatatatatatatatatatatatatatatatatgccatacgcagtggctcacacatataatgggaggtcaaggcaagacgatcatttgagcccagcagttcaagaccagtctgggccacatagcaagaccccaactctacaaaaaactttaaaaattagccaggcatggtggcatgctcctgtagtcccaactactcaagaggctgaggtgagaggatcacttgagcccaggaattcgaggctatagtgagctatgatcatgccactgccctccagcctgggtgacagcaagaccctgtctctaaaaaattaaaaattaagaaataaacttaatacctaaatatctttattcagtcaaattgttattcaaatgtgagaccataaaaaaatatattctcatacaaacacagcttcagaggcttagcaaaaaaaagtgtccttttctgaaagaagtaagataataataagataataagataaacccagttaagagaagggagagttatcagatttcatggtaagacttgtcactatccaaaaggagaaaaaagtaatcagaagaacatggcaaatattaagattggaaagaattatgatagaaaaaatacaaatatgaatggactaactctccaggtgagagattgccagatgtggtataaaacaagctagcactcttagacattcctaaaacataagactatacaaagaatgaaagtgaaaggaaaaaaataggtgtatacaaatcaaagctggcgtattagctatattactatcagaaaaagaagagtataagacgaaaagcatcattaagaatgagagggtgtctctcaatgataattggttccgttcacgaagaagatacaattattataaatattcaagcatctaatacaataatctcaatatatataaagcaaaaattaagaaactgacattaataccaatgttagaaaagaagaaaatttcaaacttgattaattaaatgtctgacttcagaagttaggaaaaaaaatacgaaatgatgctgaaaaaagtagaaggaaagaggaataaaggtaaaagccataattaatgaagtagagatccaagatacaaaagaaaggacaagccaaaatyagttctttgaaaagcctaatgtaacatgtttagtggatatagattacaacaaaattaattatgtgcttatgtatcagcaaccaacaattagaaaatgtaattataaaaaagacagatacagagaaagatcaatgaaaccaaaagctatttccttgaaaagatcattaaaattgggccgggcgcggtggctcatgcctgtaatygcagcactttaggaggccgaggcaggcacatcacaaggtcaggagatggataccatcctggctaacacggtgaaaccccgtctctactaaaaatacaaaaaattagctgggcgaggtggcgggcgcctgtagtcccagctactcaggaggctgaggcaggagaatggtgtgaacctgggaggcggagcttgcagtgagccaagatcgcaccactgcactccagcctgggtgacacagcaagactctgtttcaaaaaaaaaaaaatcattaacattgataaaccctagctagactgatcaggaaaaaaagagagaaattagcaagatcaaaatagaaaaggagatcctacctcgtgtttacagtggagtcctttaaacattaaagatcctgccagtacttaaaggacaagagaacacctatgagcaattttaggccaatgtatctgacaacttaggggaaatggataccctgaaagacaaattaccagaactgacacaagaataatagaaaacatatacagccttatatctgttacacttaatttgtaattaaaaaccttcctcagaacagctgtgtcagattgcttcacggatgaattctaccaaatgtttaagaaaggaatgataccaactttgtacaacctcttttagaaagagctacatattttttagaaaatctaggagggaagaacacttctcatttgataccaaactcaattgatacccaacttatttgataacttctcaactcaccttgataccaaaaccagacacagacactacaaaatttgaagttacagactggtatctctcaagaacatagacacaacaatccaaacaaaatattactaagtcaagctcagtactatataaaagaatgatacagtcatgaccaagtgggatttttctcaaggacacaggttggtctaacttttaatgtcaatcaatgtacttcatcatattaggagatgaaagagaaaactatatatctcaatagatgcaggaaattatttgacaaattcaactggtatttaaaattcttagtcaactaagagtagaagataatttcctcaacctgataaaggacatccattaaaaacctcagctaccagtgtactcagtggtgaaagactccacctggaatccgtacaaggcaaggtgtccattcagtacgtattcccagcattttcctggaggccctagacagtgccagatgacaagaaaaggaaataaaaggaaggaaaggaagaaagaattagagatcacatgattgtatgcatagaaaatcctaaggaaattctacaaaagaagctatagaactaacaagtgaattcaactagatcccaggatacagggtcagtatatagaacctgttgtagcagtgaacactttgaaatgaaagtgttacattaatagcatcaaaaacatgataaatttttaaatgcgtaaaaggaactataaacataaatgtaaaagctaaaactataaactttttttttttttttgagacagaatctcactcttgcccaggctggagtgcagtggcacaatctcggctcactgcaacctccgcctccctggttcaagcgattctcctgcctcagtctcccaagtagctgggattacaggcactcaccaccatacccagctaatttttgtattcctaatagagacggggtttcaccatgttggccaggctggtcttgaactcctgacctctggtgatccacccgccttgggctcccaaagtgctggattacaggcgcgagccaccatgcccgtccctaactataaacttctaaaagaaagaaatacaaaagcatatgagaaaatattcatgagagctggaatacaatggttttgtacttggaaaaatattatattggttctctatttttcatacactggaattaaatccaggtggattaaagacctaaatgtttctttaaaaaaaaactatacagggccgggcacatggctcatgcctataatcccagcactttgggaggccaagacaggagttttgtttgagcccagcctgtgcagcatagagagacccccaactctacaaaaataaactaaaattaaccaggcgtagtggcatgcacctgtagtcccagctactcargaggctagggtgggaagatcacttgaaaccggagttcaaagctgcagtgaactgtgattgcaccgctgcattccagcttgggggacagggtgagaccctgtctcaaaaaaaaacaaccaaaaaaaactatataattttgtgtggaaaatataggtaaatatatttttgactttggggtagtgaaagactccttaagccacaaaaagaatttaaaaagaaatgatgaacatacttgaccatatgaaaattagaacctaaatccataaaccttaagaaagtgaaatctaaactacaaactgggagaagagataaatagtctcaagactacatgaagaactctgataaatcaatgagaaaacaacctaataggaaaatagaaaaaaaaacatgcataggcatttcatggaagaagagatacaaaaggccaacaaacataaaaagaaatattctatttcattagtaatcagggaaatgcaaatcaaaagtgcaatgaggtacattcagctggtaaattttcagaagtctgaaaagcctataccggtgagaatgtggatcaacaagatttcttatgcattgctggcaagagtataaattgctagaagcactttgaaaacaatgtggcactctgcctgttgagcaatctgcccactgttgctcatttacgtcaactgtgttccagcaattgcacttctgggtataaacctaagaaaaacttcacgtctgcaccaggagatgggaaagaatatacacagcaacattttttgtaaaagcaaaaagtctaggctgggcgtagactcatgcctgtaatcccagcactttgggaggctgaggcaggcggatcacgaagtcaggagttcgagaccagcctggccaacatagtgaaaccccatctctactaaaaatacaaaaattagtcgggcatggtggtgggcgcctttagtcccagctactcgggaggcggaggttgtggtgagccaagatcatgccactgcactccagcctgggcaacgagcgaaactccatccccccaaaaaaaaaaaaagaaaaaaagaaaacaaaaaaaggaaaaagtctagaaccaacccaaagacccagccagtgagaatgggtgaagtatgatataaccacactgtgtaatgttattcagcagtgaaaatctatgaaccacagtgacctacagtgtggagttctcttcttcatataatgctgagagaagacaatatatatcatgatgtactatgaataaagttcataaacaacaaaaacattcactattgtttaggcaatttataaaatttttaagctaattttaattacatattttactgccagaaaacctagtttttaaagacaaggaaattataaacccagagattcttatcgcaagggaagagaagggtacacggtcggatgagcccattcagcattctggctgccggggtggctgctagtcccagatgtcactaagtcattaccatttatttactttttaagcatgaaattaaactttaaaaaaataaatatttaaattcaggagcacaactcccgcttgaaaagaaagctgtggtgaatcatttaaaaccaagatttgtcccagatggactggtttcacaggtgactattatacattgaaatggcaagatgggacatgagacattttctgtcaaacccctgaggcctttgtcctgtcggcctgaaccactggaattaagtcccacagcgtcttctgggagccctggggtggtttcragcccgccctgctgcttcacagacacagccaggcactgagccccaggcccactgccctgccccgactccaaggatatccagccctggtctctggcctttccaaccactgatgatgtatcatcgaattctgtctggcccctcaggactagtttatgtgcatcttaatttggcttaatcgtggccacattgctttattcttgggctctctcctctcagaaatcgatgagtgccggtctcagccgtgcctgcatgggggctcttgtcaggaccgygttgctgggtacctgtgcctctgcagcacaggctatgagggcgcccactgtgagctgggtaagaggggccctggccccgctggggtgacagctgcagcacactggccatgtgcctgaggcactgggtcccccggacaggtctctgtctggatggccagggtggccactgcatgctttctcgggcccctgccagctctgacatccaagacaaagattttacaaatatcccttcctgcacctccccaggggagactgagagcccagctgagaaatgctggcctggcttcagggcgcasagaaggtgggcgtcggagagggcaggtcacagtctctgacacctggtsggtgcttccagccagtggagggaggggaggcctgccccatgagccctgcacactcttgtacctcgctagggctctaagcctgagaaacgcagggtccagggagggcaaggcccagggagccgtgcccagtcgtggccctggggagcctcccattgcggagtggcctggaggaaggcatggcctggaggtggggctttgccagcaggcagtggaggtggcaygcctcccgaggaggggtgggtttggggctgatggaagaaaaagcacatgtcctgagtagttgctcccagctgggaaaggggtaactgaagccccaggaaatgcacggaatcctgggggcatgtgggcgcctcagacttgagccagcaacacccttgacaccccttctctgtgcagagagggatgagtgccgagctcacccgtgcagaaatggagggtcctgcaggaacctcccaggggcctatgtctgccggtgccctgcaggcttcgttggagtccactgtgagacaggtaggggctccctccagtgggccccacatgcagagcctgggcctctggaagatcagagaggaggtggggcatccccacattccctgctgggcaggccacctggggagagggacccccagggctgcggccaccttgggagggaggggtggaggtgagggtgctggggagggctgaggggcgggacctgcccactgcccctctctcctggcctccgcccctagactcctcctttcccttcttcccgctgtcctctcctccctcccccagactccccccttgcagcttgggcccactctctgggtgttctccagaggtggacgcctgcgactccagcccctgccagcatggaggccggtgtgagagcggcggcggggcctacctgtgcgtctgcccagagagcttcttcggctaccactgcgagacaggtagggcggcaggccygcctgctccccgccctctgcccgcctgctccccgccctctgcccgcctgctgcccgccctctgcccgcctgctccccgccctctgcccgcctgctccccgccctctgcccgccgccttggaagtccccttctcaggccagtggccctccgcctgtctcccttggtcccacaatggtgccttctaaacctccccatctcctgcgctcaccccccagacacccctcttcacccgaggacacacccaggggtggggcctcacgtccacacataggccctgctgcccttggacaggccaagtttcttgcacacccaggtctggcccctggctgtccttccatctggaacattctccctaatcagcccccagtgggatacctcctgatgaggcttccctgaccactgacctcccctcctcaagcaggactgtcactggggtggtggcctgtcctgtcctgatccagtgtctcctcccctcagccagtccggctggtggcactccgctgtggagggtggaggagctgctgggttgggccccgcagggcagtggaggtggcagaaccgaagggaggcagtagctgtcctgtgccccccgcccctccacacccacgcaggagggacccagtgccccaggagcaagggcsgggctggagcagggacccctggccacgccccaacatacactgccactttttctcccctcagtgagtgacccctgcttctccagcccctgtgggggccgtggctattgcctggccagcaacggctcccacagctgcacctgcaaagtgggctacacgggcgaggactgcgccaaaggtgggtggcgagggcgcctccagtgagggagccacgagggggtcccctctccctagagggcccaacggtctccaagggcagagcgtctggccgctgcttgcccaggccccttccctgaggaacagggaggggataaaatcccccggtgggcttgaaacacggtcacacattcaaaagtgtgaccctcctggaggtaygtggccagggacaaagaaggactctgccagcgatggctgtgtcaggcccaagagccagacccrgctgagccgccgacgggagccaggcatgcatagctaacggctgaccagtcccctccccttgttttgacccaaaccctgaagagctcttcccaccgacggccctcaagatggagagagtggaggagagtggggtctctatctcctggaacccgcccaatggtccagccgccaggcagatgcttgatggctacgcggtcacctacgtctcctccgacggctcctaccgccgcacrgactttgtggacaggacccgctcctcgcaccagctccaggccctggcggccggcagggcctacaacatctccgtcttctcagtgaagcgaaacagtaacaacaagaatgacatcagcaggcctgccgtgctgctggcccgcacgcgtgagtgtccccgagcctggccgtccctgcccagcccctgcccctcgagggcagcgctggccccggcacctgcagggcggctgtcatgccgtccaccctcctagttcttgcagcagcaagacagacagctgagctgggggttggaggcaccgccctgctggagacagagctgtgtgggagtggccttgggtccacaagatacaggcatgggattggggcgcatagaatcgagccaagagtgggagcagcacaacccccaggcatggagctaggaagtgggactggggaggaatggggscttcccaaaagggtccctagaaggagccagtgtgggagacaggggccgcgggggtgggcttgggggggctgggactctggggtgctctgaaggcctggggagagtttgaaagaggcacctgctcacagggatatgtaggcgctgaggtgtgctaaggggaggcatcggtggctcaatcgggaagagccgtggggcaggccctagatggaatgacagacccagagcctccacctggagctggcactgaaagctgtgaccagatgtgacccctgaagagggggtcctaggaggagcctcctcagagcctgagccaccaagattgcaggggaggcccgggttgtgcacagcctgtggggttgttgccgtgtcggggagcagaagatgctgagcgctctagggaaggcgtcagggcttagcgggcttgtgtgctgctgggagggattctgggaaggagaaaggagccctagaacatggcagtggacggacaggggcagggccggaagaaagcagagggctggccttccacggagcccggccgcatcagctagagcacaggggatctcggaacaggctgggcaggaaccaagtggggtgcagggccatggggccatgggactctcacccaacatgcctgtggcctccagacacaggagcaagaatggggaaggggtgctagaggctcgaggaaagaggaaaaggtgctgagagcacagactgctgcgaagtggcgtgatggatggrtgggtgggtgggtggccagggcttcagggaggcctaagcatccagcagggccctgcggggcggccacgtgagtttggtgaaacctatgggtagcatggcgggtaggtggggaggagctcggcggttctcacaggaggaaagcctcctggccacacctgggccctagcttgatgccaatgccaagggcattgagggacaggagaaggcattcaaggcagcttgagcccacccagaggcccacaagggcctgtcctgcaggagttgaccaccaaggggctggagttcccaacacagcaaggacacagagcacacctcggccagtggagagcctgggcgcatgtgcgggtggcactgagcaggtgtcagcaggagctgccaggggctgagtaggggtggctcgcctgggctgttttaggaagaagcacctgcaaggccgccccatgtgagatctgccctcggaaggtatctggagtgaagacagagcccgccctgcccgctgcagagttggggctccagccagccatggtgggtggaagggaccgctgtccacagaccggggtgctgagttgccgggagctgagcgctgccctctgggctctgcctggtgcatcagcagtggcactggagcttcggaggagactggctgggcgggaagcggagctcacaagtggccccttccctgcagtygctgggagttctgtatgtctgtcctcctaagacagcgttgcccagaccaggcccggatgtgtgctcttagaccaaaatagtcaactggcacagaaaaggggaggtccgggttactcatgtccagagggactccggcccatcccctgccatgtcactgccacatctaaatggagactaagacccctgcctctggtaagacgggctggcccacagcgggctctgcagccgtcatgctcacagcgggttctgcagctgtcagccctggaggccagagcctgggcatcccactcagcccgagttccctgagcagttgatgggacaccctctccagtgcctctctgtggcccccagcaccctcccaagcctggtttcatcttgagcccctgcactcccccaggagcaaggaggggccggcacctgctgaacagtccattccccctaggaccccgccctgtggaaggcttcgaggtcaccaatgtgacggctagcaccatctcagtgcagtgggccctgcacaggatccgccatgccaccgtcagtggggtccgtgtgtccatccgccaccctgaggccctcagggaccaggccaccgatgtggacaggagtgtggacaggttcacctttaggtaagaagggacacccagagcatggggctggggtgaaggcaggggtgggggctcggggacacggggcccaggtctcgggcacattctccgtgtgtggactgtaccacctgccgctcctcacctgagcggagacaaaggtctcaggtgagccagcctcagaccctggaggcttcactcccgcctcacctcatcagggctgccaagagaggatacaccttggtagtgttttaaagtgtccaaaaagagcaggaaaagctcagaaaatccgggggcacactttccacacagatcatgagagtgacttggcccctcagagagcagcrgccagcgagggtagatggtagcagccccgagctctcccagkagtcccacagtggacccctcagagagcagcggccagcgagggtagatggtagcagccccgagctctcccaggagtcccacagtggacccctgtgatttggtcgccaaccaaaragaaagcttccgaatcgtgctcagcgcaggcaggggtgcaggaaaagatcggagagcgagtgggaaggaagactccagccagcagcttccwggggctggggtggcattggcctcacgttgtcctgtggtttcctgagaatttacatcaactcacctgtgctgagggcccrtcccccatccctgcacagtgaccacttcccccttctctggcctctcccagctgaacaccggccctctgaccatactgtagcagccccaagcgcacccgatcctcctccgctgcccggactatgggttggcttcccgccctaggagcacacggctctgagggccatgagtctgcccctcgtggaggttgcctgggccaccagcagcaggatgacctccccgcagtcacctcctgcctgggggagctgcggtctggcagcagagtcacacacaggtcccagacatccctgttctctctttgtcacctcctgcccacagggccctgctgcctgggaagaggtacaccatccagctgaccaccctcagtgggctcaggggagaggagcaccccacagagagcctggccaccgcgccgacgcacgtgtggacccgtgagtagagcagcgcggcccccggcacacgaaaggccgtcttctagaagctctggcttccttccagcctcccctagtcctctccaaagcgtccacaacaccagaaacccagcccctggcctcccagatgtctcttccgctggggccactgggcaggagccgctgggctgggctgggcccttgtgctgggacagctgtccagggcagtctccatctctaaaggctcctggtagctcctcagcatggagttcctactggacaccgaccagagggccagaggacctcactgggccagggatacccatgctatccagggcccttgtaccttgcaaccagccccctctagctaagctccctaagttcctggtgtcactaggcccacaccccctccccagtgcatgggaggggtgacagcatggacagtcagcgcgcaggggagggacaggtgaactgggcagaggggaggctgcagctccctctgtgaggaacagaggcttaagcagacccctgcccacctgtgcactcagatgctgcccgcctggcatgggaaaggctggtggggcaggggagtctgcacagggctccacgcagccaggctcaggggaaccgactgtgccgcagggagggcgccagctgacgggccagggcctgggggcttcacagggtggatcctaacccgaggggagggtggcaaccaggggcctgcaggtctctcggttggaagattgtgctgtacgtgccagcccacaccccgcctcggcactgtaccattctccataataaagaatctggcttccagcaaggctgcrgcagcccatgtcsggttctcaaaccktgttcttgccagaagaccctgtgggcaccccctcacctctccctgctcctgcctcatccagggcccctgcctccagcaaacctgaccgccgcccgagtcactgccacctctgcccacgtggtctgggatgccccgactccaggcagcttgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctgtgagtgccgtgggccctgcgcgtgggcggggccagtgtttgccagccctccaccctgttcaggactgacctggccctgcaggggcctgggatgccaggcagacagcctagaaacaggaccgtgttagcaggggaggagtctgtgtatgaaagtggaggcttttcaaacccacaaggaaaggaaggactcatgggcaggtggcaccaacaactggaataataagcacattgagcctcagtttgtgccggaccctcccgtagatcccagacaggccgagcatcacctgaaaacgggtgccgagggtggcagcgaggaggaagcccccggaagtggcctgcattgcagcccaggcctgacccacgaagagccactggacacagacagacaaagggccaggaggccacaggcaggggcctgcaaggcaggcaggaatgctggggagcagaggcacagggcagaagccgctcggagtggggacagatgctccgaagggctcaggtctgctcccaagtgcaggggtggcccttccaggctccaccagggtcccgaacgccccacttaggtcttccaagttcacagaaggagcagtgggaaaatgcaggagcagaacagggagagaagaaagagacggagacaagcagggaggagaggccacggcgggacagagcagagcagtgygcggctccccagggaagagagggctctgaccccaggctcctccccaacccgtgaggctgtgctggggacacgaagtgcataagcttgccgagttctcagacccaaccctgccacccccaccagcttggggccaagcccaccagccaggcagaaggggcaggctgggacctctgtgagccggcgtcagagtgagagggagagggaaggggaaggagggcccagcctgggaggctgaaggacgctgttagggtgacagatgcaccctcactctcagggcacatgctggggtggggactcccagctgaagcgtcccatcaggaggccactggggagaagcactgtgtctccagggcagcctgggacctgagtcygagcccgagtgcccagccccttgagaacttgagtgacgggcaggggcctagactcagccctgcctcatgactcccaggccagtgcacgcctgtgtcatggctgcgcatggctcctcctcagaagggatgcggcgggtrggctggaagggaacccagggcatctggggaagccacaagcaccttggatgaccacggcccacgcacatgccccccttcccttctccaagcacggctgagtgtgaggggcaccacccatgccacaggggcagggacaggagcagagggcagccccagaccagccccttcctcctgcctgctctgcagcccccagggatggcgctgacagacgctggcaccagggaggacaccaccctcgggtgctcaagaacagaccgcccccggcgcgcctgccggagctgcgcctgctcaatgaccacagcgcccccgagacccccacccagccccccaggtacatgccccacccgtcggccccatcgcccgaggcggcgctcggactgtggtgaccctcccaccctctctgcaggttctcggagcttgtggacggcagaggaagagtgagcgccaggttcggtggctcacccagcaaagcagccaccgtgagatcacgtgagtgccagggcctccccacccaccttggtggccmaccctcgtcctcactgccactctcaccaggtcctgtcccctacatgatgagcccacccccaccgccagcgcagtctccagccagtgacccccaccccgactgtgcacaaggcgcggggctcgtgggccgccggcagcatgcacctccatggcaggaggggcagctcgtgagggcctcacgtcagtgtgtgggctggaggcgcaggctgctggtagggcacgcaagagaagataaacattttagaagcaggtctgagacattacagcagctttatttgccaaagtagggctctgagctttgttttagtaaaccatgggcaggaggccatgagggtctaacccgccactccgagtgtggtccggcaaatcctccgccactgtcctggcaagatcttcccggtggcagcaaggctgatgggcccargtgccttgggcccttcccaccgggtttactgggtgagtgccgctctgggaatctgcctgtgattctgacacagaagccctgagacatgttggcaggagtgaggcaggcrcgaccctgccccagaggggacctctctggcccttgcctctcacctggaaggccaggtggtcatcctcatggaactccccaacagagcctagtcaccagtttaatgaacacgctctgagcaaaaactcctcaggcagaggagggagggaaatgcagcaaggagagtggcaagcagggaccagagccctggggtccctgccgcacggtgagcaggggagagagcccccagcaaggtgtctgaggagagggcaggcagctgcccgggatgcccagtggtgggcaggtgagatctggagtacagaggggggcccgttgtacttgcagctatggaagcggatatgaagtgcccgagggtgcggttgagatccctgcataagaagtgatgcagttgggggcgagggcatgaggaaggtcagtacagactgagggcagctcagaaagagcagggggtgccacagcctccaagaagcaggggtggaaggagaggaatgcagaatttgaccctaagaagaaagcaaccgcatcagccgtgaggatggggcctctcagcatgatcagtggtggctgtccctgaagcagctctgagggggccctgcaaggggaaggccgagcccctccagagggtcagcaggagggtgaggccagcccttcaggggaggcagctctggggccgacaggtgctggggccacgcagggagcctggtccccaccagggacatccgtgctccctgagatatagaagcactcaaaagggtggccccaggaccatcccgggtgcaaagcagctgcgccgtgtggtcaccgcctggcttctcctagaacccacagcctcggcgcagctcgagaacatggaggaagcccccaagcrggtcagcctggccctccagctccctgaacrcggcagcaaggacatcggaagtragtcagcagcgctggtggggactttgggactgactgactgctctcaggggccttagaggctgcaggcaggagggaccacccacggtgaggaatcaggaggcacagagcctacctgaggggaggctgagcaccaggcaccccggtgtgggaagatggggtgaagctacaccacccaagcagtgggaccccacagacgggaacaggccagggggcaggacccacccaaaccacccagagtctgagctagagagactggctttgatgctgcctcccctcccctctcctccttcgcctccacatgcagcagagcccaccccagcccctgcctctgggcccctcacccctcacttctccaaagaggagcaggcggagtcaggatgggagaagcagagggagcagccactgggcgagccccagcttgaggactagctgggccctgtggacactcaggttatgcaggacctgaactgtctcctagtccggggctctgcctcgtgaggatcgaggccagcacgtccctgcagggcaccaagcatctgctgagcacctgcagtaagagttcccagacgctcacgaggcagttccccttcgggcagcaccaatayatgtgtgttcctcaccctgagtcagactctacctttctcctggttctaatcctttggggctgtgtcctctatggacagctctcctagcacccggtgayctgttctcccctgagtcataccatagactcagattgggatcacccctcaacccaaccccaaagaagtcctagtacttggtaaaggtgtgagctgctgagcgtggtctcacccgcaaggccttgcccccagcttctcaaggacrtgtgtacacatcaagggcacctgcggtggggtgtgtttgcaagtggcggtttcgctgaaccctaagttcaccatcccccccccgccctcaccatacaaggtctggacttgctgctagcccctgtgagcaccaggaggactggtttgtgcatccgacgcagagagtgaaggattctcttaattcaggtgtggcccattcagagtgaagactctcgtgttgatctttaagtgaactaaaacaaacatttcatcagatgatttgcattatgtcagcccctttaaataccaggtgttcatttcctagaactcagagattggaggggcgtgtgttaccctcctgggtctcttcagcaggagagattcaagatgacccccgggctggccctgaggtcaccacggtcatgtggtgtttgccagcacgagatgctcatgccctggtgggtgcaaaatgattttaagtgataacatgaaaagtagactctttaatggcccctcgatgcgcaaagccagtcatgatctttggttcatgttgcactctcacgctagctaccttttatttagttattagcctttgaataatgactaaatcaagaacccaacctataaacttggatgtgaacgataccttctatcttgccatcatactccctgttctctcccctcagttaaccatgatcctgaactttgtgcctagaattcctttgttttttcagagtggaaggtgcggggagtgattytatggtacatatatgtatggcagaacaataagtgagttttctttgcaagataattatcttgccatgtgtgatcgttagacctgtgttttcactccgcattctcggactgaggttggcccatgcggtctgggcggctgcggcttattcacacctactattgagcacagagtccactgagtgaactgaccggctcttctcccctctctgtgcagagaacatgtaggttgtgtttggtatgagcagtgctgcagtggatgttcctgtacaggttttccagtacgtgtgcgggagtggaaaagctggatctaggatgaggatgtgtgaatgcccaaattacatgagaactaagtcattttctaagaggcgatagcagtctgcgctccctccagcagtgatgaagacatgcagtgaatccagtctctctagaactaggttttgccgggtttgcagatcctacaggcagaacgggtgggatgcacacccctgggatctgggtttgcatctcctgggcactgatgtgactgcgcctctcctcatgggcatccaccaaaggtgtttgcttctgtgaaatgcctgatcacgccttttgactttatgttgggttatttgtactctttttattcatttgtcaaaattcttatatgttttgatactgatcctttgtcaggtctgtgttctgcaggtatcttcctccagcctctggcttgtccttccctgttcttggtggtacttcctaatagagaaaagttcataatcaaatttatcaagcattagtggttaacaagttgggagccttctttaaaaaatatccttccccacaccaaagttagaaagttattcatgtatatttttttcacaaagatgtaaagttttgcttttgacctgtaggtcattaatctgttagactgtgtgtgtgtgagaagttgggctacaatttcattttttatgcatatgggtaaactggatttttcatctcttcatgctaaaaagtccctttttcccccactgtcagtatcaaaattccacatataaaagtagaattctggcgrcgtcaatttgatacatctgtgccaatactgccctgtgttcactctaactttgtaagtcctggaactgattggcaaagttcctttcctttactcttcatcttcagaagtatcattgctacccttggccttttttcttccacatatacaccttcaaatctagtcacactctatggaaaaggcctttgagataatgatgactgggtgtgcattcaatccattgaccatttttgtgaaaattgacatctttaggatagtaagtctatatccatggacatgggatgtctctccatatatgacattatgacttatttaatatctttcagtaaagttttatatggaattcagacttattcctaggtattttatagtttgatactattatatagtttgatactagtatatactttaaaagttacttttcctgattatttattactggagtatagatatttatttgacctttgcatactgaccttatagccaaccatcttgccaaactctcctattcttgtcatacattctttggggttttctatatatatataaaatcatatccttttaaagattaattgtttgccttttaaaactcagacctgctcacacctgtaatcccagcactttgggaggcctaggcaggtgaatcacttgaggccaggaaggagttcaagactagcctggccaacatggtgaaacctgttggtgtggtaatgggttaaggataggcatttagatcagtggaaaagaactgagagtccagggccgggcgcgggggctcacgcctgtaatccgtggaaaagaactgagagtccagggccgggcgcagtggctcaggcctgtaatcccagcactttgggaggccgaggcgggcggatcaccaggtcaggagatcgagaccatggtgaaaccccgtctctactaaaaatacaaaaaattagctgggcatggtggcgggcgcctgtggtcccagctactccggaggctgaggcaggagaatggcgtgaacccgggaggtggagcttgcagtgagctgagattgcgccactgcactccagcctgggcgacagagcgagactccgtctcaaaaaaaaaaaaaaagaattgagagtctggaaataaaccacacgtcaatggccaactgacttctacaagggggctgaaacyattcaatgtggaaagaatagtctcagcaaatggtgctgggacagctggatatccacatgcaaaaagaatgaggccggagccctcgtaccatatacctcataacacaaattaccacaaattgaccaacaacctaaatgttaggagctaaaaccaaaactcttagaagaaaacataggagtaaatcttcatgaccttcgatcatgagggtccttaggctcaacaataaaagtatgagcaacaacaaaaatctatatataaactactcttcatcaaaacttaaaacttctgtgcctcaaaggatgccatcaaggaagtgacatgacaacctgtggagtggaggaaacatgcaaatcatacctgatcagagacccgcgtctaaaataaagagctctgacaactgaacaataaaaagacaaacaacccagttcagacatgggcaaatcatacctgatcagagacccatatctaaaataaagagctctgacaactaaacaataaaaagacaacccaattcagacaggggcaaaggacctaaaaagacatttctgcaaggaagatatgcaaatggccagtaatcacaccgaaaagatccttgacatcattagtcagcagggaaatgcacatcaaaaccactaggatggcgggaattaaaaagtcagataataataagcattggtgaggacgtggagagatcagaaccctctacgctgctggtgggactgtaaagtggtacagctgctctggaaaacagtctggcagttccttaaaggattaaaccaatagttaccgcatgacccagtaattgcactcctaggtatatacccaagagaaatgaaaacctatgtccacatgaggtcctgtacacaaatatttatagcagcacagcacaaaagccagaaagtagaaaccaccaaagtgtcaatcaactaacgaaaggaaaagtggccgggcgcggtggctcacgcctgtaatcccagcactttgggaggccgaggcgggcagatcaccaggtcaggcgttcgagacaagtctggccaacgcggtgaaaccccgtctctactaaaaatacaaaaattagctgggcgtggtggcgggcgcctgtagtcccagctcctcaggaggctgaggcaggagaatcgcttgaacccgggaggtggagtttgcagtgaggtgagatcgcgccactgcactgcagcctgggagacagaactagactccgtctcaaaaaaaaaaaaaaagaaagaaagaaaagaaaggataagcaaaacatggtatatccactcaatggaacacgattcaaccataaaacaaggacgcatgctgcatgctacaacatggatgaatcttgaaaacatgctaagtggaagaagccagacacagaagactctatgtactatgattccattcatatgaaagtccagcagagggagctctctagtgacagaaagtacattagcggttgctcaggactggagggtggaggggatggggaaggcagtaacagctaaaaggtacaaggtttctttctgaggtcacgaaaatgttctaaaattgtgctgatggatgcctgtatctgtgaatatgcttaaaaccaataaattgtacactttgggtgaattttatgttatatgaattatctcaataatgcctgctttaaaaaagttatgtgcaggccaggcacggtggctcatgcctgtaatcccagcactttgggaggctgaggcaggtggatcacttgaggtcaggagttcgagaccagcctggccaacatagggaaaccctgtctctactaaaaatacaaaaattagccaggcatggtggcacacgcctataatcccagctattcaggaggctgaggcagaagaattgcttgaacccaggaggcggaggctgcagcgagccgagatcgcaccattgcactccagcctgggtgacagggtaagactccatctcaaaaaaaaaaaaaaaaaggccgggcgcggtggctcacatctgtaatcccagcactttgggaggccgaggcaggtggatcacaagttcaggagatcgagaccatcctggctaacatggtgaaaccccatctctactaaaaatacaaaaaattagccgggcgcagtggcaggcgcctgtagtcccagctactcaggaggctgaggcaggagaatggcatgaacccaggaggcggagcttgcagtgagccaagatcgccccactgcactccagcctgggcgacagagtgagactccatctcaaaaaaaaaaaaaaaaagtaacgtgcagaacagtgttttcagtatgttgtcttttgtgtaggaaaatggagaagggaaatacaaattttgtcctcattttaataaagaaatgaaactaataagatggttcactaaatgaggagggaaagaactgcataatgggactggagatcggcgaggcttctctgaatgaaccttgttttacagttttgactttagaaccaaaaaaaaggttttaaaaacaataaaaagaaaaggcaacacctaaaaattgaaaacatactgaaataagtaaacctagttatcatgtggatggcataaccacacaggaaaaaaatatcattgcaagcgattttaataagagtagtctgttcacccctaatggaatatggtctaaggataaaaagcatcgccaaggaatgttaggctatactcagtgatcttaatgttagtagtaatacctgaattgttattttgaaatgattgcatgtatatggtaggataaagaaaataattgttaacgccaccaagattttcagtgtaaagaattaaaaatataaaatgaaagaagttaaaaatcttgtttgttttggctgggcgcagtggctcacacctgtaatcccagcactttgggaggctgaaacgggcagttgacttgaggtcaggagtttgaatccagcctggacaacatggtgaaaccccgtctctactaaaatacaaaaattagccaggcatggtggtgcgcgcctgtagtaccagctactcgggaggctgaggtgggagaatcacttgaacccaggaggcagaggttacagtgagctgagatcgcgacactgcactccagcctgggcaacagagcaagactccatctcaaaataaataaataaaatcttgtttgtcttttgattctgttaatttgaaatggaaatattagtatgaactcataatgtgtttattttttaaagaagcctaattttctagttctgttcattgaaaggcctgaagctgtgacatcccataatagggagcggtgtgagtgccaggctgtgggctctagatctcgttctcaccaagaagccagtgatctttggagaaatgggtgattccaagactgaagcaggatgtggacaaaataagcccaggacatgttgtgtaaaaagcaagcaagctttcaaaacagcagaccatgtcctgagggcggggagccaacctgaagggctcccgctgtccaaagacagaataaattgagcatcaggaaaacaactgacagcaatggacggaagcccatgaaatataccaatatctctgtgttcatcgtgatgctcagaaagaagaagcaacctagtgggcaactttggagcttgctgaggaccaactcggtctgcaggcacacaagcaaaggagcagggtggagccttcacgctgccgtgcctgtgtggaccagtccagggtgaccacggggtaggtgagggaaagcctgtcttcacagaccactctccagctggtgagggcaggagcgacagggwcagacacaggtctgtgagaggacagcccttggatcagggatctcgatgtcttgctcgagccatcaggtgcaaggcccgtggggacttttttctgggttggtcaggctgccagcactggaccagtgaccagtcctcgtgtcactcgagtgggacttggacacatcacaggcygcctgggctggctgggggtgcacacgcatccctgggcagcagccctgcaaagaccatctgaacctaaatcctatcaagcacctctctctagtgagagttcacaggaaacacaggggtgggatcaagtgagcagtaagtcacatccattagagcaccaggagggacctcaggatccaagcagcagaaaccgtgttcaggggcaaagccagcaagggtcggggtggggaggggccacaggccagtgggggctcagcactgaaggccccgctcctccctccctctccctcctcctyctcctcctccttgtttttgtttgtcttccttccttccagtaatgaggtcagggccgagcacactgcggcctgtctcctcacctctgctctctctcaacacctgaactgggaccacgctctagggcccagaggcgtttgggaggccacygcagcacaccacagaggagtgcacggccaccctgcatcaggtcatcaaggaagggacagcaacatgtccatgaggcaggcctgtcctggggttccagtgactaacctctcgtgacctctgtttccagacgtccctggcaactgttcagaaaacccctgtcagaacggaggcacttgtgtgccgggcgcagacgcccacagctgtgactgcgggccagggttcaaaggcagacgctgcgagctcggtaagtcrgggcttggcctcagggcgccccttccaacacagcctgtgcctcagcctaggactgctgggccacagctgggtttgccacgggagcctccaaacgatgaggtgccagacagggagtctggtgcacggggctgacccctgagcccccaggggctgcgctgctgccccaagcaccaggatgagaggtgctgcccatcacgggggtcagaacagccacagcatgcgaggcacagcttcggagggctccctgacccagccagagcggtgtcaggagaagggactctccacccccacaataccaacccaccccggccttagaggaagccagctgcagacccccrggccctctcccaccatcccgccttggaggaagccagcctaaggacccccgggccctctcccttgggcaaggcctctcaagaggggcaggaggagccgtcaggagcacctggtgagccactgcccttctttgtcgcagcctgtataaaggtgtcccgcccctgcacaaggctgttctccgagacaaagkcctttccagtctgggagggaggcgtctgtcaccacgtgtaagttggyttctgtcctccgccttaccgcatttgtcgtgtgttcttgactcctcaaagtgctgtctcaaagctacccagctaaccctgaggagggaygatggctgcagtcacagaagggacttgctttgaccatcgattccctccatgtcacaaattaggcagctgaggcagaaaaaccgaataactgccccaagtccatgcagctcaggagcaggggctgagaagaacgcaggctcctggtccccaggcccccagrccttccttcccacacatcagcccagtccccactggatggcagagccaactgatgtgaccttcctctcttctcytcctcagagccccctggaaaaacaaacagctcatgagaatgccggccccagttctgccattaactcatgatgtggccttaggccccccatctccaaaatgggctgtggagggagagatgcccagcccatctcttaggtcctttcttgctaacactctatgactctgtcggtcacacagtccatttagtcaacagatgacttactgagcacctgctgtgtgccgggcactgtccatttagtcaacagatgacttactgagyacctgctgtgtgccgggcactgttctagatactcagcacacatcagaacagagcagaccaaagccctgccttcaggacccgttcattgcagatgaggggacagacaacagacagcagtgagagtgtggtgtgtggtgtggcaggtggtgagtgcaaagggaaaaaggacgagatgacaggacgagaccaggagagcctgctggggatgggcagggctggtgcagcaagagggcagcctcctggggagggcgatgctgaacagacatggaggagggatggacattccagagccagaggacagttaccagggccccaagtcaggagtgtccctggcatgttgggggagaagtggagagtggtgagaggtgagggacagggaacccwcggggccatggagacccacagaaggactctggtgtttgtccggcatgaaatggggaggagctactgaagggttctgagcagaagagtgacatgttcgattacactactttggatgctctgtggagaatgggatgtagacrggcaagggtagaagcttcattagagcttggacatgaagccaggtgtaatatgtagcaggaacacatatgagatactaatctgtgttgggatttgggaagccgtgttgacagcccactgaattcggattctatgcagtgagagtccgaatccacagtatctgccatcttcccgctgtgcttagttacaccagtgcctgctggtgaccaccaagtatccaacaagaagacccttcacttcctgaaagcattctatcctttcacttttaacctatctgcatatttcaagtgactttctagtatttaacatagaggtgggtcttgctggatatctagtctgacagtctggtttttattggagtatttagaccatttactaccttccacataatggctgatgtggttggatttaaactgccatattactatttgttttctatttttcccacctgctttttgttccttttttcttttttcctgcctaattttggattactttttaggattccattttgtctccactatgggcttactggttatacttcttaggtttattgtttagaggttgctctgggatttgccatacacatcttcaccttaacacaatgtacccttaattactattgtacgagttcaatatgatggcagcgtctaggatttttttttttttttttttgagacaaagtctccctcttgtcccccaggctggagtgcgatggtgcgatcttggctcatcgcaacctctgcctcctgggttcaagcaattctcctgcctcagccccccgagtagctgggattacaggcgcctgccaccacaccctgctaatttttgtatttttagtagagacaaagtttacgtagagacagggtttcaccatgttggccaggctggtctcaaactcatgacctcaggtgatccacccaccttgccctcccaaagtgctgggattacaggcgtgagtgactgtgcccggccagcagtgtctaggatttaccatacacatcttcaacttcacgccgcatacctttaatcactagtagacaacttcagtatccatggcagcggctgacatcaagcttccacttccctcccatcctttgaattattatcagactttttccttccacatatgctgtgaactgcactatacgttatttttgcactcaaaaattatcttgttttagatattgaaagtaaagtattttgtatttattgtacatctgcctgccgactccagcactcttcattcctttttgtagatctaggattccatctggtatcatttctctttgccataagaacttaactctaacatctcctatagcacaggtctgcaggagatgaattctctctgcttttgtctgaaactatttttttttcaccttcatttttgaagaatatatttgctgaatatagacttcttgattgacagttatatttttttctttcatgacttaaaagttgtcatggctttgtcttctggcttgcatagttccagacaagaagactgcagtcattcttacctgtgttacactgtatggaatgtgtcttcctgccccttttatgttttccctttatgactgtttttggacaatttaattatgatgtgcttctcggtatggctacgttttgattctctggagtttaagcttcttgtatttctgggttttaattttgtcaaacttcgtaaaatttttgccattatttcttcatatatttttcctgtccctccatttcttctacttctgggactccagttatgcgtgtattagactgatattgtcccacaggtcactgcagctcttctcaactttttcagtcttttcattttggacagattctattgctatgcactcaaggtcattgatcttttcttctgcagcatctaccattaatcctgttcaacaaaagttttattaatactgtgttttatcatctccagaagtttcatttagttgtttcttagatgctccaatttctatcttcattatctttatattttcctttagctcactgaacatgtggaacaaatttataatagatattttaaggtcctcatctgctatttctgtcatcactctcatgtctgggtcttattctatttgattatttttctctaggttatgggtcacttttttgattattcaaatgattcttgaatgtcttatagttttttattggatgctgggcattgtaagttttatgttactgacgctggatttgtttgtttgtttgttttcttttcaagaatgttttttctctgcaaggcattatctgagtatagtttgatccttctgaggcttgttttaggtggctttggagtagcctttattctggggttaattttgccctagttctatggcatggcctttctgcggtttcttttttttttttttttttttttttgagacagtgtcttgctctgtcgcccaggctggagtgcagtggagcgatctcagctcactacaacctccgccctcctgggttcaagctattctcctgcctcagactcccaagtagctgggattacaggcactcaccaccatgcccagctaatttttgtattttagtagagacagggtttcaccatgttggccaggctggcctcaaactcctgacctcaagtgatcggcccgccttggcctcccaaagtgctggtattacaggagtgagccaccgcacctggccctgtctggggtttctatggatggcctaataaacaagatctctctactctggctctggaaatcgttcaactcctcagtagttcttctttgccttgtggggattcaccctatgcatgcacagctttatttccaaccacaggcccaaggggaccctacacagattctggagttcctcctctgcatagttccctcctcttcagtactctgccccacaaattccagctgcctctgtctccccaacttcaatctctgtttcctcaactcagtgtgaccactgcttggatcccctttctctgtgatgccatccaaaaacttctctaggctgaattccaggctgaccacaggactcatctcatctgtttctcctctctcagggattacagtctcgtgttgtctgttttctaacatctgacatacagttacttactatattttgtccagttctctggttgttcacattgggaggttaattccagattctgttactctttcatgtccagaaatggaagtcttaccacaggttttcgatcctaaaggttctatgagacttagcatatgagttggagctttgcctgctgaactccttggatttcccttttaaacagctctgacatttgagaactttaacaaaagacaaaacgccttcccatccattattatctacaaacttgtaagagagatggtatgagtaggtcccatttttacctgcaaccgaggcttaaaacttgaagagacttgctcaaagtagcctggttaataaatggaagaggcaggagatgaaatcgggtctcctgttctacaatgcctacatccgaatcccgaatccccaacactcctcaaacttctctgtgaaatacccagaaaaacagaaaagcgaggccataccttccccaggcctccggccaggtggctgcctctagcactgacatgtctttgacatttcacattttatttttagtaccatatcctttgtcagtgctcatcagaatgcacattaaaatgggtttattttatgcatattactgtaccrcaataaatttattacaaatcacatgacctttatgttagacattttaatacatcaataggaggtcacgtttcattcagaaaatagcagtttttccctcaaacaccttcaggtttactgtgggttcacatagcctaggttaagcagttggcaacattttgcttcactgtctggttttacaaagctttcttgtgacaacaggtataaaagagtctaccgagttcaccaagacatctgcttcaaagagagctgtgaaagcacaagcctcaagaagaccccaaacaggtgcctctggggagcaggcccatgccgtgtcctgcatgtagcccacagggtgatggggcaagggcggggtgctatgggatgctgcaggcctgtgggctgagccaggcggtctactcgcccagataggcagcccctgggcagccacgttctgctacgaaactgtatgtccatatatgtgcatgtgagcatacccagaggggcacagccgggcatgctgggtgctggggggggtcactctggttatgcatattcacacagaacatggtgctacaattgggaagcacagggtgttacggacagccccgagtatttaatggccgatatagcgcgtcgctctttactttttattcactcacacccaggttctttccacaaagggttcaaggtagttacaagaattactactgtttggcgtttgctgaaagaagtacgtgagaatattatatgctttagaaaccacagagtcgaagcctgtcatcgtcctcatagaccaatgagtagccacacgtacttgtttggcattaccaagtgtccgggcaaggccgcagcctgcagctcaccagccgtgctgctcggcctgtgcacgtcaccggctcttccctagggtagcttttgcttgctttctcccacgtccrtcctctctctctctgactcacagccagccaggtttctagccttgtcattcctaaactactgcctcaagccaggcgggcgcacacaaactaaaatgctaatctccacagcggtgtctggactaatggtgtcccccaccgtggaatgtatgtgagctaaagacaggatctcagcaggcagcctggactgaggtagctgtagaattcaaggtacacagtctctttttcattaaacgacttttctctaattatttcaggaaacaaagtaagagtcagacactggagaaatcttaaggtacgtccctgctgctcccgccccactaccacagagctgctgggaagtggggggcgactgcccagccccgggatctcagagtgccgctgcctgcttactcagcactgcwaaaggaagcgcggtcctgtgctgctgtgttacagactcccgggcaggaaggttcagaagtccccaaggggaaacagacatgaacctggtctagccactgacaaatacaccttcaggtggaaatgaggctctctgtggatagggcaaatcccactctctctcaagggaaatgtggccaagaaacccctagatcagctgcagtgggaggaagaggcaggggggtgggcccttggagaggctggaagaccacctggcacctgggaggaggggccacgggcagcgggagggcctgggctgctgagaaattccgggggctccaggagagggctgagagagtgcctcccagatcttgtgaacggcattctgttggaactaaaagtggggcaggggccttgatcgcttaatatttagaaagtgttgaagaccgccgctagaaagtcgtcactgacactgggctcataggcattcataaatcctgacgtgaaaggaacttcctctcgcctttgtttaagccagcatttcccaaactcttttggcaaccaaaccccatcctgcccccacctccccacacaaactgccgaatcttaaacaacactggcattcttcacaatcgtttgcaagagactgggatataccatagaaagccatctacaacctgttaccagtttcatactgaccatcattttttatcaacatgtcactgcatgaaagatgaatctctggttggcctaggacagctttgctcttcctgccccttataggagccctcacagttcatcttcctggtggcgcagatgagtgaggcacccttgggtracaagccacttcaaaacaggyctatgttttgttacgtgcctaaaaaaataaaggagaaatgtcattcaggaacctttaaaaacaaacagaagcaaaacagcttttcagatataggctcacacacaccaaaggaagagtgtccacacccccttgggggaaaggtctgggccggagctccgcacatggcaggaacttgagctctgagttggccatgacagagtgcatgcatctgcctcttcggatgtggaaagtctctccataagagagtagccggcagcattcacttcctgttgactcgagggaatcacttcccgctcccacctcaccctccaaagacacacacactaagcacactccaggcttgtaagcaatttcctacagccgagcatcacttaacaatggagatgcattctgagaaatgctttgtgaggcaatttcatctgggcgaacatcatagcgcatacttagaacaaacctagatggcaccgcgtactgcgcacctaggctgtgtggcagagcccatgctcccgggctacacaccacagcgtgttactgaatactgtaggcggtcgtaacacagtgccaagtgtgtgtgtatctaaacgtagaaaacctacagtaaaaatagatataaaagataaaaaatggtatacctgggcagggcgcttagcgtagctggaatgcgcaggactggcagttgcacaataataaattagtcctgcaataagaaattaaccttagcttactgtaacttttttactttatacatttttaatttttactttttaactctttttaataacagcttaaaatacaaacacactgtacggatgttcaaaattgttttctgtccttagtgcttttctctgtttttaaaatttttaattgttttttactatttaacttttgttaaaaactaagacacaaacacacacattggcttatgcctacacaggggcaggatcatccatgtcaccttcttccacttccacatcgtgtcccagtaacacacatggagctgccacctcctgtgacaatgatgccttcttctggaaacctcctgaaggacctgcctgaggccattttatagttaactttttttcataagtagaaggagtacactctaaaataatgatgaagagtatagtaaatacgtaaaccagtaacatcacaaattatcatcaagtattatgtactctacataattgtatgtgctagacttctatacacagggcagtgcagtaggtttgtatacaccagcatcaccacaaacacaaaaagaattattctagcactttgggaggccgaggccggcggatcacttgaggccaggagttcgagaccagcctggccaacatgatgaaaccctgtctctactaaaaatacaaaaattagtcagacatggtggtgggcacctgtaatctcagctactgaagaggctgagtcaggaaaatcacttgaacttggaaggcagaggttgcagtgggctgagattgcgccactatactacagcttaggcaactgagcaagaccctctgtctcaaaaaaaaaaaaaaaagaaaaaagaattctgtacgatggctatgacctcagctccactgtaatctcatgggaccactgtcatgcgcgcggtccttcatcgtgcagtgcctaactgtactaggattaagaatccacaaacataatttgggtttgagatatttatacggtggtaagtcacctgaaatattaatgtatctttttaaatgcttgcctagcacatccactcccataaaaacaaatcagaaacccccaactaattatcaaatactgacttatwgaatacctattcttgaaataatggagacaacacacaaaaaagcaggaaacagaaacacacgcacccagacacccatccaagaacaacacgagaattcatttcaacccagagcaacctgacacagctgtgcccttggagaaaagacccagagtcgttaccggaaggaggagggcagggaagaggaacaggctgtgatttcacatttaaaagttgcaatgctgagcccacatgttcctaaagatggggatgtagtcggtggaggctgcccctccccgtgtgcactgccatatggtagaatcctggtgctctaagaacgcggggtcctccccgtgtgcactgccatatggtagaatcctggtgctctaagaacgtggggtcctctgggtgacagaggccctgagggccactaagagaagcaggaagcagcccatttaaagaggagtgggaatgcctgtcattctcctcatgcttcactttgttttttcttcaaaggatttaagacgttcttgttacactccaccaacctcacgagtttctaacacccaggaagatgaggtctaaaaactggatgaaaaaggacaccctgagaaaaggtcctagctggagtcagtcccctctgtgacctctctcctcaggcctctagaggacagatggccaggcctgtgcacacaccagcccaccctgagagacccctctgggaccaaccacctgtgagtcctgcgatgcgtttaagcagcctgtgccctcacccaagctgcagttcctgaaggtgtagtctgtgtctctgcggatgagatgacagctcgccattccccggaatcagtgaggctgtcagtcagccacgcttctgcagtatgcagaaacctgttcttagactccaaagccagagaaagaattctcccttcgaggcccaacaaattgagaaggaactgtgatggaccacttccaaaacagagacgggggcaggggctgaagggcagagaccaggtgatgtcagaaggaaagccgggttgcagacacagccgcccctgctctggtcctccagcgtgtttatgacgctcgtgcaggtcgacgagccatcctatggactagttaacactaaggtggagttcagacttttttagacaacggcgcgactggcagcctttctctatcaagggtcagacggtaaacgttttcagctttgcagaccagaggtccctgtggctacagtagcgcagacacagccacaggcatgtcattgaatggctgcggctatgttccaataaaaacttatttacaataacaggtggtggccaaattggcccatgggccttatttggtgaaccctgttctatgagatcacctaggcttcagccttaaacagtggaagccatcccctgaatgacaagtcacaagggtatcaaagaaagacccctgaattttcatggaaaaagctattcagacccctgcttggaaagctaaggcacactgccacgaagcagcaaggacgccttacaagtctcagtgcaacagagatggacacctgggctgggctggacaatgtttaaggttccttttagtccatgactcaagtgatactgttttaggctatcaggtagtaaacacgatcttagacatccccatctttgtaagcagaacagtacggcacttcaccacatctgcttcccaccatgcttctaagcagctgtcttccccctgctaatgttacaaccaaagcagccaccccacctcctctcgtgttgagcctcacgaccrctgacccagctggaaagccagcgccctgccgcgtcaccctgactctgctcagagccagcattccagccacaaagagggcctccttcctttcctctttcataaaartgttttttgaagagttagagtatattttaggctttttatctttattaaaatttcatgtgcatgtgtctgtgtattctgcaatttgtcattttcagaaagaaggaacaggcaattcgmgaagtttcacctgtactcccgagctgttccccaggctccagacccacttgagagcagaaggtggagctcaatgaagggtctcgagctcagcraagggtcactgggtgaactgagagaaaccacgttcacaaacgcgtactgcggacttcctgccgccctgggacctgtcactgtttgtccatgtaagctacagcattactagcagatgctaagatcgagtgrtatcactggaaaagtaggtgaatcctactaggaaactttctactccctactaggacctcaagcccctcagccacacagcaaatgctaatatgctccagtgttagcttagaagccttgtgtcaacaagaactggctcctgagtcccaagcttggtgccacacagcaaatgctaatatgctccagtgttagcttagaagccttgtgtcaacaagaactggctcctgagtcccaagcttggtgccacacagcaaatgctaatatgctccagtgttagcttagaagccttgtgtcaacaagaactggctcctgagtcccaagtgctgtcacaggacttgcccattgggatgttttccacattaaatatcaagtaaaaagacttcctggtgctcaggaattacagttcgttcttgaaacattccaaagaggccaccacagcttttcccatgtggcttcttttaaaaactcaaatggcttccttgaaaatactcaaagtccacccaaggaaattagtaataatagaatcagaaaactgtcaggagcataaagatttctgtatcaaaatgaaagaagcaatcctgagttgctgaattacccatctgctaatgaaaccgggatggactgatcatctaaccaagtgcagactgaggattctacttagtcctccgactgggtacaacaacagcctaggttctagggagggtggcagtgaccgggatgccacaatggaagagaaaatgaaaacactggcacagtgaaatgtctcatttccaaacagttttgcctatggccaagcaaggcaataaagacaaactctcccttttccccattgcrtgtgggctgccaggtacaagtaagggaatctttgctgtgcccactgtcctccagtagagaacccaacaggcaagggccccactcaggtatcagctcacctccygcacctccccttagcaggaactccttccactggcaaaggactgccactgccatctgactcaactgtggcgatgwggacggagtcaccgagctgcttttcttttgcaaaacaaaagtctttttctttgcagtcacgctgtaagacgaggctgctggagaaaacaaaagcacctagatttcagtgctgaatccccacaattgcatgcagctcacacctaccaggggtattccagtgcataggggaaaggaacccggctgaaaaaccagctccttatttttcttttaaataaaataatacgatcctaagtccatttaccatctgaagttgtcacgagtgaacagtcacattactgttgtggaccaggccttagatgagtttctcaggctcagcactgacattctgggccggatcatcctctcttgtgggaccatcctgtgcactgcaggatgtttyacagcacccctggcctctacccactagaatcctacaatctaccagatcctaggatctagttgatcctagaatgctaccaaggagacttgaattttggtcccatcatcaaaaatgccttctgcatcaatcctatgccagtttcccctaaaagagggctaactggaatgttctaggatgtaccaatcctccaggaccctcttagagctcatgccatcagagacaggcctctatctcagggatcaccccggctgacatcaaattcctcttctcttttcccaacatttcaaattgttcttcggactcattgagttccctaaggtgacacgcccccccccccccccacacccaccttggggggtcacggattgctccctgtggccctggcttcagcccacctgctccatgaccctatgctcttctcctctggttctcgaagctgtctgtaaccagggcaggggagataactgtatgggaccattccctggcctccacctgccccagcactctccaggccagcacagtctggcactacagactacagggccggagacaccaggcttggaagtgaccactggccaagagctgacataaaagccaacttccccaaacaggaagggcctgttcttcacaaagataaagaaaactgccagcattttgctggccttaagaagccatgcaaaattaaccagtacatcatgaattaacttcttttactctgctgtgcactgaataccattatgaagcaatatacttttggattaaaaataagcatttttgtggaaaatctgctacatgttttcataaaataaagtgctatgatgtactaaaacctcacattgccttctcgtaattttatttttatcacaagaaggaaatacatagtgattcctgaaccggaagaatgaaccccatcttccaactgtcacggaattatcaccaacatattcaaaagagaaaaaaataaaamcaattgttgatatattgagtccccttgatktgaatagctcaacataagtatcttattcaggatgggacagggccctccccacagacacgtgacaacagatcaaacatgcatttcctgtttcctgtttggtttgatctgtctgcctctcaggtgacttataatttttttcatcaagagaccagttttagaataaaaaataacttgagaagattcaagtaaaggacccaaaagctttaagagaatgaaaagcttccttgatatctctgggccctttcgctctagtccttccatcacagctattcctcctcgtcgtcgtcctcatcctcatcattgtcctccgcctcgtcgtcgtcctcatcatcgtcatcctcatcattgtcatcctcatcattgtcctcctcatcatcgtcatcctcatcctcatccagacttgcccttttgtcatcagatgtgctgctctcagactcctcctcctcccgagccaggagcttcttaaaaacttgaaactcctcaacagaagtacaggctgtcctggccaaaaactcagcttctgaaactctgagaatgtccttgagcaatgggttagggatctgtgtctgccccttcttatcaggggtttggtaccgtcccaggcgctccaggtaaatgtgtctctgcttaatcttggttagtgaatactgcaagtactcactctttacaatgtctggatgcttaattcccatcctgaagtatgcatactggaagacacaaacacacttaggagtcccagatacagagtattgaaacctatcattctataaaccataaaaacttaagttgtacaaaaggattcaaaaagaattgcctaattgacaacagcgaatacccagtctaggatactgacatttgtgtgacagccagcagtttcaaaacactttcaaattcatcctgagaaacatggagcaggaaataaaggggtgggagggaaaaggggcaggagggagaaggggcagaaggaagaggtggtatttttctttaaatggggaaggaaaaggatgaatatggaaagaataggcaaaacattcagaaaacatctagaaattcgacctaagttgtcataattattaccaaaaaatcggacaactgttaaaattacattttcaaaatcaacatgcaaaatagattctaaggacaggaaggtttcagctattttaaaattagctatttcagagtccccacttagactctaagaataggactggatcattcattattaatggcagaaaagttgaagaataggtttgatctgtagtaaagaaattaaagatttctctttggctgatgtatgcagagaatctagtctttcacttcctccactcaaatatgaggtgtccgaggcttcttatccatataactgaccttcactacatttgaaaaacctgagaaacttgctgttactacactaatcacggtaccagtcattctcacctgaaactacgctaatcccattaccagtcattctcacctgaaactacgctaatcacgctatcagtcattctcacctgaaacttgtattccagttgacccaggtcctctcgaagaacagaggggcaactgtgcaaaatcttggtgacttgctgtaccgtgaaaaggcacttctccttgagaagcctgacagtgtcgttaatgtcctgctggcgcatggtgaaaatttcagggcaacagtaaagcaccctctttaatttccctgcagaacattcaaaaaaggcaagcatataatttcaggatactccagaaactcaaggagctagctgcacccaatttaagtccacatttaaaaacaaacaaggatcctctccttccacagagcaagtggcaatttcagatctatcttcccagaagcaccatggaaatgatacatctccccactgacttcctgacactcctcagactcaccatccttccctccctatattcctgctttattctggcctcccacctgaaaggtgccaactttgtattttgggtctcctcttgccctcctcacttggaaaagaatttcccaggcatttactggaaagatcagagagtaatatgggagagtagtttcctccatattgctggtttgggttgatgtttccttctataataaaatagtcattgaagcattcacaactaacattctcaagctgaactcaatgaaaaggagttccatcaccatcgtcatcataacagtaataacaataatagtaatcatgaggacacacaacaccaatgctgacgtcctggttaccagggtcaccatatatcttctccaagccagggcaccttgagtgaaagaggccctattaaaaccgcactaactggtgtaaactgggactattccaggccttcctagggatagctgagcaaaattcagtaatgggaaacttaaagtcaactatttaaactgttaattaaaattttcctaacatttgagttagtgattatcttaatatgtgaggaatttcagtttaggtttatcttcatttcttaaggctgtgctgagtttgctaattaatcaccaccacacataatatatttagacttttagattacactgtaagaatctgttaagaaaaatatacaaggctacctttttcttatcttctagagaaggaggcctgtagagatgctgtgaaatggtggatcctaaaccttctaccactgcctcaaaaaacatcttaccaggaagagtcaataatgcaaagaaataatagtggaactcctctggtcaaagtgggtaagggtccttggagacccccaactcctccagaaggcccttaaagagattcaaggaactttgagcatccttgagatgtgaatattgttgggggcaggagtgggggataaatagaagggaaggccactccacgagtatcccaggaacctggccagatctctcatgttccagagtaaatctaaacactcgactagaatctaagtctttacaagagatgttggtttgacatcacatcacagagacagagcactaagaccatttcatgttgatttaaacatcaaatgctatatgtacacatatttatcaacatcacattatcagcatcaacccactgaacacataccatatgcccaccactgcactaggtgctgaagatcccacggtgaacaaggcagacaagagtctctgccctggcactcaattttttcttctagtcttaactcctcctccttccctctcaaaatgtattctgcacagaaagccactcctattcctcacctccaagccaaattatacagtcctctccaggaacactgacatactcagaaacctcccctaatccatctcaccttaggctgctctttccccacctctggctcctgtcacactatataaaatctttttttttttttttgagacagccttgctgtcacccaggctggagtgcagtggcgccatctcagctcactgcaacctccgcctcctgggttcaagcgattttcatgcctcagcctcccaagtagctggaattacaggtgcgtgccaccaagcccagctaatttttctatttttagttgagtcagggtttcaccatgttggccaggctgatcttgaacccctgacctcaagtgatctgcctgcctcggcctcccaaagatctgggattacaggcatgagccaccgcacccagccaaaatctgcaacttcttgtaccttctccaagcccaagcttttgcaggtaactggagcgcttcctcatttgcataataggcagtttcaataactggggacttttcttcaagaccacacacacaggctctggattcagacccaagagaataaattctgaaatgatgtccagcaactgttgaagactggcacctcgccgtacactgagcaattcattaatatgggcattgctgaaacccatgtccaggagggaactcatgaccctctctagctccaaggacccttgtaccacaggagtcccctgcttctcaaggaggcactgaacaagattcctcctgcactctggttcctgcacatagttattggatctaacacaagataactcctcaatgacccctccattggaggctgtagtcagtttgcgcaacaaagaagctgtcgtccttctctgttctccaagatgaggagtctgcctagccatacaggcccaggtgagggggatcaggcggtgccaatcaaggacctgtaagacacaggaccaaaagacaattaattcctcactattccagtgtaatggacaccataagacttctgagccagagtacttactgccttggttccacacaaacatacaatttttataagcaatctgcaaaatcctatctgaacttaagcctacagagaaggaagctcacaaagaacagggtatttcaaggccacagagatgggagtcaagcaggtacaatattgttagcttttgcagctttaaggatgggagcagggacatggaggaagagggaaaaactatttctaggccacctggtcatgtgtgccagaaaagtctggacctcagactactttccagattcatgttcttaaattcattccacgagaagaatcttgtgggatacagagttggcccttgaacaacaagggtttgaactgcttggatccacttatatgtggattttcttccgcctctgccacccttgagacaccaagaccaaactctccttcacctcctcttcagcctaaagaccttatgaggatctacttcctcttaatgaatagtaaatacattttctcttaggattttctttttgttttttgagacgggggtctcactctgttgcccaggctggagtgcagtggtgcaatcatggctcactgcagccttgacttccccaggctgaggtaatcctcccacctcagccttctgagtagctgggactacaggtgcacactacaccctgctaatttttgtattttttgtagagacggggttttgcccttatgattttctgaataacgttttcttttctctagcttactttaagaatacagaatgcaatatatatatatacaagatatgtgttaactgtttatgttgtcggtaaggcttccagtcatgagtaggctattagtagttgagttttggaggagtcaaacgttatacactgattttcaactggtgtgggggcggtctggtgcccctaacccctgtgttgttcaagggtcacagtaattagtcaacttgcatacacaattccagttgacctcaaaagtcttcagtggttcaggctggtgcttaacaaactatgcacaaatcatccaggcactctaagccagcagtcttcaacgtttttggcaccagggactggcttcatggaagacaatttttccacagactggtgaggggtttcaggatgattcaagcatattacatttgttgtgcactttatttctgttattttcacgttgtaatataagatgaaataattatacaactcaccataatgtagaatcactgggagccctgagcttgttttcctacaaccaggaggtgccatctggggttgatgggaaacagtgacagatcatcgggcatcagattctcataaggagcgcaacctggacccctcaaaggcgcagttcacaatagggttcgcgctccagtgagaatctaaggcggctggtctgacaggaggcggagctcaggcggtaatgccagcgaagggagcggctgtaaatacagtctggctggctcacttgccgctcacctcctgctgtgcagcctggttcctaataggcaagggacggtaccgggggttggggaacccctgctctaaaaccttcacatcggtcccaaccccttctccagcgtcatcgattgtcgccctggggccaccctgccaagcccaagctctggctgctctccagcctcccctgtccagatgctccctccgccaggaacacctggcagtcgctggggtcagcgggcgcggcccgtggaactgggctcaagcctaaagacctctatgctgattccgcttcctcttaatgaaaagtacatgttatcttccttgtgaagttcaaactcttgttcaacagtcaactcaggccgggcgcggtggctcacgcctgtaatcccagcactttgggagttcgaggcgggtggatcacctgaggccagaagttacagaccagactggccaacacggtgaaaccccgtctctactaaaaatacaaaaattagccaggcatggtggcgggcgcctgtaatcccagctacttgggaggctgaagcagtagaattgcttgaacccgggaggcggaggttgcagtgagccgagatcgcgccattgcactccagcctggagacagagcgagactttgtctcaaaaaaaaaaaaatgtcaactctatatcccacaataattgagcagagccacgggtccaggatgccaaaa

SEQ ID NO: 12272 - DNA, 14309 bp, Homo sapiens
gcacaagctgtcagccatgcctgatgtggtcctctaggcatcattctgccctgctttctccttgtcctgcctgacccactgtcccatcctaggaacggtcctcatgtcacaccaccatgcacaccactcttgcacgtgtccctccttcactttctgctccaccctgcacccccaaggattgcgttgggcaccccccaactcccaggccctttggatgtatttccccasttgctacatggccttcaccactgcttcacatctgtctgctacctctgtgcccgacttccactgcactgctcactgcaaagaaactcacttcccgaccccactgcagagtcccctgcactgccctgtgcctctgcccagcctgtgcctgtcccagggttcccctcagtccctgcatcacccccatccacaccacactccctcccatattccccacccctttaccatgtgttcctgccccatgtgcttggtcgcccagcttggtccaagccttcccctgtatgctgctttcaaggtggggctggcgggggcctctgaggggactggggaagaggactagcccttgggcmtagagtggcctgtagctccagagttctggggacccagaccccacagtgtccttgtcatctccaccacccgagctccaagccctgctccttgctgctctaggttggccatcagttttcccttccttttgtccttcatcttctgcctctgcaccccacagcagctgtcctgccatggcctcagcctcaaagtgggttccctgcagatgtcagctttccctcttcatctgggcatctaagtcctttacccctcaagaccactgctgagcctccgtctccaccatctcctcttttagtggccttgcttctctcctgccaagaaaaacaggaatgaaaaagtccattatccactttggtttgctggtccttgactccctgggttggtgagacttgtcttctgggactgaaggagaggtagcccagtggccggagggaagatagctgagggctgtgactgaacgtgaggtgtggaatctggctcagagccccagcccttccctccaaacatctggtagagagtcaggtctaaaggacaggaagaggctgaaggatgctttttggaagtagctcctaactaaggtgggtggaggcatggccattactgataaaaatcacagctgggccccgagtgggcagaggaggtgccttgatcaggccctcacctcccaggggaagggttcagggtccctgatgtcaagtgctttgaaggctgagactggcagagtagagaggaggtggatgggaggaagaacgggagaggggagaggggagatgggaagggccagctctggagatgctgcctcctgggctctgcggtggccctctcatcacagcttggcacccttggaaggctctgaggactgccgcacgtctgtccactcctgcatggtgttctgcagggcctgggtcttctccttgtccacctgaacgtagtccaccttctcatcagaggtgacggatgaagtagatggctgaggggacagagtgggaaagagggagtagctgtgagttaccagttaggtggggaggaagaaggtgggcacgggatcttcctgagctgtctgaaggggagaagagcatggcctctgcctgccactgaccagcctcaggagcctggcttctctttctgaatgtgggctttaaagctcagactccaaactcatcatccctcctgcaggatgtagcagcacctgccagcccttcttacttcccggcttctgggaggacccaggcccttccttggccctggtggatgggtccaggccttcatctctgcctccacccatctctgtcaggtcgctcatccaggggaaggaatttgctaggtgcaaacaaacatcagccacaggactttacgtgctgtgctcactgccaccctgtgaaggggaaccatgctgaggcacagctctgcacccttctgtctagactgcttagctataaggatgcctcctggggaggctttcccaggcctggaagtcccttctgaaggctgatgtatcgacggcagggctctggacccactcgagagcccaggaccaggaggcagtatcctcattcctggatctgttgctgattcactttgtaaccttaggacaatcagatctctgtgcactcatttgcccatctctacaacacgggggatgggctgactgatgaggttctctgactgagggtactgtgctctgagagcaggaataggagtctttagacctagatgaaagctctatgactaaagatgcatcataaaagctgggtactggagcaggagggaggctgagtgctgctgttcagtgttgaaggcaccctggcctccatgatctctgcctccgggaccctgagagctcttactgcccccccaactctactccaggcaccttgcggtgggggcttggggagctcggctggaagtccagggccagataatcaacgctgccggtgctcttcttaggggcaggactgttcgtgccactgggaacgggagatgcagacactgggttttgctgtcacgaggaggaaaaaactgtgagtgactgcagaaaacagactaacccaccacccagaaaaacacctctgggagtaagaacactgtttccctgagccctactctgacacatgcaccatgctaaggacttttcatgttttcattttaatcctcatgacaatcctgtaaggtaggtatgattactgttgatactgtttaaagcaaagatgaaactgtggttcactttactttcagagaagtgactttgcctgtggctgcacagctgttgagtgatgggaatcaggtctgttttctgacttccaaacctgtgctaacccctgtaccacactgcctcctttctagcacatcaggccaagtctcatcaacagtggctctcctgagacatccagcctttgcttgctggcgcttaagaaaggagcacatttcctttatgcactggaaagttttcttctgtcgcaccaaatcagcccctgtgaaactcccacctgtggcctagagtggggtagtcaccccaaagcagcttgctcccccgcctagctcctccaagatctgaagagggtggcttcatctccaggctgcacaagcccgcatttcttcagatgacacgctctaggatcctgtccatccaggctcgtgctctagcagagcaccacctcctctagaactttctggaagtcttattctaatgagaaggtgatagtcctgtgttctgtttgttggctgctttactggttggttaattcattctttcactatctatgcagtgactaccaggtgctgggcagttacgcccttaatggaaatctcagggaagaaatatcctcctctgcctgtgttgatagctctattatggcctcaccaaagtgagttatgtgcacgtatgcctctcaccactgaggagatacctccaccactgaggagatacctccagcactgcctatccaagggcacagatcatgccacccatgtcactgtcatgagaggcaggcccctgctcttgaagaccatgacttcgttgggacaggtctcatgtcttccttacatctgatgacaactcctactgcttgataaacaggtgctcaagaagggtttgtagcaggagactaaatcatgaataatacaaggagtccctgggctgaggtgagttagctaagctgggaagtggggaactgaggggtgggtcccaggggacttgaaaggcgtcattccagcgaagcccgaaggactcaccatagggacatagttctcttcgctgtctcctgagtctgtgctggtgatgctctgggtggagatggggcggcagtactgggaggagctggagttgaaggtgtggctgttgtgggaaggaagagttaacactggggaagctgcatggctgctgccatgtttctagcctccagctgggccctgaccctcacacacccagacctcagccattagagctgcacactccatcagattaagatctgatatagggcaggtataattattctcttttacagctgaggaaaccaagccacaagacatcgagacatgatcagctaatgatagcgttagcatcagaatccagctgtcccggcccacaggccagctaccacatcactcattttccctaatggcccgactccaagctcccacccccacacatacgcacttacttggccctagaccaagacttggtgataggtgacttgaaggggagttcatcgatgacggtgttgttcctcaggtcaagtggtgttggctttgctggagcaggaaaagaaagtctggtaatcagccagtaatgataatgctacacatacacaccttatatataacacatgagcatgtttataaaggcctgcaaagtcattccagtttcacacagggaaactgacgctcagcgaggttgtataatctttgcccatattgatgagccttgaagtcatgtcttcagattccaaattatatattctttctgctgtatctatggtaattatattttcagaatcaaaagtggggacacagggtttgacaacagatttttctccctcaatttatgacttcatttaaaaataaaagactatatataaaatatatttatatattaatatattaatatttataaaaatatatactatttatatattaacacacatatatgtattttttaagacggggtctcactctgttgctcaggctggagtgcagcggcgcaatctcagctcactgcaacctctgcctcctgagttcaagtgattctcctgcctcagcctccctagtagctgggactataggcgcctgccaccacgcttagctaatttttatatttttagtagagacggggtttcactattttggccaggctggtctcgaacttctgacctcaggtgatccactcgcctcagcctcccaaagtgttggggttacaggcgtacaggcgtgagccatggcgcccagccaagagaccatatttgaagtatagatggtcaccgtgactactccctgctgctcctggccaggtcggtgcaagccacagtggaggaaggtagatgccataagggcttgagggcttcagttccaaatgctaagatttgaattccctgttggccagacccacagggggctatctctgcctagctatcctactcctccctttgaatccttgccactgatccaatgccaggagagtgagattgtagcagacgaggaccttgcctggtctacatgcagggggcacaaagctgactttactgaacgcctgctatgtaccaaagtactatcctagatgctctcctttgcagcaaacctgggaggtaggaattaccatctgcatttcacagataagaaaactgagactcagattttacatgatttgccccaagtcacacctctcaagtccaggatccacatgacccctaagcaaatggaaagagtccctagccactgtccagagatgggacaggggaaagaatggacttacctttccgatcaggtttgaggttgcggttgacagggggtggctgaatctcacttcctctgctggggcctcggtgcacaggaagggttgttgatgggtagccaagtgagtcaaagtgatgggcccctgggctcattgggatgtagacgctctgggaattatcacctgctcgttccatggccaacagggtggaagaacctggattcatgggcacatagttgtcttcagaattggtgctgtccgatcggcccacaatcattttccctggctagggagaggaacagtgaaagaaatacagctgttactagcaagaagaaacaggaagggggtaagactttgtaaatgaggcaagacaagtcatgactgggttagctatactttgaagctgtaagggagaccttggggagaccaaataagaaagcagagtagtgggaggctgaggcaggtggatcacttgaggtgaggggttcgagaccagcttggccaacatggcaaaacctcctctctactaaaaatccaaagtattagctgggcgtggtggcatatgcttgtagtcccagctactcaggaggctgaggcacgagaatcgcttgaacctgggaggccaaggttgtagtgagccaagatcatgccactgcactccagcctgggtgacagagtgagactctgtttcaaaaaataaaaaataaaaaaaaggaagcagagtgggagacaagaatatatgaggtctgtgggccccttcaagccttcacgatcctttggcatccactaataatttttgataaatctagagtataaaatattcttggtgactgggtccacttggctttctggacgcctgaccaacactgtgggtggcatagtccatagactgtaggtttggttcaggacctgccctccacctcaagtccagactcaccactggcaggtcagcatctcaggccctggatcagaacaaggagcatattaggagtcctggctctggaaggtgaggtctggggccagttgtgtttccccagtccaggtttctaagtacctggggctcactccaggcacctaggggaccaccaagctgcagtcagagcttctacagagttgtgtgatacagcaatcccagccttcctctaactcttgctctatctgccgtgacatacaactaagctgcttctgccttggttacctgatttcactgtcttttcagtgggcctgaagccaggccctggtcttcttgcctgacaccttggagaactgcggttagcatcttccagagggcagcctgggatcctgcactcaagccataattctgccacttagcctgactgtgagtaccacccttgcctggagtctcacactgcagcctccctcctgcatgtgaggccacgtgggtaaggttgctgtcttagaggttcccccaccgtgcagcctgggtctattgcattctagatcctctgcttacctacaaggttggtgaaccttgtaatccagtctaccttagcacatacatttcttccagactagaatacttatatcttacttgtccaaagactcaacgcagggttctgaactgagacaagaacttgggcagggtcctaagatggagacgccatcamtcttttggggttgtgcttttaattccataaggtgtgaccttttacctaaccaggccggcctgaggacccttgggttaacccacactcaccaggaaagagccractccatcactcatggattcagcagaccggcctgcactctctccaccacgctgtgggtactcgtaggtctcacaggaagaagctgacagaggaaggaggattcataagtactcatggttgattcatgtgttgacacttacccataccctcaccagtgtggttcaaggtcttactgatactccagaagatactactctcaaccccaaatgataaggaatttcttcgaacacatcactcctcagttcaaaaattcctcctgggcttctagatgtagctccagtgttagcatctgcagagaagctgtccttgactactctaccctcatmtatgcacctctcctttgactcctacaccactcacstgtcstgctcaccccagccatcacttctstgaacaccacagtaacaatacttgtcctgatttatatgtgttggttttattttcccaatgagatgtaagctctraagggcaggmacatgttttatgtatgtctttatcatcwcagttccaaaacggagtatgactgctcaaattgtcgatggattgaaagacggcaaagaggtctaaactaggagctgggactmtagggtctgagtctcatctctggcacaatgactctgcaactctatttaagtctcttaactgtcattggcctcatgtgagatggagacaaggaggttttgtcccaccaacctctctgcctggcttaaacaacaggatggacaagaaaaggctttgcaaaccataaagcaagatgcaaaatgaaaggaattaatattgttctattttttcatcatacagaggaggttacatgcagagttggaatactctcagtggaaaacaagtaacaatagaatttaggtacttcaaataaaagttttgacttcaaccaaagagattcaagtatgatttagaaaatattaagacctcgttttgctttagcagtctgttagtccacacaggtttcactccagtttggactgatcttctgaatttattttttaaatctttgatttgatttacaaatgaataaaatamaatgatttgggcttctaaacccataatatgttatactgtggttaatcaagaatgtcctattctccattagtagaacattaacttctctggggctagctctgttagacaactactactaacagcctccagtgctggaggaccaactggtaagggatctgggtagaagacacctatgtttttgagtatcagtgacctaggtggttcgtaagttcccctcggccatggatgaccaaggaccatcaaactattgagaacccctgtgttacctcctcctccctctgagtctcagctaggacttatactgacctcggtgaagtcggctgttgtccattgcagggagggtgttgcgtctggggatggtggcagcgacagatctgctattttcactgattggcggtctctgctgaggactgccccatcgaggtgtttctgcctgacttggcttgggggggcggggtgggggagctatggctgagtccccaggagtggccactgtcatggcattgtggtttttgtccagagtgaatgtcctagggatctggtaggctgagagtggggtggccggaacatccatattgtctaccaggaggtccccraactccctgcacagggtgttgctgggcgtcttgaaggtgtacacatcctcattatctgtctcggagcctgtgaggctgcccttggtgtggccatgggaggccaggctgcgggggaggtcgtaggtactgtctctgaattctgtattgtgccggctcggcttgggaaggctatagaagccatggacttgaccactgatcccgttgacacagtgtccattgccctgggcaagtttttgtacagctgtgtcactcctcatgagaaaagaggctctggtgccctgagagaagctggcactcctaaaagagaaagaagggaaagggcaggagggtgagacaattactagctgtgtgaccttgaggcaaagcactttctctttctatactttggtttaggcatctgtaaaatggtgactaaaagcatattttgaaggttgttcagactctagtatatgaatgtttaaacaatgttagacttcatccgtcccccatctccaaatggcagttaatagcaggggttataacccccactccctgaacaagtatcaataagccagatggattgcctatttgttcactgttttaagtaccgcagaatatgcacattcgaacacaaatgttgtgagacagtggaaagaacctttaagttgatgacaggaaacagcaaacaagtcattttacctctctgagtctattctgccactgtgaaactagcccatgggtattgatgttgtaagttgaaaagaattatttgggtcaggtgcagtgtgcagtggctcatgactgtaatccctgcactttgggaggctgaggtgggaggttcacttgaggccaggagttcaagaccagcctgggaacacaataagactccattgccaccaaaaaaaaaaaaaaaagaactagctgggcagggtgctgcacacctgtagtcctagcttctggtgaggctaagggaggaggatcgcttgaacccagaagttcgaagttagagtgagctatgatcgcaccactgcattccagtctagtaaacagaatgagaccctgtttcaaaaaaacacacgccccaacacaaacaaacaacaaactattcaaacgtaagctctagatttattttctaccatgatttatggttggttaagaggcattttgaggggaaagatctctttccagagacctagaaatctatatgaagaatggtttcctgtttgggaactatatatagaaaaagttttgattagtacatttttaaatttaggttttgggcaataaggcaagcagtaaaaagagaagagaaacaagaggggagacttgtgttaggttccagtactgctactgatacgtgctgtgtgtatcaccaagcctcctctctcaggtgggacctagtacgtcacaatgatttctaagggcccatctggccccgatgctctacaagcccttcgtttcacaagagtggttttcaaactagattccaggttctctgtaagtgctttgggaaattggagggtgaggttctgagcaagcagggatttaggtctgcttctttagcttgtgtatgattcttcataggatttcacttggggaaaaaaagaatcaatcctttgtagcagggattctaagccttttggaggctataggagtttttaagattctggtcaaaagctcttggagtgtctcatcagaaaaggcaaatctcgtatacatataaacttgttggggctgtaatacataatagccctctgaggccaatccctggaccttttgccttatagaagctctctcagctcctgaggagtttgttatttacagatgtggccaccagatggtgttagaaaataggggccagagcttagaaagaggaaacaggtgtgtaaagccaggcttcctctcatgtaaactgtacccaccatgatggctaggaattccaggtcagtctccaaaccttcactgatgctcctccttgggcctctgcactcctcctccctttctgttccattccagacacataaccaagccaacagccatgggcttggatgattgaacatctaggctttagataatgtagtgcttagggaagaggacgggggtggcggggggagcgaatggtagacataaggtgttaatgttgtatgcatttttttggtgcctttcattttgctttttttggaatttccaactctctgttggatgctcccatctggatttgttcattttacatttactgatgtcctaatttccatctgggccaggcaaaagggatacagagatgccacctgcccagtgaggggtggtctgggaatgtcacagtagggcaggagatgacatggatgcaaatcattacagtcaagtaggggtgagtatgtagctgctgacagttggtatcagcccttgctgggggtggtggtagacaatgtcagggaagcctccttcagagatgttttatcttgagtgagtctggaaggatgagccacaactggccaggcagaaggcaggagaagggaaatggtgttctagttgaaggctcaaagatgtagaacacaacctggcaagttctagaaactcgaagctgctcaggctgcagcaagcacattagaaggcagggctgagagaagacactggaggccaggccaggactaaagggaacggggagcctctgaaggatttcaaggtggggatggggttgcaagagcatcacaggcaccctgcaataaccttcaacatactcaagaatgaactcatcatcttcctctggaactcttctcctcctgcctctcttattttgggaatggcaacagttactcaagccagaaacctgggagtcacccacattatgatttctgcccagggcctctctgatccttccatcctactaatatttactttcctaacttcccagtgtaaacattttcaacaccgcctcaatgcttcaggattaagcccaaactcctaggtttatcccaactcatctcaccaatcttttctctttagttcccttttccactctaggatccaaaccaaactttgcagtgttccctgtgtgccccagttagtcaagcattgggctttgctgcattgttgggctgtgtctggaaggcttcttacctcaatctggcaagttcctactccatttatccttcaaactcatctcagaagacacattttttaaggccattcttacatcctctacctctaagcattgcttaacttaatcacttgcttaactttgttcttggagcaggtagcaagtgttacctatattaggcaccattactacttatctctgccaacagactgtgatttccttgaggaaagaaactgtgtcttactcatttttctctccttagcacctaggttaatgcttgttgcattataaataatgaataaacgtttgttgtaagtaagcaaatgaataaacaaacgtatgttgctgctatcccttttcctgggcttggcccaaaccttctgatcagcagatcaaagcccttcctctgtagaacccactagcttacgttccaacttccctctaccccggcatcctcctgtctcgctcacagaactactcactcatccctaaacatgtcctgtgtagtctaaacttcagccctggtcttgcattactcacctccctgtggaacgcttccttgatacatcaacaccttacacaaagtccacaagaagccttttcactctacaaaggtattacaggtccctaattctcctttttatggtaatcattccttcctctgtgctaccacagcactctgtgcttccatcgcaacactcaccttattctgccttatgtcagttattcaggtctgtgtctttccacttctaccagaccatgtgctcctagaaggcagagggccatatcctgtaccctggcatagtgccaggcatatgatagataatagtgacacatgttgagggagactgattatcacctcagtaaccaagtaagaggagttgaacaagggactcttgcccaaagttacatactcagagggcagggaatttgttctagcagccaggtctctgggtgcccccactgcgcaaaccatgctaaaatgtggtccctttgggcaataatctagatggggaattccaaatactcagcagtcttatggcctttagtattttcatgtaaaccttaactgaggcctgtgtcactgtgatgacctgagttgcttttgtgggatggataatccacctggaagtggtggatttggagagaggcttctcttccagggctgggcttacagaagccttataaaataggcaagatactatgccatacatatcacatgtgatctcattttaaatcctcctaatagttctgagacacacctcttactttcacattatcagatgaggaaaacagtaaatggcagagttggagcaggaagatactcaaacacaagcacgtatgggagctccccagaatcaaaaagaagtttgagagaagatattccctcaagccagcagtgccaagtgccttccctttccattcctggccaatggctcttccagaggctatagaggctattgccaccatacagtctctcccttggtgcgcgcgcgcgcgtgtgtggtgtgtgtgtgtgtgtgtgtgtgtgtgtgtgtgtgtgtcggagtctcattctgtctcccaggctggagtgcagtgatgcaatcttggctcactgcaacctccgcctcctgggttcaaagcgattctcctgcctcagcaccctgagtagctgtgattacaggagcgtaccactgcacctggctaatttttgtatatttagtagagacggggtttcatcatatcggccatgctggtctcgaactcctgacctcgtggtctgcccgcctcagcctcccaaagtgctgggattacaggcgtgagccactgtgcccggccttcccttggcttttaaaaatggttttctagtttttctagccacttcattttgtacttgttcttccacacattttcatataattttatataccatactatatgatgattttgcttttttctatcccactggactccaagaaccctaatgatgaaggactcactttgattttcaatgagtatgttcccatttaagggtgacttaatataaaatgcttgtaagtagattaaacaccatttagagttctgtaactgtcactggccatgtttaagaggtcatttgaactatcctcttgcatttgacccattccaaatggatccttcctgtgaaagaagaaaactctgtgtcacaaatctttatgagatgaggcaatctttgtatctcaaacccttctggctgcagttctgagccaattttggcaggactctggttacagagcaaagctgtatatgtgaaactaaaagttgtatattttgcctttggtcagtcaatcaaagcctctggtgaatgagtcagggaagacttagaaaag

SEQ ID NO: 12273 - DNA, 37927 bp, Homo sapiens
aggtcaggcagttggctcatgcctgtaatcccggcactttggcaggccgaggtgggtggatcacttgagcccaggagttcaagaccagcctgggctacttggtgaaaccctgtctctaccaaaaaaaaaaaaaaaaaaattagccaggcgtggtggtgtgcgtctgtagtcccagctactaaggaggctatggtgggagaatcacttgaaccaggaggtggaggttgcagcgagccaagatcgtgccactgcactccaacctgggtgacagaacgagaccctgtctcagaaaaaaaaaaaaagagtggatatatgctccgtggagcctgaaacatatacaattgtggggctctaaaattatgtaataaattcaatatttatttagagtaaataaacttatgtaataaagaattaaatgatgtcataaagtcagtatttaaaatgagaagaatcattgtagattttgaaatactgacaaaaaccacagacatcacaaagtccagaaaaataatattaataactgcccagcaaccgctataagtcttcacccatcttgcattttttagttgcatactctttgcaactaaatgaccattttatagagatgttagaaagataaattagtcaaaaatagattttaaataattgatagtctctaaactttgtattatcagctttccaactccttgctataatgtcttgcacgggtgatgcttctcgctgaggaaaagccctggggagaattccagccctttgatctcccttggcttggtctccaaaggggcttctaagacagctccatctggtggtcactgccctcgtccctagcccaccgaccctagtccaccctcaactgacacttggcctgagagaatgacctccatgctggggtccaagtgtccgatgaagggctggtaatactttttttttccattctgatggaatgaggttcagagtaaatattaggttgtacaaataagggaggagaccacccctcatattgtcttacgcccaatttttgcctccaaagaaagaagaagtaaaaactaaaaggcaggaatgaagtccacaagcagacagcctggcaccacactctgggcctggtagttaaagatcaacccctgacctaatcggttatgttttctatagattacagacattgtatagaaaagcactgtgaaaatccctgtcctgttctgttctgatctaattaccaatgcatgcagaccccagtcacgtacccactgcttgctcaatcgatcacaaccctctcaagtggacccccttagagttgtgagcccttaaaagggaaaggaattgctcactaggggagctcggctcttgagacaggagtcttgccaatgctcctggctgaataaactgcttccttctttaactcggtgtctgaggggttttgtctgcagcttgtcctgctacatttcttggttacctgatcgggaagcaaggtgattggcagatggtcgagacagctccttaggcggcttaagcctgccctgtggaacatccctgtgggggacttcgaccagcccaagtgacgcagattctgagagcgctcctgggtaggcatttgcccaggcgggatgcctcgccagagcagtgtgtggcaggcccctgtggaggatcaatgcagtggctgaacaccaggaaagaactggtacttagagtgtggacatctgaaacttggtaagactagtctttggaacttgcctactccatttgagtggaagcgtggcctgatcaccgacggcatgcttttaatggcactttggtttggttttggttttggttttgacttggtttgaattgcttgacaagaccggtcttaggaactttcccactccatttgagtggaagcgtggcctgatcacccacgacgtgcctttatcggcactttggttttggttttgacttggtttgaattgcttgacaggactggtcttgggaacttgcctactccatttgggtggaagcgtggcctgatcacccacggtgtgcctgtaccggcactttggtttttgtttttgacttgatttggattgcttgatactttggttttggttttgacctggcttggatttcttgatactctgattttggttttgattttggtttggtgtaaactgcaaaagtgtgtgtgtgccctttttacctgttctttgttttgtggtgtgcgtgtggtgtgagcatggtgttttgtctcaaagaagcatgggtcaggcacaaagtaagcccaccccactaggaactatgttgaaaaatttcaagaaatttaagggagactatggagtactatgacaccaggaaaacttaaaactttgtggaagatagactggccagcattagaggtgggttggccatcagaaggaagcctggacaggtcccttgtttcaaaggtatggcacaaggtaacctataagccaaagcacccagaccagttcccatacatagacacttggttacagctggttttagatccccgacagtgattgatagaacggcagcataagtggctggcagaggcaaggaaagaccaggagagagagagagagagagagagagagagagagagagagagaggcagagagagagaaagagacagaggcaaaagaaaagtcaaagagaaaaagagacagaaaatcaaagaaagagagatatacaagtagttaaaagaaaagtgtaccctattcctttaaaagccaaggtaaatttaaaacctgtaattgataattgaaggtattctccgtaaccctataacactccaataccactttgttgacagtgtaaacaagggcgtatcttgaaagcactgaggccttcctatcaaaaatccttaacccagtaacccgtggatggcccaaatgcattcaatctgtagcggcaactgctttgctaacagaaaaaagtaaaaaaaaacttacaggaaacctcattctgagcacacctcaccagttcagaagcatcctaaggaataaaagggggggggggggcggaatttatgtaaaaagagtattatatggtaaatttttgtcctgaattaaattaactggttgtttaaagaaagaaatatttgtaataagtcagaaagttgaagcatgtcaaagaattgtctgcaaaagttgtgaaagagaaaaatgttattaaaaaaagaatttatgcaagaaattttgtataatttaaaagtaactaggcctcctgaatgtaaacaacaaacaaacaacagtttatgtgcaaggtgtataaggaaagtaaaatatacctgtggtaaaagaattataaggaggcatgagaatataaatttttacctacattaaaaggctaaaaatatgtatattttgttttaaaggtttaatcaagttttaaagtgttaattggaaagaaaattctgtgtgtaaacattggctaaagttaaagcagtatcatccagtttttctgtaaactggacattaaaataaaaccatagcaggtttttcttaaagcaccaacctgctctttagcaaaaattataaaaagttaaaaagagtctataaaatcttaccttgtggtctaacattaaaaattgcataaatatgtctacaaggttttgttaaaattaggtttaatattaataacacactaatataaaagtaaaatttagcttatctggtgtaaaaatcatagaaaaagcattgttaaatgtaaaatggtatttggctttctttggtttaaaaactaataaaaataggtgctaaagaaaatttctcagtaaaaaggcactaaggactaagtccactgccaaggtccccacatttaaaacaaaaggtcaatttcttaaaaattatatacttggtttatcttccactttcctttccctcaaaaactaaaagtcttttagcacatgtaccacccctagaatttccggtaaaccagcaccagcctgaagatcacgttctcatcaaagggtggaaagaagaaaaactcgagccagcctgggaaggaccctaccttgtgctgctaaccaccgagactgttgtttgtacagtggaaaggggatggactcaccacacccaagtcaagaaccccctccagagtcgtgggccatagtcccaggggaaaaccttaccaaactaaagctaagaaaaatttaactttttcatctattctattactcttccttctttcctcgctctattgctaaccgtctagttattaacattaccaagtcaattttgcctcaaactattgcatttaatgcttgccttgttataccctgtggggacttgccaagtcaaagacagctctttacttcagaaaagtacttctgtcccttctgactctcctcagattgggcattagtaaattaggaccatttaatctggggaaatttcgataaagattccagtgtcaaccaggagtcttgccccacaatgtagagcttttatgctgtagttggtccaacattctatggaccactaaagagcaaggatggactgccctaactggtttttgtaatttcctaaaatcatacattcattttactagaggatcatagaagttaaagacttaaaacaaactttagcagttaagacaggataccaagatgcaaatgcctggttaaaatgaatcaaatattccatctgcacattaaacaaaagcaattgttatgcttgtgcacatggcaggccagaggcccagattgtcccccttccactaaggtggtcctccagttgaccaggcataggtctgcatggtagctcttttccaggattctacagcctggagtaataagtcatgccaagctctctctgctatatcccgaagtccggcaccctgcgggtcagcccccaagggctatccagcttccgtctctcaacactaagttcacttcatgtctccctggcattccttggagacctgaaaggatgcaatgagcttaagaattttcaagagcttatccatcagtcagcccttgttcatccccgagtggatgtgtggtggtattgtggtggacctttactgagcactctgccgaataactggagtggcacttgtgctttggtccatttggctatccctttcaccctggcatttcatcaaccagagggagaaaaaaataagacatcgtaaagtgagagaagccccttattggtcttccgactctcacgtccatttagacacaattggagtcccacagggaataccagatcaatttaaagcttggaatcaaatagcggcaggatttgagtcaatattttggtaggtgacagttaataaaaatgtagattggataaactatattataaccaacagcaacaagcttttcatgagttaaaactcatgtcggccccagccctggggctacctgacctgacaaaaccctttacactctatgtatcagaaaaagaaaaaatggcagttggagttttaacccagactgtggggccatggccaaggccagtggcctatctctcaaaacaactggacggggtttccaaaggctggcccccatgtctaagggccctggcagcaatggccctgttagcacaagaagcagataaactaacccttaggcaaaacctgaatataaaggccccccatgctgtggtaactttgatgaataccagaggacatcattggctaacaaatgctagattaaccaagtaccaaagcttgctatgtgaaaatccccgcataaccattgaagtttacaacaccctaaaccttgccaccttgctcccagtatcagagagcccagttgaacataactgtgtagaggtattggactcagtttattctagtgggccgaacctccaagaccatccttgaacatcagtagactgtgagctgtacattgacaggagcagctttgccaacccctgcaaagtgactctgaaaaagacgacaagccctgctccagtcatatccggaagctgactaatccacacacggctgaagcatgagaaaactcatcacgggactcattttccttaaaatttggacttgtacagtaaggacttcaactgaccttcctcagactgaggactgttcccagtgtatacatcaagtcactgaggtaggacaaaaagttgctacagtcttattattttatggttattataggtgtaccgggactctaaaaagaacttgtttgtataatgctattctatacaaggtatgtagcccaggaaatgaccaacctgatgtgtgttatgacccatctgagcctcccatgaccacagtttttaaaataagattaaggactgaggactggtggggaggactcataaatgatacgagtaaagtgttagccaaaacaaaagaaaaaggggtgcccaaacaagtcaccttgaagtttgatgcctgtgctgtcattaatagcaataagttaggaaggggatgtggctcttttagttgggaaaaaggctatatgaccgaaaataagtacatttgtcatgaatgaggactgtgtgaaaatgaatgtggatactggtcttgtgtcatttaggccacttggataaaaaatgaaaaggatccagtccaccttcagaaaggaaaaaatggctcttcctgtactaagggacaatgtaaccccttagagctagtaataaccaatccccttgatcctcgctggaaaaaaaggggagcgtgtgaccttaggaatcgacagggctggactggatcgtcgagtaaatatcttagttcgaggagaagtctgtggaaaatttaaccttaccaattgctgcctgcacatagatgatcagaggcaagtagtcgaagatatagttaaagacatgacgaaactggcacatgtgcctgtacaagtgtgacacggatttgaccctgaagctatgtttaaaaatggttcccagtgctaggaggatttaaaactcttataataaaaattatagtagtaatagcctgcttactgatcccttatttactayctgtactcattcaaatggtaaaaggtttcatcactactctagttcaccagaatgcttcagcacaagtgtactacataaatcactatcgatctgtcatgcaggaagacataggtagtgaagatgaaggtgagaactcccactaataaaatgagtgagagtctcaaagtgggggaataagggaggagaccacccctcatattgtcttatgcccaatttctgcctccaaagaaagaagtagtaaaaactaaaaggcagaaatgaaatccacaagcagacagccaggcaccacaccctgggcctcgtagttaaagatcgacccctgacctaatcggttatgttatctatagattacagacattgtatagaaaagcactgtgaaaatccctgtcctgttctgatctaattaccggtgcatgcttgctcaatcgatcactaccctctcaagcggatccctttagagttgtgaggccttaaaagggacaggaattgctcactcagggagctcagctcttgagacaggagtcttggccgatgctcctggcggaataaaccgcttcctgctttaactcggtgtctgaggggttttgtctgcggcttgtcctgctacactacagcaaaaattaggttgtattatagaaaattaacttttttggtttttttgagacggggtctcgctctgtctcccaggctggagtgcagtggcaccatctcggctcactgcaaccttcacctccagggtcaagcaattctcctgcctcagcctcccgagtagttgggattacaggcacacgccaccacgcccagctaattttttaaatttttaatagagatggggttttaccatgttagccaggctggtctcaaactcctggcctcaagtgatctgcccacctcagcctcccaaagtgctgggattacagacgtaagccaccacgcccagccgaaaattaacttctattaattgcatacctgggtttgcctactgagaatcataccctggatatttgtattctttactgaaaagaactgttctatctttccagaaagtggtttcctaaattctggttttcctcctggaatcctgctatttccttctcgcatactctagagaaatcgaagtgttttcaaaggtgctctgaagcttacgctccactagtttcacagtaaatcgccccttgcgagggcgctttttttttttttttaatgtgttctctgaatcgctttccccctttaacactgcatgacaagactaaagccagaatcccaagactgcagcgctaccccttcacaagccgtcgggctgtcccgggcggggccggcccattttcactttctccactagaggcagcagcgcaccgtgaccctggcttactacggtaagaaagcggagaccttttgcttcgaggcggttggtggccagtagtcttgatcgacaagctcaggcctctgaactaagcagccgctgtttatgcacgtacagccaatggaaaggcaggagtgcggccaacggccaatgaggactggtcttaagcggaccacagggcggggtttccctcgagaggcgaacgccgggtaaaagatcgggagcggaagtgggcgagtcagagcacatccggtgttagaagcgctggtaggccttggagaggcgggttaggaaggtacgtctgaacctagtactgggcgaactgggagtgagaaatggaaagggagttagcagttactgtctgagcaagagtggcagtagcttccttctgcggacagatggcaccctgaaggaacgaggccctgctcggagaccagactcgggaaaacagggtgtggagggaagctagggaactagtgctgcgcgtgcgcaacagtgctgaagcgggggtggggcggaggcgagtctgcgggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgatgtcacactcctctgtgacacgcgaggctcctcagttacttagccaacggcagaggcgggaagtgagaggagtctggggctggggctgccttccaggcccacggggcggccccgctcttttcggattggttacctttgggcaggtgaggtggctttgctttgcttggtcttgaggttttgtgggcgtctttctaagtctgctcagcaagggcgtcgttgggcagtttttatcttgggcctacttgctggacctgtggtaacaagtaggctttggtatctttgtatatttactgagtgtagaattactacccggtgccagcccgggctgcttggggtcatcagcctttcattgaccacccccacaacaaaaatcactatgaacttgagactgtgttctagcaacttgtgaatgtgtaacccagtagaagggctgactgtgcttgaaacagacaaggattttaaggtcaaaggtaaataaatggcaaatggacttttctagttacttattgatatttatttacagtttatcttttgtatgtgtggtttaagaattgaattctggaaagataccggaattgcataaacacatttcttatgacctgcgtatacacacttttttctgtaattattgtatttacactctttggtgttttcttattctttgtgtctaatatttttgttctggcctaaagaatatgttgacatttagattctctgccgccactttcctccagtagggacagaatagttgaacccttgagaaatacaatctgtacttttgatccatagtttgcttcttccgttatttatctggttgtggaaacatggtttagtaccttcctcctcttttttttttttttttttttgaggcagagtctcactgtcgcccaggctagagtgcagtggcgcagtcatggctcacttgaaccttgacctctcctggcttaggtgatccaccccagcctcctgagtagctaggaccacaggtggacgtcaccagctccagctaatttttgtattttttgtggagatggggtatcaccatgttgcccaggcttaccaactccagaactcaagcgatttatttatttattattattattatgttttttttttgagacagtctcactcccttacccaagctggagtgcagtggtgcaatctcggctcactgcaacctccgcctccctggtgcattcaattctcatgcctcagcctcctaagcagctgagatgacaggcgcgcaccaccatgcccagctaatttttgtatttttagtagagacgggcttttgccaagttgtccagcctggtctcgaactccacacctcaagcgattcgcccgccttgacctcccaaawtgctaggattacaggtgtaatcctttcctaaagaaaaagagtcatctctcctgaagaataagaaaaggtaaaattaatctagatacttagcattttcaagttattttccctgattatagatatagttcgcgctctttatacaaatgctgaaaatgcagaaaaatgtcataggaatcaatgtatgttttgggagggtttttttgttttaaagatttgttttcacctatggctgaaacttttgaaagcttatataaatgaaagcttatttttctactgtaggatggaatagtaaaaagagcactagactatagtggtcagaagaccccaaatctggttctggctctgctatttaactttctaatgttggtcaaatcaatactaatgtttgttttagtactttacgttgatttcacacagattttcttattggcattcagtagagcaggtattgatcatcatcgttatcttacagatgaggaagctgaaataaccttaggtaaaatgatttttcctaggttatatagtagaaagtggcagcacttgtgacaccaaatcctgtcctcttgccactattacattgcctttttgaacttaaaaaagatgtataaaatgggcctaatctttccctttccttgtgggttgatgtgtgaggattgaaggtgatacatatataaaagcaccttaaaagttataaattttatataaatatagtcaggrgtattagtatagaaggtactactgctggcctgacgagtttcattttatttcgtaaactgcccaagggtattaattttctctagagaaaccattgaatattctgatgctctaacttctgattttttttcctttactactttgacctggttgtagaatctggtagaaatgtcttctaccactctgttttgttcccccagagtttctaaccaaactgcatgcagcccttcgtagtttttatacacattttgttttccaaagatggtgttcgagaccaaggagagaaaggctgtctccttgacttaaaggttacctaagtgaccccttgaggtaggttccactctgagccagctggggaatgttgatttgaggttacagcactcttgatctgataatagggtctaaatttgctctagagactttgtagtgcttaaatcttggggatagctgagctgaaccagatgcaagctctgccctcagggtgagaagtttctgcacaattaactggaatccaaaacacgtgaaaaaggagcttcaccagtgagggtgaagtgggtatgctgtttgtcttaatttatgtgtgctccccatttgggctaaatatggtgttattagggagggattactggtttatactggaagaagattatgtatttaggattttggggccttcttaggattcagtatctgtcaaacgttatagagagggagatgaagtagtgtcaacgtttggtacaaaaaataatttactgaaggcagtaggcatttcatctccagttactggtttggttttgaggcagccccctggaggagatggattcagtattagctaatccagggatttgggtccaagttaagggagaggcggggacatctagggtgtccacctgggaagatcaaagcttggtcctagttgaatgaaacaattccttggatggttccgaaactgaactgacctacctcctgggagtggcagggaaagcatcaagcttttgcgcatttacttcatcaaatcctttaccatatcagattatcacttagtggctattaggctgtctcaaaatgtccatggccctgtgggacaagagagatagtataaatgtgctagaagaaaggtatgccatttaaacaaaagtacagacgggccccaatttatgatgattggacttaatgattttttactttataatgatgcaaaagtgctacctgtttgctagaaactgtacttcaggccaggcatggtggctcatgcctgtaatcccagcactttgggaggccgaggtgggcagatcacttgaggtcaggagtttgagaccagcctggccaacatggcaaaaccctgtatctacttaaaatacaaaaattagctgggcatggtggcacacacctgtaatcccagctacttgggaggctgaggcatgataatcacttgaacccaggaggcagaggttgcagtgagctgagatcgtgccactgcactccagcctgggcaacagagcgagactctgtctcaaaaaaaaaaacccagcacatttagaatttccatcttttcccagactagggatatctggtatgatattttcacatgagatatttaacactttattataaagtaggctttgcgttagatagttttgcccaacttcagactaatgtaagcgttctgggcacatttaaggtaaggtaggctaggcttaagctataatgtttggtaggttatatgtagtaagtgcataaattacgatactttcagtttacaatgggattattgggatgtaacttcattgtaaatcgagcatctatacttttaccagtaatgagatttttcaagtgcctttatgtttcagtttataattttcttttctctctttttttttttttcttttttgagacagagtctcactctgtcgcccaggctggagtgcagtggtgcaatctcggctcactgcaacctccgcctcctgggttcaagccattctcctgcctcagcctcccaagtagctgggattataggcgcccaccaccacgcctggctaattttttgtatttttagtagagatggggtttcattgtgttggctgggctggtctcgaactcctgacctcaagtgatccgcctgcctcagcctcccaaagtgctgggattacaggctaaaactagacttttaaaagagaataatctactgaagatattgtagtaatgagtacaccagtaataacaatgttagtacaccagtaataacaatggttaccatgtattgaactcattctatgtacaaagagctattttaagaactttatttgtattatctcacctaatctgcaaccttaggaaataaggattgttatgtactagtattttacacatggtaggtgaaactgaagtacagtgaggttaagtgccagcagcttgctgcatgtcccactgctaaggaaataactaggattcagaagtagcaggcagtcttaaccactatgcaggggacatggttatacagtgtatgaacattactcagtagtaaaaactaatgaatggaaagctttcttggccaaaaacacagaagaagaagaagaagaagaaaaaaaactactgacaaattactaacagttcttccccctcctttttttgtttttgtttttttgagacagagtctggctctgtcacccaggctggagtgcagtagcgcaatctcggctcactgcaaactctgcctcctgggttcaaacgattttccttccctagcctcctgagtagctgggattacaggcgcccaccaccacatctggctgatttttgtatttttttactagagactgggtgtcaccatgttggccaggttggtctcgatctcgtgacctcaggtgatccacccacttaggcatcccaaagtgctgggattacaggcatgagccaccgtgcccagccctttcccctcttttaaactatatgggatttttcttctaagtatcaatttggtcccttctagatatgtgggaacaaggttcaggatggttgaatttatacaacaggaagaaagaaccatgtaattgacaaactaatttttttgttttaattttataaaacggttttgctgtgttgcccaggctggggtgcagtgacacatttttgctctgttaccaggctggagtgaagcaacatgatgatggctcactgcagcctgaaattcctgggctcaagcaattctccttcctcagcctcccaagtagttgggacaacaggcgcacaccaccacacccagctaattttttaattgtttgcagagatgaggttttgctgtgttgcccaggttggtctggaactcctgggctcaagcgaccctcccaccttggcttcccaaagtgctgggctcacaggtgtgagacattgtgcatggcctttttccttttttgttttttggaagtgaacataaccttgagactttattgtcttcataataaaacataaactgatatttaattaaatgtgcgaacagtgtttctttgacttgctgttttaatgttgctgtacacactgaggcaaagtctgtcttggctccagcattgcatagaacgcatactaaatccacgatagttttgttttgcatagcttttggctacttcagcatgtttcatgttcactgtagctcctaggtgtgtgggaataggactgaagagaatggttgtgttttttttaatttttaaattttttttacacgtagtctcgcactgtcacccatggtggagggcaatggcgtgatctcagttcactgcaacctccgcttccctggctcaagcgattctcctgcctcagcctcctgagtagctgggactataggtgcccgccatcacgcccagctaatttttgtatttttagtagagacagggtttcaccatgttggccaggctggtctccaactcctgacctcatgatctgcttgcctttgcctcccaaagtgctgggattacaggcgtgagccaccgcacccagcctgttttttttttgttttgttttgttttgtttttaatttaaggctggacccttgataatagtctttcattttaggacaagggtaagggagatacctagaacaaaacaaggcatttaacatgacctagatgtccactgctaagaatgcctgtctcctcctaccagcccctgctgtccctgtcttcccaagcaaaagcagaccacaggaatatctaactcaaacaattgtgtttacttgagttttttcttgggagagctatgtattaagctcttagctttttgtttttgcatggctctggcagaggaggctggtcagggataccacagaatgatgacacttcagcaaaactttagcagtatgtgcatgacatgttgacagcttctgacaggttttcctctcctgggatgaaggcataacaggaggctctgaatgaaattagaggaatttggttatgattaacacctgaacatttacttttcagttacaaacgcagtataggcagattttccacaactccaggaggcactatccacattgtattctatgtaaataacccctcctctttattttagaattgaattagtaagtaataggcttagaggtgtgaaaggactgctgtattgaattttttagcagcttgtaatgtactttttttctttattgtggtaaactataacattttaatgtgtttttttaaaacaaagattttcatttaactgtgggctcctctggaatgttagcgagttacttggttaatggtactgaatataatacttcaagctcttaagagctgattgctcctagaatggaaaatacttgatatgagagctgctatttttgagttaagtgcaacttaatcttgtttggctgagtttgcatatcggccattgaaatgtaggtatcttttctgagcttcgctagttgaagctaagattgaaacttggtaagtttattttatctggcaaaacttgtcagaacagtttgatctcattacttatctgtatattcttgtctatttggaacagctctagagcaaactatcatatttctttgattctaagacctatgtattccctctcacattttaacatttctgaaattgtcatctgtacattgtgtcatatacattaaatgtatacagatgctcctcaagacggggctgcatctggaaaaccccatcataagttgaaaataccgtaagttgaaaatgtaagtccttttctttttgtaagtcatttttgtttttttttgaaacggagtctcgctgtgttgcccaagctggagtacagtggtgtgatctcggcttactgcaacctccacctcctggattcaagtgattctcctgcctcagcctcccaagtagctgggactacaggggcgtgcctctatgcccagataatttttgtattttttgtagagacagggtttcgccgtgttggccagactggtctcgaactcctgacgtcaaagtgatccacctgcctcggcctcccaaagtactgggattacaggcgtgagccactgtgcccaacctgtaagtcatttttgagtcaacgatatttttaatttacaatgggtgtatccagatgtaagccatcgcaaatcaaggagtgtaccgaatgagtatcaatttctcccagtgataggtcaaccctggtaagtcagggaccatctgctttaccaggtttcttttttttctccataaagctaataaaattgctgtgcccttttgcgtctataatatttggtagttacatgttttgttttaaattttgaaatactgatattgaaaaacagaagttttagttattttttaatgatttcaaaccacaagcttctattaaatcaaagtgaaattgccgtttgacatctcatccccctgccccaacccacacagcctttgatggttttggtttttccatcaacagttgttaagagagaaccagaaagaggcagtcagtaccccctgggaaacgtcagagaagtatctgagaaaggggagtttctgccattctcccctcgaacagattccgccaagcagggtctggttacatgagcattgcctctttcttagaatcccctgggcgtttgaggatccaccccgctccatcccttacctttctttaattcttgtaattggaagcaagaggttctttagcattgctgttgtgaatactgagaaacttggctctgaaagttgcttcagtattattgtaagtgctgtctagggatgtcattaggggtgttaatgggaaaccttaaacaaagacactttccaggtgctgaattctgccatgctgtaagtgtgctctctagaggacatagtcatattcatcttggttatggaaggctgtggttggccttgtaacaacctgcaataattgcaccatctagatcaagagggcccagatccgtgtgactcagaggagagagcaacaaccttagtaggttctgcagcttctcactgtatctgtccttaagaacagaattaacaaaagttctgaggtgagtagtgatgttaatgagagaaggaaagaagaaaccagagaaagcaagccagccattgtgattgtttcatttgtgggagagagcctcaggaagcagatgatgtttatatctttccactggcccaggattccttaggaaatttgtttggggactgtaacttttattattacctagatgaattgttctgagtgttgggctgggtgctgattagagtgcttcattcagtaggtggcgtttcacacaactttatgtttgaatcccttcctccctgcccctccttttctggtagatttaaaatggatgggcattatggccctgataggagtttggaggatttatatttagaagagatgaaagttcttgactggatctttagtactgtagattgaacacgtttacttaggattgcatgtgaaataggggagggagcaaaacttaagaacttgactttatggtgttgatatgatctaacctggatatagttcagtttaaaaatgccctttttgacattgggacagttggcaaaaatctgaataaggtctgcagattagaaatagtattgcattagtattaatatcctgattttgatcattgctttcaggatatacacactgaagtgtttaggagcactgtgtctgtatggttagggaaaaaatatttttacatctgtctatatattgctatatagaaagaagatgaagcaaatgtgaaatattagcatttaggaaatctgggtgaaggttgtacaggaattctttgtactgttctaacctttctgtaggaaaggttctgaaactgtcaaaaaaataccccccaaaaaatcctcctttctgcataaattccttttttatggaggtaggaacctctctttttttaaaattgtgagtccttttcagttcagttcttaaatgtgttaggttaagaaaatttgatacgcatatatttaaaatgcaagtcttaatgccagacccagctttatagtttttgtttgttttgttaagactagtcaaagttttgttttttatctttgaggtgctgctagtgagataatttttttttttttttttttttttgagatggactcttgccctgttgcccaggctggagtgcagtggcgtgtcttggctcactgcagcctctgcctcccaggttcaagcaattcttctgtcttaggctcctgagtagctgggattacaggtgtgtgccaacacacccagctaatttttgtatttttagtagagacagggtttcaccatgttggccaggctggtctcgaactcctgacctcaggtgatccgcccacctcagcctctcagaagtgctgggattataggcctcagtgagccactatgcccagccaagggaattctttagcatcttgaaacaatgacataaaattgctttatgtgccaatgtctaggttcctttaactagattgttaattgagaatttcttttataaacttactgccttttaaagtggcaaatcacctgaaagaatagaaatcagatgatagtaacaaaatagtttgagggagaagaagatgcattcaattcctctgtcstctttaagatggttgactatgattgcaaatatattgtaggacacataaaaataaaaatggttgtgttagggctgtagaattttaggcaagttttcatctttctgaacttacatgttgcttttttttttttttataagctgttcgtgtgattctgtatgacttaatgactctaacctttctttattctgcagagtggagactgctgcacggactctggaaccatgaacatatttgatcgaaagatcaactttgatgcgcttttaaaattttctcatatgtaagtgttttgaccttgactggttttgtactgcatttcttttcatatctctttgtcccttttctgcatttataacttttgtgtgtataasctaacaaattaacttggccagaatccagaggacctratgaaaatgtccarattctacacgttgctgtgtggttattggaaaggcatttattctagtttgggtactgattattcataattttgggcatttggtcttcctcagcatttaaggttctgttaacctattttcaaaatattattttttattgtaatatgctttcctaaaagtatttcaaactatttgtaacagaacttttacatattcccaggaagggaaagagagaaatgattcttcttagcttaaatatgagattgatctgggactgattgctcttattcacattcttttcttagaaccccgtcracgcagcagcacctgaagaaggtctatgcaagttttgccctttgtatgtttgtggcggctgcaggggcctatgtccatatggtcactcatttcattcaggtaagaacgattttctctcctggttgctgtggtacaaattacattaggaaaaaaccagctcagcaaggtggtccaagggaccctgytcctctctttaatctttatcagtagtttaggatttaaactcagacattaaatcaggacatgtaaagccattttaattttctggcaactgtgccccctctagataccgaaaaacagaatgccttaaccttggcactgaatggtgtgctgctgacgtacaagacccccacccactgagtaggcgcatggcatgcatgctgggattctttggcacagaagcttttttatcttttcctccattcttcctttacaaaactctgattgtgtgattaactatcaggagaggcaggattgagatctttttaaggaattgacctgttttattttccgataactgttgtctgcatggttgggtaaaaaccttcaacaatttgttttcctgtattgagagagaatctgggtttggtcagcaggagtagaaggtacagtttgaggaataaccagaaagtttgaagactccctaacatagtcttgtgcctttgtagagtattccttttagcataaatgtagaggtgggcctctgttggcatttgccactgttgagaactatccttatgttcaggcatctcctggcagggattgtgtgaaaaattactttagacactcaaaggatagggctttgatcgcttgagttttaggcaaggttagcccttaaataatttagtaaaatacagtcaatccttgttattcacagactctatatttgtgaattcacctactcattaaaatttgtaaccccaaaatcaatactcatggcacttttttttttttttttgagacagagtctcgctctgttactcatggcactttttgcagacagtcacagagtggtgaaaaagttgagtcaccctgctgttgcagtgttttcagctgaggttgaacaagacagtgctctgccttcttgtttcagttctcgtattgtaaacaaatgttcttttcatggtcatttagtgccacttcctttgtatttttgtgcttttaattggtgattttgctgggttttttgagtggaggtcttgtggtgtcgtcctgactggtctcaaactcctgggctcaattgatcctcgcacctcagcctcccaagtagctgggaatacaagcacatgccaccatgcttggcttaattttgctgttcagaatgcaaacagcatagtgctgaagtgctgtctagtattcctgagtgcagaaagaccgtaatgtgccttatgaagaaaatgtgtatattagataagcttcattccggcatgagttgtactgctgttgtaactgtgagttcaatgttaaggaatcaaaaataatgtcaaatgaggtgtccttaaacagaaacacatataaaagcaaggtatctattgatcatttgatgaaaatgttgtgaccttaggcttgcaggaacctacctaccttttatttccctcaggaacaagggtttactaattcattgtccactgtgattttataacataaacactgaataatgagaatcaacttcttcctttaaaggaaggaaggaacttcagtgtctacgtccatccttaatgatttctcttttttctaatgcctatagtttttcccacttggcgtttttaaaaaaagaaacacttttttcttactacaaagctaatatgtgttcattttagaaaattcagaaaacagactagcaatgagaaggaagtattttagaaacttccataatcccatcatccagaaataactactgttaacattttagtactttgcagtcttctgtatatgtatgtgtcttggtgttttggtgtttgggggttttgtttgttggtttttgtttttttgagacggagtttcactcttgttgcccaggctgaagtgcaatggcgtgatcttggcttactgcaacctctgcctccctgggttcaagcaattctcttgcctcagcctcctgagtagctgggattacaggcgtgtgccaccatgcctggctaattttgtatttttagtagagacggggtttctccatgttggtcaggctggtctcgaactcctgatctcaggtgatttgcccacctcggcctcccaaagtgctgggattacaggcgtgagccaccatgttttttttaaagtgaccaaagggggatcatttctatttgttctacagatggaatgtactttaagcacttgtcacgtttcattcatcctttctattttttgggcaagactcactcatagtttgacttgggtagttgtactgtagttgaaggactacgcaagccagaagagcctccagcatccaccatggtcctaactctgtgcttcaaggcttctgggttatctcctcagccccatccctgagaaaacactactttttctcctgcctccaggttataagcaaatgttaggaagttcagacgagtgtttgaacccaataaaggtctcttgcaaaataaatttgaaactttcaagtgtttaatgattgattgattctgactctaacaggctggcctgctgtctgccttgggctccctgatattgatgatttggctgatggcaacacctcatagccatgaaactgaacagaaaagactgggacttcttgctggatttgcattccttacaggtacgttaagggatttgtctaattttgaggggtgagctatattttcagtatctcttaattagttcccccccctttttttttcttttttttttttttgagacagagtctcgctctgttgcccaggccagagtgcagtggcttgatcttggctcactgcaagctccgcctcccaggttcacaccattcttctgctttagcctcccgtgtaggtgggaccacaggcacctgccaccacacccggctaatattttgcatttttagtagagacggggtttcatcgtgttagccaggatggtcttgatctcctgacctcatgatycgcccgtctcggcctcctaaaatgctaggattacaggcatgagccaccgtgcctggccctttttttcctttttttttgagacagtgtctcygtctgtcacccaggctagagagtgcagtggcgtgatcttggctcactgcaaactctgccttccgggttcaagcgattctcctgcctcagcctcccaaatagctgggattacaggcatgtgccaccatgccyggctaatttttgtatttttagtagagatggggttttaccatgttggccaggatggtgttgatctcttgacctagtgatccacccaccttagcctcccaaagtgttaggatgacaggcgtgagccatagtaccctgcctcctggcttttttttttttttttttttttaagatggagtctcaccctgtkgccaggctggagtgcagtggcgagatctcagctcattgcaatctctgcctcccaggttcaagcgattccccttcctcagcctcccaagtagctgggactacagcggctaattttttgtattttagtagagacggggtttcaccatgttggccaggatggtcttgatctcctgacctcgtgatctgctcgcctcagcctcccaaaatgctgggattacaggcatgagccaccacacccagcgcttttttttgtttttttgtttttttttttgagactgagtttcactcttgttgcccaggctggagtgcagtggcacgatcttggctcactgcagcctccacctcccaggttcaagcgattctcctgcctcagcctcccgaatagctgggattataggcatcaaccaccacgccagctaatcttttgtatttttagtagagatgggccactatgttggccaggctggtctcgaactcctgacctcgtgatccgcccacctcggcctcccaaagtgctgggattacaggcatgagccactgcccctggccctaattttgtattttagtagagacggggtttcaccatgttggtcagactggtctcgaactcctgacctcaggtaatctacctgcctcagcctcccaaagtgctgggattacagacgtgagccactgtgcctggccttcctggcctgctttctaatctcatataggttcattttgtttccccatccattaggggaaactctgtgagtagccactgtgactctacttttgtgtccaaaaatagccattgtgtacttgaatgaatgaggttcaagagcttaggtagcataacctattaatagtaggcatagaacttttaataaactagacttgagaatccgacatagttgcacccatactggcaattatcataggagcttctgttctgagtcttacagacagtgcattaaagctatacattgagatctattgtgcaggacactttgctgattctcaaaaaaagaaaggcacagctcttctagaattgtcataaaggaaacaagactcaagctatgtaataaaaatgtttgcaaaacatttraattagaacagcttgttctgagtgacagtctaatatacgtaggagaaattttagaaaggaagagatttagggattaaratttttgcatcagggcaagctagtttttgaaggcattaaggggtggaattatcagaaggaaagaggaaagtaattagaacgaaagaaatgttagagctggaacaggttgccctcctgttggcaggtgtccacctgcagaaccagtctcacctttctttgctacaaaggggagtcagtcctacatgactataaggttgctggccacgaggcactgttttgctctttatcctttttttctaattcctgatctggcctatattaccatcttacatcactctagctctgaaatgtttggcatgcctactttattttcttstaatctctgtaccctccctgaggtcatccatgattttcagctaagaggacaattttgcagctatttctataaaaaaaaaaaaaacaacgcagtcaggtatacattttattgaaaacaattacagcggaggggagagagatttaattctttagtccacgtttgttaagagcatgagtatgcctatatttcgggatcagcttttggatgaggatcctattcaagaattgatcrtaatactgtgttctgggttttctgttttctaggagttggcctgggccctgccctggagttttgtattgctgtcaaccccaggtaactcttttggtagtgtcttatgtgcttttatctttatgaatataccttctaaatgtagacsgtatacctgtagcccttaatctaatggtctttttttctaacagcatccttcccactgctttcatgggcacrgcaatgatctttacctgyttcaccctcagtgcactctatgccaggcgccgtagctacctctttctgggaggtaagtgtgaactgggaaacagggaatgggggctcctttttagccagaattctcactagtactccttccttacccctaactcctttgcgactattgagttgagattaaccttcattctgggggaagttaaggaatggctttaatgggattgctttactttgccttggcttctctcaagacagctttttgctgtgtcttataggtatcttgatgtcagccctgagcttgttgcttttgtcttccctggggaatgttttctttggatccatttggcttttccaggtaagacttagcctggaactttccagcagccatttgcctcacacttcttycyttccytttttttttttttttgcacttctttctgtactactttgggcagtgctctctaagccttcccattatccttcataggatggagccttctgccacaagtgaaaacaggctgcacaaggttgggcattgctaagagaaaatggtttgctcagacaccatttgtgtaaggccagtctggcagtggctgattgttaaaatgattgaaactcttccagtgaccagtgcagtattgtgcctagggaagtaaagtggtcttcaccctaggctgcagttctcgtgaatggtaatgttcatagggttcacatttgatgtactttcaagtgactatgagccagaaagtatggctggtttttttttctctgcaacttctgctgtatagtaacttcatctcttacatttgttaggcaaacctgtatgtgggactggtggtcatgtgtggcttcgtcctttttgatactcaactcattattgaaaaggccgaacatggagatcaagattatatctggtgagtgtgggaactagtctttaacaagcatgaaggttgaggcataccgttcagcagctgaacttaggttggcattggctgaacataggtggccaagctttgggagtgtatgtggtaggaaacccacggttttggaactgtgtaccataatcttcctcaattcctgaaagatttcagattttttaaaaatctgggctaataggccaggtgtggtggctcacacctataatcctagcactttgggaggctgaggccactggatcgcttgagctcagaagtttgagaccagcctgggcaacatggcgaaatcccatctctactaaaaatataaaaaaattagctgggcatggtggcacatgtatataatcccagctactcaggaggctaaggtataagaatcatttgaacctaggaggtggaggttgaagtgagccaagattgcaccactgcactccagcctggcaacagagcgagaccctgtctcaaaaaaaaaaaaaaaaaagtgtgggggccgggcacggtggctcacgcctgtaatcccagcactttgggaggtcggggcaggcggatcacgaggtcaggagatcgaaaccatcctggctaacacggtgaaaccctgtctctactaaaaatacaaaaaattagtcgggcgtggtggcgggcacctgtagtcccagctactcaggaggcggaggcaggagaatggtgtgaaccggggaggcggagcttgcagtgagcggagattgcaccactgcactccagcctggacgacagagcgagactccttctcaaaaaaaaaaaaaaaaaaagtgttggggggtggctatatatttacatatccatagtggctacctccaagcagaagtgagggaaagagatctttctccttttcctatttatacttctgtattttttaaacaatgagtagaagatacactctttttttagagacagggtctcgctctgttgcctaggcagtagtgtggtgccatgaacacagctcgctgcagcctgaatttactgtgctcaagcagtactcctgcctcagcctcttgagtagctgggacaacaggcacgtgcgaccatgccaggctaatttattttttgtagagatggggtcttaccatatgcccagattggtctcaagcagtcctcttgccttggtttcccaaagtgttgggattacaggcttaagccaccatgcccagccacttttttttttttttttttttttttgagacagttttgctttgtcacccaggctggagtgcggtggcaacatctcagctcactgcaacctccgcctcctgggttcaagcgattcttgtgcctcagcctccctagtagctgggattacaggcactctccaccacgtccagctaatttctgtaattttagtagaacgaggttttgccacgttgccccgtgaggacatggtgtcgaactcttggcctcaagcaatctgccttcctcagcctcccaaagtggtgggattacagacatgggccaccatgcccagctcacttttttttttttgagacggagtttcgctcttgttgcccaggctggagtgcaacggtgtgatcttggctcaccgcagcctccgtctcccggcttcaggtgtttctcctgccttaacatcctgagtagctgggattacaggcatgcaccaccatgcccrgctaattttgtatttttagtagagatggggtttctccatgttggtcaggctggtctcaaactcctgactcaggtgatgcccgcctcagccttccaaagtgctgggattacaggtgtgagccactgtgctcggcactttttttttaatgtagtgattctctcagtctcatgactaattagtggtagttaagggttcagacktggacctctgcagagttcagagcgcttgagacagggcttgctctgtcacccaagctgcagtaggagagtggcactgtcatggcttactgtagactcaagctccctgggctcaggtgttcctcccatctcagcctcctcagtagctgggattacaggcacatgccacaatgccctgctaatttttgtagagacgggattttgctatgttacccaggttggtctcgaactcctgggctcaagcagtccacctgcctcagcctcccaaaatgttgggattacaggcatgagccactgtgcctggcccagtctcttttctctatgctgcatgacttcgatgagtctaaaggatctcagacaccagagttttacttccttagttgggggtaaagtgtgggagaagctggctcgtgggggtrggggtggggtttatattctgcatctttgtgggcttgtggataaaaaagtctgaagtacagatcctaatctggttcttgcctttcaggcactgcattgatctcttcttagatttcattactgtcttcagaaaacycatgatgatcctggccatgaatgaaaaggttagttagcctacaacccaaagatgagacaataatggctcctgagcttggcatgtgtgtatacttcagatttgaaaacttgctcacacactgtgttaggtccagggtaactgtaaggcaggccactgagtaagaggtaagccagaagtcttcagttgttagaaaaaaagcagcaagtgaaaaaaaaatttttttaactaattcctgcgtttagtatgaaagggaaaaaagcttcagtggcagtaaacacaacctgctacatgaataatttaaaggctatatagttgtgactcagagaaaggtattgtggaggacgttgtaaatttcagaagtagactaattttatccatttgttaatttttttttccaaggaagcattctatatagggctaatgagtatctaacgtagttgagtcaagcagtgggggaaacaaatgaaatgagcttttctttatagaccttatggagcttagagatagcatagtggtagcgggagtagttgaccagataggattgctggctctgtctgggctatgccatggttggactgagcactaggcagatgtacaagtttcagaacaagcaactgaattttcattccttaatacattgggcttccatccaagattgaatgaagaattctgctggaccaaattatttctgaatgtcagtttatgccagagtcatgctcactttgcagggtggagcacttctcgcgcctaatggttggttggtggtcttggcctctagtttcactctttgaggatagagtgccatctgcagccttcactgttgggatctgagctgtagtggctgtgaatagcctagagtggtcaggcagcccacctcggcactcctggggtgggggtggggacagctgcttaacctttattcttggtcggtctgtcggcaactttgggaaccaccagtaggatrtggttaagattcagttcttgctgagctaaggaagcatttctcatttctttttaattgtctggctcacttctagtccctaactaaatgctcactcaagagttttagcttgaatgtcaaatgtcaaaaaattaattgggtgatytttctccatttctaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcarccccatctgtagcctcttcctctactcaggcagtcgacccrccacgatgagaagtgggaccagcagagggcgccaacttcaggagtccgctttcccaccaggcttcattcacccagtggacctgaactgtttggtagagccacccggcccttccttcctcatygttgtttggtatgcgcacagttcctgtgggactgggccgtgagttttccattggaaagaagttcagtggtcccatkgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctytgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaaraargaaaaaaaaaaaaacacctacttttaaagaaaatrcctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttcctggtgtttgtgttaaattcaagggtacagctggtcatggagcttgtgatactgccagggtttgctactgggggctgggagtgggacacgattgagttcgtgtcataagtatgaacagagacaaagacctcccactctgtagccccagcatgccacaaatgttgagaattttctctgtcaaatatgtaagccagttttttttccagtcctctccaccccctgccacctttgctatatgttgtttgtggtgatatgtgcagttggttcagatgtgcagccaagctttggagtttgaggatgcataatggaaaaaaggcaaatgatacccactcattctgcaagtatttttgttcacccactgctgcccggctgtattctaagtgcattagttaataaagatgtaaaagttggccaggcatggtggcttatgcctgtaatcccagcactttgggaggccaaggtgggcagatctcgaggtcaggagttcaagaccagtctggccaacatggtgaaaccccatctctactaaatacaccaaaaaaaaaaaaaaaaaaaaaaaattaggcaaagtggcaggcacttgtaatcccagctacttgggaggctgaggcaggagaattacttgaacctgagaggtgaaggttgcagtgagctgagatgcaccactgcattccagcccgggtgacagagaaaaaaagtcggccaggcgtggtggctcacgcatgtaatcccagcactttgggaggtcgaggcaggcggatcacctgaggtcaggagttttgagaccagcctggctaataaggtgaaaccccgtctcaactaaaaataacaaaaaatagcccggcatggtggtgggcgcctgcagtgccaactactcgggaggctgaggcaggagaatcgcttgtacccgggaggcagaggttgcagtgagccgagagcgcaccactgcactacagcctaggcgacagagactcccatctcaaaaaaataataaaagtccttgtcatagttcagatatgagattatcaatcggaacttgcattacaatcaggttgctcaattctgtgtttgtgtttttgttttgatttttggagacagggtcatggtcttgccctgtcacccaggctgtagtgcagtgatgcgatcatggctcacagcaacctcagtcacctgagctcaagtgatccacctcagcctcccgagtagctgggaccacaggaacatgccactgcaccccgctgatttaatttttgtagaggtgggatctcaccatgttgctcaggttatgttgaactcgtgttcctcaaacgatccaccttagcctcccaaagtgctgggattataggcttaagccaccatgccgagcctagtagctcaattttaccatgcttgttctccgcttgtcatattcattgtagacccaggccttcctgttagaatttgaccattattctgactggttcatctaggttactcccagttgacctgttcggactccacatgtgcccgtgccaactaaggatagccattttccttaagcttgggaaatattccttaagcatcttttctctcttgctgactttgagaaaagactggtcctaaagactctttaaagcccccattttatctgctaggggagaagtacaaggtgcaacaccttttgagtgtttacaaggtcaggcactgtacaaagtgccttacatggattgcttaacatccccagtagtttaagaagatggtgtatttactacgtacggtcagttacttccagggctggcagatgtgtgcccagaaagaatctaggcacactatctccagagcccctatcctttactgttaacctatgtaagcagtgttaaggttagtcctcctgggctggagtcatcctttccatcctgacctacatcctggctatggctctggccaagggtggaaagggaaattgtgaaggggtttgagcaaaatctccccaccccaaatctttgtaaccaaagaaacgtagaagagtgagcggcctttttagtctttcttcccccagccagcccaccaattaccaattaaatggaagaggataacaaacagcagctctttccatgtgtaggagacctgcaggccaaaactagaccaaggaagaccctagtgggcggcagaagtggaaggtcctctgggttgaaagaagaaacagtattttttttttttttttggagatggagtctcactctggcccaggctggagtgcaatggcgtgatcttggctaacagcaacctccacctcctgggttcaagcaattctcctgcctcagcctctccagtagctgagattacaggtgcatgccaccatgcccagctaatttttcatatttttagtagaaagggggtttccccatgttgctcaggctggtctcgaactcctgacctcaagtgatctgcccttaagtgatctgcccacttcggcctctcaaagtgctggattacttacaggcatgagccaccacgcccagccaagaaacaatatgttctttctaagcatggtgagcagatgaggggatctgtcttgtttaagctggggataaagatgtagaagacagttcctgccttggagtccttcaccactgagtagtgctggagagccacatgtgaacattacatgtgaataggagttaagcatagtgggccatgagacaacagcaggagacacagcctggtctggtcggtcagagaaagtgctttgtagatgacacctcagctaagtctaaatctcaaagtttgagtcaaagtgaggcaagtgaagagattaagaaaggcagtgggagtggatgtttctgatcaagggatcagcacgaggaaagacaggagtacgctccagcatggggagtgcaaggaaggagctgcaaaaacaggttttgctaactaggaaagttggaggaaactagtaggaaatggagggggtaagtcaacagttactgaagacctggtatgaggcactgttgcatcaaacctctgatgaagctgggcgcagtggctcacacctgtaatcccagcactatgggagaccccaggcgggtgaatcacctgaggttgggagtttgagaccagcctgaccaacatggagaaacctaaaaatacaaaattagctgggcgaggtggtgcatgcctgtaatcccagctactcaggaggctgaagcaggagaatcgcttgaacccaggaggcaaagattgtggtgagccaagatcgcaccattgcactccagcccgggcaacaagagcgaaactccgtctcaaaaaaaaaaaaaaacaaaaacacttttgataatgaaagtagataatgataatataagaatggccactaatgccgggcgcagtggctcaagcctgtaatcccagcattttgggaggcagaggtgggcggatcacgaggtcaggagttcaaaaccagccttaccaacctggtgaaaccccctctctactaaaattacaaaaattagctgggcttggtggtgcacacctgtaatcccagctactcaggaggctgaggcaagataactgcttgaacctgggacgtggaggttgcagtgagctgagatcatgccactccactccagtctaggcgacagagtgagactttgtctcaaaaaaaaaaaaaagaatggccactaacatcatattaagacagacaacctgacatcacataccttctgatagaagtaaatactaccaatgaagtgtgtattttttttgtttttgtttttgtttttttgagatgtctcattctgttgcccaggctggagtgcagtggcatgatcttggctcactgcaacctctgccttccaggttcaagtgattctcctgcctcagcctaccaagtagctgggattacaggcacctgccaccacgcccagctaatttttttatttttaatagagatggggtttcaccacattggccaggctggtctcgaactcctgacctcgagtgatcagcccacctcagcctcccaacgtgctgggattacaggagtgagccactgcgcccagcctaccaatgaagttttcttaacaacaacaaaaaaattgaatctgggctgggcacggtagcttacacctgtaattccagcacttcgggaggctgaagtgggtgaattgcttgagtccaggagttcgagaccagcctgggcagcatggcaagaccccatctctacaaaaaaatataaaaatacacctgtggtctcagctacttgggaggctgaggtgggaggatcagttgagcctgggaggttgaggctgcagggagccataaacgcatcgctgcactccagcctggggagaaaaaattgaatctgaatcatattaagttctgtgtgaggtaataatacatacgtcagttcactagatttaatcatgccacaatgtgtatacacttcaaaagatgttggacacatatatggttttatctgtcaattaataataaaaagaaaactttaagttcaaactattggtttcttttttcaaaaaatatggcaaagaacaaatccaaaaagagagggaaggaaacctagacattaagagacttataagccatatcaacaaaatgcaatcaatgatgtgatcttgtttgaatcctgattcaaataaatcaagtatagccgggcgcagtggctcacgcctgtaatccaggcactttgggtgaccgaggctggtggatcacttgaggtcaggagttcaagatcagcctgaccaacatggtgaaactctgtctctactaaaaatacaaaaattagctgggtatggtggtgggcacctgtaatcccagctactcaggaggcggaggcaggagaatcgcttgaacctgggaggcggaggttgtagtgagctgagattgcaccactgcactccagcctgggcgacaaagtgagacttcgtctcaaacaaaaacaaaaataaacaaaaaaaccaagtgtaaaaggaaaagaaaaagggagagaattggagcaatttgaaccccgattcacattctccaagatggcccccaaggatcctcaccttggtgtgccctggtagagttctccacattgaggcaggctggcacgcatgaccaaaatatcactgcagaagcgtgtgtggcttctgaggccaggtcttcagaggaattgcagcttcctccttgtctccttggatcacttgctctgagtgaaactaagtacaggttctgaggccattcaagccgccctgtgtggaaagccttgaagtgaagactggagccccctgcccacagccagcaccgacttgccagccagtgggaaggagccaccatgaaagcagatcctccagtttcaaactttcaggtgactacagtctcatgagacactgagccagaactgcctcaccaatctaccaatctgtttctgaatgcctggcccacagaaactgtgagcaataatacatttattgctgttttaaaccactgtgttacacagcaatagataacagctcaaacactgactacatgataaagaaatattattaatgcataacgctaataatgttatgattgcattcttcaaaagttatcttttaaagatgcatactggccaggcgcggtggctcacgcctgtaatcccagcactttgggaggccgaggtgggcggatcacctgaggtcaggagttcaagaccagcctggacaacatggtgaaacccggtctatactaaaaatacaaaaatgagccaggtgtggtggtgggcgcctatagtcccagctactcgggaggctgaggcaagagaatcgcttgaacctgggagtggaggttgcagtgagccgagatctcaccactgcactccagactgggtgacagagcgagactccatctcaaaaataaataaataaataaaaattaaagatgcatactgaaataagtatggattaattactatgatgtctgagatttgcatcaaaatactcagttgggcttgtggagtgcctggagtgagggttctggatcccacccg

SEQ ID NO: 12274 - DNA, 81441 bp, Homo sapiens
ataaggcttggtaagtttttgctgctgtagtcactgtttttagatttctagaagggtagtgaaaaggtcaaaaacaaagagcatgtatgtgcatgtttttatcttggtgaccttatctataagtatacttttttactctattagaaaaattaattgattaaaataataagtgaattattagtgtattatctagagaaatgaattatttattgaaaatctttgttgtgccaggcactgagtacagtgctagtgggattatgggaacagatttgaactccattatctggaagaaacatatcccatagaaacaggttaaatgcatttcctgagtctggccatgttaattgctgggttgagtgactatagccacaaagaaggggtggtgaggtcatatccaggacgcagcatgggtctcatcagaggacacagagatgtccagggggcatgacctgggttggaacttgttcccaggtcaacaggccaagagcatgtccagttttctaaaccctgtgtttacatggcagaagctttgagtgatccacaattggttaatcacaaggatgtttacatgaagccagtgaaatgagaacctctgagggtcagaggcccaggagacagctattgtgctattgatttgtttcttaacttcagaaaggggaagctgatgccatgagcttggatgcaggattcatctacatagcagggaaatgtggtctggtgcctgtcctggcagagaactacagtaagtggaggggagtgtccgtctccattttttctgtccacagttcccctgggctgtgggcatagaaagatgaggaaataacttagtttagtgttgagataataactattgttggaatgtatggagctagtagaaaaaaaaagtctccctctcctggagccagaaacaattaagatatagacaaaggaatcaggcagaaagagatcaaaataacacctttacttctgagattgtgatactggagtgtgtgatgtagagctggcacggggctgcaagtcacccttaccttaaagttgcccactagttcaggaaaacgggtctgatggcttatgccaagactaagggcaaagggaaacacattttatcataggtgagaagacccaaacaactctctccccattgtcttcaagaaagaaagaggggctgagccacatgtgctcatgatccttcacccagatgcactgggtggttgagaaggtggggctgcaaggtcatgttctttagtggggatccatccacatggaaaaatgaagctggtgtaaaagagggtttccctaatatcattgattacacctcatctgctacattatctttcaaaacaaaacgactctgtgaggtaaatagtggtatctccattttatagctgtaaaaactgaggcttagaaaagataagtgatgggtcgggcgtggtggctcacacctgtaatcccagcactttgggacactgaggtgggtggatcacgtgaggtcaggagttcgagaccagcctggccaacatggcgaaaccctgtctctactaaaaatacaaaaattagcggggcatggcagcaggtgcctgtaatcccagctacagggaggctgaggcaggagaatcgcttgaacctgggaggcagaggttgcagtgagctgagatcgtgccattgcactccagcctgggcaacaacagcaaaactccatctcaaaaaaaaaaaaaaggataaatgatgtttccattgtagaataaagactgaatccagatctttctgactccctggactgggttctttccctcccgtatagcaaaaataatgattgcctaccacagtctaagactctgaagggaagaaagatatcaggatgacttattacacagctaatgcaaagggatatgacctctccctctcttccccttcaatgagcacctccactttctttgcctgcatctgctagagtactggggagattttgggatggaacctatcttcaaataggaaagagcagaagagggtaaaatgggcttgcagaaccttaacccactgatacccaatgataccttgctcatattattattgactattgagattgagaagctcctgactttggatggagtaatgtgagggtttaatgtcatgtaccttgattgtttttctttttctttttagagcagtttaggtctaagtgtgtgaatttacccatggaaggtgagttagaatcagtaatactggctcaaaggtaaaggcccattgttggggagaggaaagcttaaaaacaaataaaaatgactggaggtggaaaaaaattcacagttaattgttaagatgcaaacctatcctggggtgtaataatactatttgcagggcactttatagttggcaaaggactcctgtttgcactattcctgttccctcttctcagcaaccctggagtatgtgggcattgttgtctcatgttatggagctggagtctgagactcagggactgagtgacttgcccagggccacactgccaggaggcggctgcacctgggtttcagaagaggaggaatggctggaaaccccaggcccttcctggcaccacactgcgcctgagcacatgctgcctgcccatctctgtgtgaaggtccacactggggcccattcctggcatttctggactaagtagagacctcacgagagaaggagattcatagatgctgataatgaagatgaggaggaaaataaaatccacctttcagcttttagccagctggagcttgatggcaggggagttgatcagtctttagagtagaagaccaccactaggaggcaagttcctccgttttgtgcctccagataagcagagagggtctgtctctagtacctactcctggaaaatggatagaacagtggttctcaggtgtagtctctggaccagcagcatcagcatcccctaggagtttgttgggaacaaaaattctggggctccatcctagatctgagtcagaagctctgaggctggggctagcaatctatgttttaacaaatttaatgcgcattatggtttgaaaactgctgtgatagagaattccctgaggtgaaaaccaagtgcatacttgggtttagagtttcttctgaggcaggagggctggggaagttgagggatttagagcatcacagcacaaggagctgtggtctctgtcccctgctgagcactgggtcataggaccctgcacagcccaccctgcacaaaggccactggagtgcaaagttgaggcatcatttccctgctcacctgcagcagctccccttcctgtgtggcaggaccccagcccggggatatgctgtacctcatccctctctgctgtcatgtctaagaagccttctttaaattgtgtcttcatccctaatcctgaagtccagcaaacaatcttctatctgctatgtattctattctgatcatttatagtcagaaacaaccctaactgcttcaagagtagttgacatattcagaaactgcaatgatacacaaatgtagatcagcaagcatacttagaggatggtttagtcaccagcagagtgactgactgtgatggagaaggtgccatctgagtagagagggggagagttaacctcagagtcacacacacacacacacacacacacacacacacacacgcatggaaagatggatgacaataatgaatgccataggtacagaaatagtggcattgaaggaaggcactatgacagcatttggctaccagactggtgtcatggaccgcagtgtggtaggcaagggcttgccatggcctcaggagaacctgcttcactgggaggggcctccagtcctgcttctgcactactgctggaaagccacctccctaacctgctcttcccattcctgatttgcctgtgctcatatctgcacctctgatccccatcagtcactccaggaggggttccactgccaccatttaactgaagaaaaatttaggctcctagatgataaggacgtgtctgaggtcacctaagaaggacaagacggaccttccatctgccatgttgactcccaacttctccaagtttgaatttgtagagacctgatctacaacacagagaaaaggtgtgtacgtggggaaagcagggagtggtgagccgcattatcgtctaattctaagaatttatgattcaaatcttatgattcttttcagtttgcagttcaacctaactcaacaagcacaattcagttatatagtattggcactggaataaatgaaatattcatgatattctcattagaatcaggagcaaggcaagaatgcccactcccaccaaagacattcagcattatattggaagtaaatgcagtaagataagaaaaagagttgggtttttaaatattgggaaagagaaaagagattaaattgtcattattagaaaatattattgtaaacctagaaaatcagagacttaacattaaaaaataactcattaaagctttcttttgaacttatattcaacagaaaaacttaaacaagtgcatactcataattacaaacatttatagaaataaatgggttttagtaggggaaaatgggccacaataaaaatacctactagtatagatatgatacatccatatataataagatataacttagattcagccaaataaaagaatgatgtagccatatctatcactactgaatcaaagaagtgtccacaatatattattgaggaggaataaagcaactcacagaaaataatgcagcaagactccgtctcaaaaaaagagaaaataatacatagcaagattctattgaaaaagtacggtgtatgtaaatatatgtgggtgcatgtatgtagacatagctagggagcagtagtgttagtctgtttggctcagttcctaataatggtagctattgggagggtcctctactagagtaacatgaggggttcaagatattccctctccccagggagagtgacaggcaggggctagcagcagtagctctaaaatatattttcagagtgccctggaggtctgataatagtatcttggcaccccttccactaatatatatatgtaaatatgtgtgtgcaaacatatatatataatttataatgtgtgtatttataaatatgtatacttatatgtatatatgtataaatacatagtatataagtaaatactatatgtatatatttaaatgtataggttttttttttttccgaaagagcaacttgctgccagcaaagtcttctctgagatggtcttgctgtctgcttgaaaggacagacagagtacatcactgaggggtcagtaaagaaatgaagcactattttaagcaggaagggatttaatacagggaattaaatgttaacaaaaagtggacactaggttcctggaatgactcccacccatagtgaaagagagctgactccctaggagacctactacctgcaagacctctactagtacagtgatttcaagacacatcctgtagctgtgaccaagggataggaagccagaattgatagtggctgctgctgctgcatttgctgtaatagcttctaatcctctaggatggagaagggatactagagatctggacagaaaaacctaacatctccaagaatttatttcctagcagaaaagaggtgagggggaaggcaaagacctctatgtgacttccaccttccaaatttcacacatccttttacactaagaacacagctgcaaggaaacattggaagtgtagtttccatatttccagccagaagggggacaggatggaaatggagaataccagctccagcatagccaccatatggagatggcatttaatggcccggtgcaggagggctggccagatctcactggatcgtacattcttcctcctccttccccttctctccctgaaaaagaagaaattgcatcttggtatttcaatttctaggctattatgtcatggctgtggttaagaaatcagatgctgatgtcacctggaactctctttgaggcaagaagtcctgccacactgcagttggcacttctgcaagctggaacatccccatgggcttaatatacaatcaaaccgggtcctgtaaatgtggtgagtatgttctgggaggtgttgtggcagttcattccctgtgcctgtgcctgggtaaaggagaaattcagtttgatgaatggcagaaaatgccataaatgggtggtgagcttaagagcttgacagaaattgtgggcgagcctcacatctccttgagcaggtcctcctccttctcatccttttgcttctgagggaaataccttggcccaaagggcagatctcagggaaatagctctatttttgatgtctcacaaatggctcagggaacaagcctgggttcgcaaagcaagaccagcctggatgcgttggtgmgcgcgagtgtgttgttttcacatataaaccgaaatggctgccttcttaattggaaaccttccaccagtaagtcctggagtgctgtttttcatgttcatcctcatctctcccatccaagtactagcaaggcctgaccctgcttagcttccaagatcagacaagatcaggcgcattcagggtggtatggccgtagaccatcctcatctctcttagatgcattcatcatttcagctatgctcatgccactacctaagaggctcctgctcctctgctttccccaactctctgaaaatcccagccctgactgaaccctattacctgctctcttttttacctgagcagctgaacgtggctggagagcgtcacagcgcggcagagcagtttgtgtcactggaatgcttcaggcactgtcgttggtgtgcccccaacatttacaagcgcccccaccacttctctgctccacatgccacatttcccggtgattctcctaatgtcctaattgtccacacacctcaaacccacaccatctaccacctttcttagcagaccatttcacctgcacctgcaggagacaaagaaaccatcagagaagtttctcttaacatccccctgccaaaactgcgggcctcctgggggctgcacctccccacctcctccctccgcagccaatccctctacctgcacttgggtgcgggtcactcccatgttcccttccatggtctcaaccctcagttattacttctccttctggtgtgtccaacaatttctctcaacatgtaaacacaccgaatgttttccatctttaaaattggccccccyacaacattctcctgcagctcctgycttccttccctcctcctctttaaggccagagtgatcaaagtgttgttggaaccactccccttccactcactcytcaactccctgccgcctggctcctctgcatcactcctcaggaaggattctggtcaagccaccagtggcctccatactgctcagttggaacgatgtgcttctgttgcttcccccatgacctctcagcagcatttcctcatttcgccctaaaataatatctcctggcttttatgaaaacacactggtttgtttttcttctattctcacaaggtccccatttcccaatctagttaagaaacgtttgcgttgctaaatgaaactctttttcccaatctcaacggaatccccaagcactcacatccaygcccacagcctcaattgccatccaaaggggtgttacacaaacaaagctaggcacatgataagcactaggtaaatgctttttatctatctctgtgttgataattgtcaacacagatctctcaacacagatccccaacacagatctctccttagcctccagacatgtatgtatttaactgcctatttgacatctctagatggatatctcaaaagcacactaagctcatcctgttcaaaactgaatgcaccatccctgccgagcctggtccttttccagaactacctggtgtggtggaggatcctacagtccatcctcttgtgcccactggaagcctcatcctccgcatagccatctatctccaggggtgccaatttctcctccttccactcatctccctcccctttgtgctcctctagccccagctgccctcatttcccctgaacttctccaggagcctgccacctgaactccacatccgctctggtttccatccaccctgttgccaggccaatctttgcaaagtgcagatatgaccatatccagcttactgcccctggcccagcattgtctaaaacccttcacagacttctcatctctctaacgataaagaacaaaactaatgacagtaaaagggtctggaccctgccccccactgcactcaccgtcattttcttggtggtttagtcctgaaggcctccatgaggctctctgtgccgtgcctccaccccaccccaacacaggcctgtgcagatgctggtcccctgtctggagggctcttcccctccactcttcacttgggtaactcctactcactcttcatgtctcggcttaaaccttctccctgacccctagggctgcaaggggctcttttattgtagcttcatggaaccctataattttttcccagagcaaagagggaaacatgaatttactggtgtggttacttgagttctgactatcgccctacaggctgcaagttttcaagagggcagagcctgtgtctgatttcctcatggtggtgccctggagcccagcacagggcttggcagctgtgcctctctagactcttcctggacttgaagctgtgatggcacaccttgtgaaaaagggcaatggcagcagagcccagaaaacatgtgctccgggttctgcgagccaggacttctcttttgtcccctcactgttaaactctgtgtccatctttcgatgccactgccctgtgctgggatggagtagacccctgtgagctcacagacccttgatccaacttgagtcagttcccctttacttagctccagctggaaccttttttttttaattccataaagtcttgcttttaataatatgttacaaataactgaatgtgtctttatcaggcaattttggggacagaatctgaggctttcttgctaacacaggcagggagggctgatcctgacctctggttgtcctttctcgcagatgatttcttcagtcgcagttgtgcccctgggtctaatccggattcccctctctgtgctctgtgtggtggcaggtgcaatcctgcccacatatgggcttacaacagccaggagagatactacrgctccagtggggctttcaggcaagtaatgtctgtgcaccacctttatctttgcaccaagccagtacatttcttgtcctgtcacttcttccatcatcccagcatctggctgctgcatttggaaggagccagaatctaggaaacagaactactgcaaactttgaatggctccaatgactcaagtcctgctcttctctagggcactctcctgcagacccagatgatttagggcaccttasggcacctagggagaagcaagaatgatggcggcagagtcacaactctagttctacttttgccactttcttctgtgtgactgtggacaagtcaagaatccatcagagccttggtttaaaatcacaggggggacaccagacacctcacttcttacacttggctggtaagtatattttaaaaatagatattcctgggctcctccatccattcaagaaatatttattgagcacctaataggtattgttctaactagaggtgttacagcagttaagctgttaccaaccatgggttgttgggctctcaatgcaatagaaattgtcataaggccaagatagttttcccagacaaggctttgttggagcttatgcccaggaatatgggaggcaacacaagagagagagaattttctggctggctccccagagggtgttgaaaaggaagttgtaaaggggcygcggtgagaaaggagtgatgtctaggaatgtagaggcagggaacttttagcacctccacagtttgatgacatgcttcttcatgcatcgcttgtcttataagcatgttacatctccacccctgggtgtgatttttagtattataatgaagctaaagttaaggatcagtcattctcctggccttgcgtgcatgtgggagatagtaagatttatggtgggagctgctgcttttagcttcctcagggtccggcagtcagcaggtatggctccttgagcaaggtttatgttgcaaggtctggaggggctggttggggtccctgccacccatggggcctcccctctaccagtttgcagtgaggtccttggtggggtatggggggtaccaagtcctgtccctcttctgtctcaaagccacacataatacctgtccctcccctgctcccagtcttctggggaaagtaggacaacagcacataaataaagggcaggatactttccaactgtaagtgctactgaggaaccaagggaggtgatgcatcagcaaccagttttagaaatttcagaaaaggtggtcagggcaggcctcagcaggcagaggggtcatgtgggaatcaggcctgagaaaacctggaggaagagcaacgtaggatgaaggaacagcaagcacaaaggcatgggggcagggcaagtcatgctgtgtggaggccagagaagaaggtctgtggatgagggcacagagagagaggcactggctgtctcggagccctgttggcctggctaaagacgtagatttaactctaggtattgtgggcagtgctggacctttgaggaagcagggcagtgctgtatgaatgagttatgtgaacaatgtatgaggctctagaaagttctcttttattcatagacaccagggtattccactaccagactactttgtcctgccctctccaaagttttctctctttcataagccatgcataaattacatattttcacagatctacaacaacatatactattattacattaaatctggatgaaattgcttaatttttctttacatcagaaggtgcattggtgttaggcttgatggtctgtctagaaccacaacttcttccaaaatgaacatacacataaaaagcagtcttagcttcaaacctctcattctctccatctcctacctgtcttttcacttccttgagttgtttttttgtttgtttgtttgtttttttgatggagtcttgctctgtcacctaggctggagtgtggtggtgcgatctcggctcaatgaaacctccgcctcctgggttgaagcagttttcctgcctcagcctcctgagtagctgggattacaggtgcccactaccacacccagctaatttttgtattttgagtagagacggggtttcaccatgttggccaggctggtcttgaactcctgacctcagatgatccacccgcctcggcctcccaaagtgctgggattacaggtgtgagccaccacacccagccctttaagtttcttgactcctctagccattcactcctggctgacctgtgatctatcaatcccgcacctttccccgtggtctttttttccatcctttctgagcatacatttcacaatcaactgtgcctgcacttccagcctggctggtttccctttaagtgatgaggaccttgttaaatgagccatgtatctctagtcctcccactaccccatttctcctagaagacaattccatactttctcctctccttaagcctccaacacttcttcccccacctttcatacctttgtttcctatttctcctaagaaaagaaatcgaaagataaattctacaacaccctgctgccatatctacccacatgccagcatctgtggccctagtcactgccttccctcctcctactggggtgaactggctgtctcctcgctaagtcctgtcctgcaccggttcaggattgttgccctggcagttctccctttttctgtggcagcatcaaatcttcttctctactagatcatttccatcagcatacaaaacatgctgctatgtttttccatcttaaacacaaataactaagtaaaacctctccacctcactttcctctcccatttctcctcttctttttacaacaaaattccttgaaagagttaaatatctttgctaactcatatttctcccctttaaatctccccaggacccagtttaagaatctgttcaggccccaaactgccaacatggagttggttttattattgtttttcaatgatctacagaaaatatacctctttattgtcagagtatgggcagactactcccaccactccaacccccttggtacaccaccgaccactgtggagatgaaactataccagtgatctctgttgctaaatcgaaaggccagttcttggtccttgtgttgttgcaggatttttaaggaatcagcttacacactctttaatttcttttaattcctgttccagtgttaattgawctaccagcatcactggcagcccccatcacttcctcctcttggatttcttccctggcttctggaataccacactctcttggattctcccttccccctcctgacactgcacctcagtctcttttgctggttctgtccacttccccagcctctacatgctggcatgactcagggctctgtacttggagttcttctctctgctgcccattctcttggtgggtttatctctgtatgctgacaattcccaaatttaacattctagttctgacattttcctgaaaccccagacctgtagatccagctgcctactggctatctccacttggatttctaaccaccatctcaaacttaaatgtccaaaactgagctcctgaaactccatacactcccacccaagtgctgcatcctgtagcccacctcatctcagttaagggcaactctatttttcattttggaaaaaatgtcaataccttgctgctttctgtgcctgcccttgttctctctcaccccatatctcgtccatcaccaaattatattggttgtaccttctcaaggtatccagaatcgatctctctgcccatctccactgataccattctgacctaaaccaccatcgtctctccccagatttttatcatagccccttgacaggtctccatgcatctgtcttgtcccactctcctccacaacacatgagccaaagtgattctgttaaacttaaagcattacattaatacttctctgctcaaagcccaccagtgatttcccatatcactcggagtaaaagttaaggtgcctctttgatctgtaaggttctttgtaatctaagaggcctttgcaacctcatctacttctttccctgtgcactctctgctccagtcagcttggcatctcggctgttccttgaagacctcaggcacactccttccccggggactttgcacttggtcctacccccatctggagtgcttgtcttcctcagatcatcatggctagtttcctcattttatttaggatttctcagggcagactttcctggccactctgtaattttcaacctataaacacacatgcttgcacatacccttgccaatacttcatatccccctttcttgctttatgttttctttagcacttattactctctagcttgctatatattttktctacttaccttgcttcgtgtctcttttcttctgtagaatgaacaaggaccccgttggttgtaagtgagaaaacctcatgtgaagcagcttacaccaagggcactgtcttgacaggtgctctgggtgctccctccttgaaagggctgatacctgagmctaggaggccaacgaaaattctttaagggtagggttgccacatacaattcaggatgtccagttaaattagaattccaaatagacaacacatgattttttaatataaggggatacactctgcttctcccgtctgcttgtctttctctgcacatctgcctcattgttcttctcccctgcagggtgggttttggtttctcaggctacctggagggaaatgtttgcaaccagcagtcccaatgttgttacagttcatcagttataaaggagcagtcaaacaaagaccatagtgtattcgtcccaatgctcaggaagggggattgacacaacagtctgggcgaaagcttcctgttcacwcaactcatgcagtgaagtcacattgtaaggtgacagctgcctccactgtgaccacatggattgaggcggctggggtggggggagttggttctcaaaaaagtaacaatgcttgagggaccaaacaaggactgaatacacaaagggaattttgttttcctggatacaaaaatcacattataatgatgtaataatggtttaaggatggtttaagtgcaagaatgacaaataagtggaaaagaattgaggtccaagagagattcatggatatattgccatttggtcacaaatggtgacatttcaaatcactggggaaagaatgaacttgagagacccaataaaatatatgccaagaactggcccctgtgctccctgatgggagcacgtttaatcatgagtgagtcctggacgctggatgggcaagggtccaggagagtggtgggaagggagagtggtgggaaggggtgctgatggtgagtgaggatgatttcttttaggtatttgtatgagtgggaagagaagcccattgctggagaatagggtgggataaatgcagggtttgttgtttttgtaaaatgaaaagacataaatgtgatgaaaagggcccagtgaacagggaaaggttctaattgagtaagagaaagagtatagctgtagcataaggttgccaagagtgagggcagggtccctggtgaggacatgtttgctgggagggagaccttccctcctctgtacctggacggcagaagagggcactggagatgcaggctggcagatctgttggagggatgctgagaaaaagccacataatgaattctgtgttttctctgggaagcaggagcacaggtcagtgtatgaatgttgtggggtagggggatgtggagaggcagaagtttgtggaaagtgggaaaatgtttgctctacagagcagggaggcagctgtctaaagcagtggtcctcatgcttgagcatggatcagaatctcctggaggtcttgttaaggcacaggtccctgggccccacctccagagccccagaatttgcatttccaacaagtttccagccaacactgatgytgswggttcctcacctccaactttgagaaccattagtctagagtagagaaaggaaagcaggaacgctgaggtgaagttaaggatcaggaaggtttctttttgtttacctaccttgccctgaaatagagacacatgtaagacaagggatcatgctcattcaggactgggattctatgaaggggcatgaaggaaagacatagggtggtggagcttargaaatgtgaatgggagtgattgatcctagctaggtatagagggacctgaagataggagagaaaactggagaggtgctcctgacaattgctagccatttccacctaagtgtcataacactgattttggatgtgctcagcattcttaaaaagaatgtaccttgaacccagagaaacatttttcatgggattaggggaacaaatgtatagtgatatacattcacttcattaatcctgagtagacatatagragtgtgataaaattcctgcaaaatcacctttcatgctgattttaatctccgatattgtgagtttggatccaatcagagagtcaccccttgcacatccctgttaacgggagaacacaagcacctcctctggagagactaattagtatttaaaataaggacccaaacaatggttgtccatagtagaaataagtaagcagttttctttgtccatgacattttcccctataattcccagggrttgtgtgggcattgcaggtgttggtgtggaagtgttgggcatgtggggaaggggtatgaggctcaaagtgtgttccttgcggtgtctccctcccactcctgtagtatagtaaaagtcaggtactgtgatacccccagctttgttctttatgctcaggattgttttggctatttggggtctttagtgattccatataaattttacaatttttttttctatttccatgaagaatgctgttgttatttgagagggattacattaattctacagattgctttgtgtagtatggccatttttacaatgttaatttttccaatccatgaacatgggatgtcttcccgtttatttgtgtcctcaattttcttcatcacagttttatagtttttagtgtagagatccttcaccctcttgattaagtttattcctagttatcttttttggtagctattgtaaatggaattattttcttgatttcttttttagtttattattagcgtatgaaaatgatactgatttttgtatgctgatttcatattctgcaactttactaaatagtttattagctctaagtttttttgatggagtttttagggttgtctttatataggattatgactcctccaatgataatttgacttccctctttccaaattggatgccttttccctattttttctccttcctaactgttgttactagtatttccaatattaagatgaatagaagtggtgaaagtgagcatccttgatctcttcctgatcttaaagggaaaggtttcagcttttcctccttcagtatgatgttagctatgggtctgtaataggtggtctttattgtgttgaggtacatactttctgtacttaatttgttcagtttttatcatgaagtgaggttgaattttatcaatgccttttttgtgyctattcaaataatcatatggtttttgtcttttattctattaatgtggtgtatcccatttgttgatttgtctatgttaaatcatccttgcatttctggggtgaatcccacttgattatagtgaatgatctttttaatgtgccatttgattgcatttactagtatcttcttgaaatgtttgcatctatattcattraaggtgttgatctgtagttttcttttattgttgtgtccttgtctggttttggaatcaggataattctggccrtataaaatgagttttaaaatattctctcctcttcaattttctgaaatagttggaggataattaatgttagttcttctttaaatgtttagtggaatttagcagtgaagccattgggtcctgggcttttctttgatggaagattttttattactgattcaattttctcacttattactggtctgtgcctattttctatttcttcttaatttaatcttggtagtttttaatgtgtccagtaatttacctatttcttctatgttatcaaatttgttggcatataattattcataacagtctcttatgatctttcatgtttctgtggtatcagttataatgtctcctctttcatttctgattttattcatttgaatcttctcttgttttctttgtttagctaaaggtttctcaatttggtttaccttttcaaaaaaccaaatctttgttttgttaatttttttgaactgtttctttaatctctatttcatttatttctgctcagagttttattattttcttccttctaccaatttcaggtttagtttgttcttgtttttctagttctttgaggtgcacagttaggttgtttattagaaatcttctttcttgatgtagatgtttattgctaaaaatttccctcttagaactgcttttgctgtgtctcataggttttagtacgatgtgcttccattctcatttgtcttaaggaatttttaaattttcctttttaatttcttcattgactcaccagtggtttagaagcatgatgtttaatatatatgtaaagattctgaagtttttcttactgttgatttttagttgtataccattgtggttagaaaaaatactttgtatgatgtctgtcttcttaaatttgttaagacttgttttgtggcctaatgtgatatatcctagagaatgtcccatgtgcagttgagaagaatgcatactttgcagctgttggatggaatgttctgtaaatatcttttaggccaatttgatctatgatgcagttaaagtcttttttctttttgcttattttttgtctaaataatctgttcattgtcagaagttgagtgttgaagtcctctattatcactgtattacagtttatctctccatttaggtgtaataatatttgctttatatatttgggtgctccactattggatgcatatctacttacaattgttatatcttcttgttgaattgatcccttcatcattatcatcatcatataatgaccttctttgtctctttttataggttgtttttgttgttgttgctgtygttcgagacagggtctggctgtgtcacccatgctggagtgcagtgatacgaacttggctcactgcaacctctgcctcctggggtcaagccatcctcccaccttagtttcctgagtagctgagactacagatgcttgccaccaagctcggctaatttttttgtattttttgtggagactgggtttcaccatgttgcacaggctgatctcaaactcctgagctcaagcaatctccctgccttggcctcccaaagtgctgggattacaggcataagccaccatgcctggcctctttttacaatttttgacttaatgtctattttatctgatgtaatatggctacttctgcttgcttctggtttctatttgcatggaatatctttttccatcttttcactttcagtctatgtttgtctttaatggtgaggtgaatctcttgtagagagcacatagttgagtcttatttacttagccaccctctatcttttaatttgagaatgtaacccatttacattcaaaggctgttactgatagataagaacttactcctgacatttttgttaattgttttctggtagtttggtagattctttgtttctttattcctctttttttgtttacttctgtggtttggtggttttctgtggtttctctttcttatttttgtatctgctgtgatttatttatctgtggttaccatggggctaatgtcagtcttgtaagtataatagacaattttaagctgatagcaacttaactttggctgcataaaagtacgcattttccttcccacagttaatatttttgttgccctaatttacttctttatctatgatgtgttcctcagccactaattgttgttgttttttaaccatttaactttaaatcttcatactagaagactgagagttttacatagcaccattatatcatggagtattcttagtttgatttatgaaattacttctactggtaagttttatattttaatgtgtttttaatgacagtaattatcatccttgtgtttcttgttgtagcactcctttaaacatttcttgtaaggctggtcttaggggtgatgaattctcttaacttttgcttgtctgtgaaggactttatttcttcttcatttctgagggataactttgtgggacacaatattcttggttgacagttttttttttcctctcagcactttgaatatgtcatgccattctctcctggtctgcaaagtttctgctgagaaatatgctgatagtctgataggaattcccttatatgtgacttgtcactcttctcttgtggcttttagaattttcactatctttgacttttgacagtttgattataatgttcctcagagagaatctttttgggttgaatctagatggagacctttgggtctcctgaatctggatgttcatatctcttactatatttgagaagtttttagctattatttcattaaattggttttctgtgactttcttagtctcttctcatctgatatttctataatgtgaatatctgttcactgaatggtgtcccataagtaccatagggtttcttcattcctttttattcttgtttttttttttttctctctgactgggttactttaaaataactatcttcaagttcagaacttctttcttttgcttgatttagtctgttgatgaagcacttaattgtattattttattttattcattgaattttttcagttcacaatatctgtttggttctattattattattattactattattattattattattattattattattatactttaagttttagggtacatgtgcacaatctgcaggttagttacatatgtatacatgtgccatgctggtgtgctgcacccattaactcatcatttagcattaggtatatctcctaatgctatccctcccccttccccaccccaccacagtccccagagtatgatgttccccttcctgtgtccatgtgttctcattgttcaattcccatctatgagtgagaacatgtgctgtttggttttctgtccttgcgatagtttactgagaatgatgatttccaatttcatccatgtccctacaaaggacatgaactcatcattttttatggctgcatagtattccatggtgtatatgtgccacattttcttaatccagtcaatcattattggacatttgggttggttccaagtctttgctattgtgaatagtgccgcaataaatatacgtgtgcatgtgtctttatagcagcatgatttatagtcctttgggtatatacccagtaacaggatggctgggtcaaatggtatttctagttctagatccctgaggaattgccacactgacttccacaatggttgaactagtttacagttccaccaacagtgtaaaagtgttcctatttctccacatcctctccagcacctgttgtttcctgactttttaatgatcaccattctaactggtgtaagatggtatctcattgtggttttgatttgcatttctctgatggccagtgatgatgagcattttttcatgtgccttttggctgcataaatgtcttcttatgagaagtgtctgttcatatcctttgcccacatttgatggggttgtttggttttttcttgtaaatttgtttgagttcattgtagattctggatattagccctttgtcagatgagtcggttgcgaaaattttctcccattttgtaggctgcctgttcactctgatggtagtttcttttgctgtgcagaagctctttagtttaattagatcccatttgtcaatgttggcttttgttgccattgcttttggtgttttagacatgaagtccttgcccatgcctatgtcctgaatggtattgcctaggttttcttctagggattttatggttttaggtctaacatgtaagtctttaatccatcttgaattaatctttgtataaggtgtaaggaagggatccaagttcagctttctacatatggctagccagttttcccagcaccatttattagatagggaatcctttccccattkcttgtttttctcaggtttgtcaaagatcagatagttgtagatatgtggcgttatttctgagggctctgttctgttccattgatctatatctctgttttggtaccagtaccatgctgttttggttactgtagccttgtaatatagtttgaaatcaggtagcgtgatgcctccagctttgttcttttggcttaggattgacttggcgatgggggctcttttttggttccatatgaactttaaagtagttttttccaattctgtgaagaaagtcattggtagcttgatggggatggcattgaatctataaattaccttgggcagtatggccattttcacgatattgattcttcctaaccatgagcatggaaggttcttccatttgtttgtatccttttttatttcattgagtagtggtttgtagttctccttggggaggtccttcacgtcccttgtaagttggattcctaggtattttattctctttgaagcaattgtgaatgggagttcactcatgatttggctctctgtttgtctgttattggtgtataagaatgcttgtgatttttgtacattgattttacatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaaaggaatgcttccagtttttgcccattcagtatgatattggctgtgggtttgtcatagatagctcttattattttgagatacgtcccatcaatacctaatttattgagagtttttagcatgaagggttgttgaattttgtcaaatgccttttctacatctattgagataatcatgtggtttttgtctttggttctgtttatatgctggattacatttatcaatttgcgtatattgaaccagccttgcatcccagggatgaagcccacttgatcatggtggataagcttttggacgtgctgctggattcggtttgccagtattttattgaggatttttgcatcaatgttcattaaggatattggtctaaaattctcttttttgattgtgtctctgcccggctttgatatcaggaygatgctggcctcataaaatgagtaagggaggattccctctttttctattgattggaatagtctcagaaggaatggtaccagttcctccttgtacctctggtagaattcggctgtgaatccatctggtcctggacttttttttgttggtaagctattgattattgccacaatttcagagcctgttattggtctattcagagattcaacttcttcctggtttagtcttgggagagtgtatgtgttgaggaatttatccatttcttctagattttctagtttatttgcgtagaggtgtttgtagtattctctgatggtagtttgtatttctgtgggattggtggtgatatcccctttatcattttatattgcatctatttgattcttctctcttttcttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcatttctagttgttttaattgtgatgttagggtgtcaattttggatctttcctgctttctcttgtgggcatttagtgctataaatttccctctacacactgctctgaatgcgtcccagagattctggtatgttgtgtctttgttctcgttggtttcaaagaacatctttatttctgccttcattttgttatgtacccagtagtcattcaggagcaggttgttcagtttccatgtagttgagcggttttgagtgattttcttaatcctgagttctagtttgattgcactgtggtctgagagacagtttgttataatttctgttcttttacatttgctgagaactttacttgcaactatgtggtcaattttggaataggtgtggtgtggtgctgaaaaaaatgtatattctgttgatttggggtggagagttctgtagatgtctattagatcagcttggtgtagagctgagttcaattcctgggtatccttgttaactttctgtctcattgatctatctaatgttgatagtggggtgttaaagtctcccattattattgtgtgggagtctaagtttctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgagtttgatcctgtcattatgatgttagctggttattttgctcgttagttgatgcagtttcttcctagtctcgatggtctttacattttggcatgattttgcagcggctggtaccggttgttcctttccatgtttagtgcttccttcaggaactcttttagggcaggcctggtggtgacaaaatctctcagcatttgcttgtctgtaaagtattttatttctccttcacttatgatgcttagtttggctggacatgaaattctggattgaaaattcttttctttaagaatgttgaatattggcccccactctcttctggctggcagggtttctgctgagagatcagctgtttgtctgacgggcttccctttgtgggtaacccaacctttctccctggctatccttaacatttttccttcatttcaactttggtgaatctgacaattatgtgtcttggagttgttcttctcgaggagtatctttgtggcgttctctgtatttcctgaatctgaatgttggcctgccttgctagattggggaagttctcctggataatatcctgcagagtgttttccaacttggttccattctccccgtcactttcaggtacaccaatcagatgcagatttggtctgttcacatagtcccatatttcttggaggctttgttcgtttctttttattcttttttctctacacttcccttctcgcttcatttcattcatttcatcttccatcactgataccctttcttccggttcattgcatcagctcctgaggcttctgcattcttcacgtagttcttgagccttggctttcagctccatcagctcctttaagcacttctctgtattggttattctagttatacattcrtctaaatttttttcaaagtttataacttctttgcctttggtttgaatttcctcctgtagcttggagtagtttgattgtctgaagccttcttstctcaacttgtcaaagtccttttccatccagctttgttccgttgctggtgaggaactgcattcctttggaggaggagaggcrctctgctttttagagtttccagtttttctgttctgttttttccccatctttgtggttttatctacttttggtctttgatgatggtgatgtacagatgggtttttggtgtggatggcctttctgtttgttagctttccttttaccagacaggaccctcagctgcaggactgtttgagtttgctagaggtccactccagaccctgttcgcctgggtatcagcagcggtggctgcagaacagcggatttttgtgaaccgcgaatgctgctgtctgatcgttcctctggaagttttgtctcagaggagtacccggccgtgtaaggtgtcagtctgcccctactggggggtgcctcccagttaggctgcttgggggtcaggggtcagaggggtcacttgaggaggcagtctgtccattctcagatctccagctgcgtgctgggagaaccactgctctcttcaaagctgtcagacagggacattgaagtctgcagaggttactgctgtctttttgtttgtctgtgccctgcccccagagatggcgcctacaaaggcaggcaggcctccttgagctgtggtgggctccacccagtttgagcttcccagctgctttgtttacctaagcaagcctgggcaatggcgggcrcccctcccccagcctcgctgctgccttgcrgtttgatctcagactgctgtgctagcaatcagtgagactccgtgggcgtaggaccctctgagccaggtgtgggatataatctcctggtgcgcygttttttaagcccgtcggaaaagcgcagtattcgggtggaagtgacccgattttccaggtgctgtctgtcacccctttccttgaccaggaaagagaactccctgaccccttgcacttcccgagtgaggcaatgcctcgccctgtttcggctcgtgcacagtgcrctgcacccagtgtcctgcacccactgtctggcactccctagtgagatgaacctggtacctcagatggaaatgcagaaatcacccgtcttctgcatcgctcacgctgggagctgtagactggagctgttcctattcggccatcttggctcctcccccccgtttggttcttttatatgatatctctttgttgatttttttcattcagatcatggattgttttcctgatttcattgaattgtttgtctgtgttctcttgtatcccactgatcttccttaagatcaatatttttaaatttcttttcaggtattttgtaaattcctctttctttgtggcctcttactggacatttattgtggtgtcatattctcttgctttttcatgtttcttatgtccctacattgatatcagcacatctagcgaaatgagcttctatctcaagttcctcatctacccagtgagctaccagattgactcttccagctcatttagttgccagagctgaagaacccagcagaaggcagatcttctctccagcctagaactcagtcctagaggggacaggaagggcccctggctcatgagcttcctacccaggagtttctggggacaggacctcactccttctggaaatggcattttcacatcaagtcctatgttctctccttgaagttttccctcaggaagccatgaggcatgcctatcctttatgctgggcttctggaagactctcccctggagtttcacctgctacaaatcttcagactctgttatccaaagcccagagactgctggctatggtgggcttgtggttctaccaccaattttctataccaggagagtcaaccttgcagtcctaagtggcacagacctgaggcaggagcctgtagaccctggtccaacaggggtctttcaatggcactggggaagagctgtcaagaaccccacctctgctttgtcccaattctaagaacctggaaagaaagccagagcaaataattaatgtttaacatttcaatatatttgggatactaatggatccctttgaagattaataaaagccaggaactctcattctagtaacacacacacaagcatgcatacacacacatgtttacatacaatttttgtgcattcatagcttcagttcagtgattcttctgtgacctcacactgcctttccctgagtggtagaagtgtagggatggagatttgttgatctgattttaagtagatgctaccctagggggttggtaagtcttattaaattgtacatgtatacactttacatatatgtacttaaaaggcctatctgtgaggaatatttaaaacaactaaaagggtaaaatcattccattgtagaaaccaacagttgacaccaattatttgcaaatctgtataggtcagagatttactttggacagctgagaaaactggtgaactttgatcttctttttccatggaccctgaggacattaaacaagggagtttgctctggaggcagtagaaggatcagtgatcagtttactttggccctaggagyactggactctgttcagcttaaccagctgaacagagctgattcagctcatgggcctatctgaaggtcttgggacttgacctgtcttggtgaaggagcaatgggaagtacaatccttaaataatgttggaagaaattgtgaataacacttttcaagaaagtgtgttacaggacagtggggacagctcaggctattgagttcatagtcctagattctagctttccatcttgctggacagcctaccagttatgtcctccagctgagctcagcttttgtctctgtaaaaccacttctctatactaaatggtctctcagggtgtattttgccaaaggkcccagcagcaatggagggagacataaagcagtcacacagaataacttcattagttcactgagtgtgtatttggtatgtagtctatgttgggtgttctgtaataatgatagttgtcatcaccatctattggtgtcattaccatctattggtcagacagagcaagcaatctaatagcaatgtgagcaatcttcagaatgacaaggtagacatttgtactcctattactaatgagaaaacagagcctcagagtagttaagtaacttgtccggtatgatgcagctactcagtggtctaacatccaaacccaagagtctttgactccaatcccatgcccattttattactgtayggattgcatgtgacaatactcagtgaatgaatggacaggtgactgttaatagaaggtgggcatagggaactagtatacagagaaaaagtcctgctaggatctgtctgctctgttctctgtgatggacttcctaggacttagtggtcagcatccttgcagggtccttgatgtagtgggacctgaggggctgggctcaggagctgtgcacatgggacttagaaggggaagatattggtcaggatataaataaaaattagaggaaaaatgctaaggtgctggatactgtactaggtgatttacagtaattactaatttagatctcacaataactctatgaagcaggcattattgagaggtgaagctggctgggcttctgggtygggtggggacttggagaacttttctgtctagctaaaggatcataaatgcaccaatcagtgctctgtgtctagctaaakgtttgtaaatgcaccaatcagcatgctgtcaaaacggaccaatcagcactctgtaaaacggaccaatcagcactctataaaatggaccaatcagctctctgtaaaatggaccaatcagcaggatgtgggtggggccaaataagggaataaaagtaggccaccagagccaacagcggcaacccactccggttccttttcacagtgtggaagttttattcttttgctgtttgcaataaatcttgctgctgcgcactgtttgggtccacactacctttatgagctgtaacagtcatcttgaaggtctgcagcttcatttctgaagtcagcaagaccaccagcacaccagaaggaaaaaactccagacacgtctgaacatcagaaggaagaaactcttgacacaccatctttaagaactgtaacactcgctgcaagggtctgcagctttgttcttgaactcagcgagaccaatgaacccaccaattccggacacatgatcctcattttctagatggggaattggggcactgagagcttgggtgacttgcctaattcactgtccaacctgaaagtcttggtgtatagaagtgaacgaccaagccactgtagctttagtggtgtcttcagtcagggagaaccagggccaggatcttctcttgtcctaattcgtgcagttatgatcttgtcctgtgtttactgaatgccacttctaccaacgytatgttcctgccttgcagtgtgaagattatttccaaattcagatctaggaataaaccccacttctgggggcccattcatctatcagaatttattcttttgtttaaaatccaaattatttgacacctgttgtcccagcccactttrtgccatgctgtcaaaatttcacagccttcctttccactcccgagcatctactatctcacctgggagaggggcctgtggaggaaggggctgaagcagctgctgtgacacaggctgcctatttcacagtttggggcacaaaactcgtgtgtccccatccctgactactaacctccttcccatctttgccaagcctgccgaggtgtcctgtaaatagtgtgtcagggaaggctagcattcctgcacacctgcctttgatcagggacctttgttcctttacacatgagagttcccagagtgcgctgggctccagggtcagtggcccttctagctgtcagcctggggggtcaagtggaactgggtgagattgaaaatatggtgatgagaaaaggggtttcttagccrggtacatctctgtcttaaaatgagaacagacagctcctggtctgtcccagttgtagaagaaggactgagttaaggagaaggagcccttggctttgtaacattgaacaatgctgaatatctctgctccgttattcctccattctgcacacaatcctatctgcccttcacagtcctgtagaggagatgattaaaaggctggctgctccctttcttctttcatttccctgcctttctcttgtttccattttctttccttccttaaaaaacaaaaaaaacaaaaaaacatgtatttattctattctcgttcctttgcttgaggtggctatgggcagtggctcctgagacactggggtgaagcaggcagtgggaggatcaggaggttgtttatgtacaagagaaatgagcaaagagctgaaaatagtgagcacactgggactgcggtttctcatggccagagaagggagctgcacatatggggaggaagacagctagaatatctgcagtgctgttcagttggaattgagggatcagtgtgaactcatggttgtgtaagggtgtgggacaggtatagacgtgtgtgtgtttctgtgtcccctagctctgtctggagagcctagtatcaatgattctgcaacaagaattaccacacctggcacccagaatttgctttctaaataccgttctccactaaaaggttacgtccgtcacctyagagaaggagattctagaaatagagatcccagagctggtacagggaaggtacaaagtaggcttgaatgtcttgttctatcagaaagtgaagtgcttaaaaaatgttgaggcttgtcacaggtctgcaggagccagctggaaatgcctccaattggccacatgtgcaacagtttgagcactgaactagataatgtcagtaactggctataacccaccaaactcacgagtccatgcagatataaacaagtcatagaaaaaactaaacagatgaagaaagggaagttcttccttacctcagaatgctaattaataagcatagaagaagtgatatctgaaaatcctcattttgcaatcaatgtagtactaattcattctgtgaatcattaagaacacagcattgtgtctgtgatattgctgccaaaaatgcacaacctgagtcaaatcatgtggtgatgccacaaaaacccaaatggagagtttcttaaaaaaaaaaaaaaacctgttaaatacaaaatcacaccatgagaacacagaccagccaaatccagaatgttggaaattcccaaggacaagtgatccagtttatttgacaagtatgcaacataaaatgctgccaattgtttagagtgaaagagatttaagagttaaatgtaacatgtggatcttctttgggatccagtttgaacaacctaacacttttttagacaacaagggtaattgctatattgactgagtattagatgataataagaaaaaattgtgctgttgtcccagcactttgggatgctgaggcgggtggatcacgaggtcaggagttcaagaccagcttggtcaagatggtgaaaccccgtctctactaaaaatacaaaaattagccaggcgtggtggcaggtgcctgtaatcccagtgactcgggaggctgacacagagaattgcttgaacctggcaggcagaggttgcagtgagccaagatcacaccactgcactctagcctgagcaactgagcaagactccatcccaaaaaaaaaaaaaaaagaaataattgtggaaaattccaaaagccagaacacctcttctcctccaaaggattgcaactccttgccagccaggaacaaaactggacagagaatgagtttgacgaattgacagaaataggcttcagaaggtgggtaataacaaacccctccgagctaaaggagcatgttctaacccaatgcaaggaagctaaaaaccttgaaaaaaggttagaggaattgctaactacaataatcagtttgaagaaggacataaataagctgatggagctgaaaaacagcacgagaactttgtgaagcatacacaaataccaattgtgccgaattgatcaggcagaagaaaggatatcagagattgaagatcaacttaatgaaataaagcatgaagacaagattagagaaaaaagaatgaaaaagaacaaataaagcctccaagaaatatgggactatgtgaaaagaccaaacctacatttgatttgtgtacctgaaagtgacagggagaatggaaccaagctggaaaagactcttcaggatattatccaggagaacttccccaacctagcaagacaggccaacattccaattcaggaaatacagagaacatcacaaagatactcctcaaaaagaccaaccacaagccacataatcgtcagattcaccaagattgaaatgaagaaaaaatgttaagggcagccagagagaaaggttgggttacccacaaagggaagcccatcagactaacagcagatctctcagcagaaaccctgcaagccagaagagaggggagccaatattcaacattcttaaagaaaggaattttcaacccagaatttcatatccagccaaactaagcttcctaagtgaaggagaaataaaatcctttacagacaagcaactgctgagagattttgtcaccaccaggcctgccttacaagagcttatagaggaagcactaaatatggaaaggaaaaaccggtaccagccactgcaaaaacataacaaattgtaaagaccatcaacactatgaagaaactgcatcaactaacaggcaaaataaccagctagcatcataatgacaggatcaaattcacacataacaatattaaccttaatgtaaacgggctaagtgccccccagttaaaagacacagactggcaaattggatagagtcaagacccatcagtgtgctgtattcaggagacccatctcacgtgcaaagacacacataggctcaaaataaagggatagaagaagatttaccaagcaaatggaaagccaaaaaaaaaaaaaaaaaaaaaagcaggggttacaatcttagtctctgataaaacagactttaaaccaacaaagattaaaaaaaagacaaagaagagtattacataatggtaaaaagatcaatgcaacaagaagagctaattatcctaaatatatatgcatgcaatacaggagcacccagattcataaagcaagttcttagggacggacaaagagacttagactcccacacaataatagtgggagactttaacaccccactgtcaatataaggcagattaatgagacagaaaattaacaaggatattcaggacttgaactcagctctggaccaagcggacctaatagacatctacagaactctccaccccaaatcaatagaatatacatccttctcagcaccacatcgcacttattctaaaattgaacacataatcgaaagtaaaacactcctcagcaaatgcaaaagaagagaaatcataacagtctctcagaccacagtgcaatcaaattggaactcaggattaagaaactcactcaaaactgcacaacttcatggaaactgagcaacctgttcctgaatgactactgggtaaataacgaaattaaggcagaaataaataagttctttgaaaccaatgagaacaaagacacaatgtaccagaatctctgggacacagctaaagcagggtttagagggaaatttataccactaaatgcccacaggagaaagcaggaaagatctaaaattgacactctaacatcacaattaaaagaactagagaagcaacagcaaacacattcaaaagctagaagaagacaagaaataactaagatcagagcagagctgtgggaggtagagacacacaaaaaaaaacccttaaaaaaatcaatgaatccaggagctggttttttgaaaagattaacaaaatggaccgctagccagactaataagaaaagagagargagtcaaatagacacaataaaaaatgataaaggggatatcaccactgatcccacagaaatacaaacaaccatcagagaatactataaacacctctatgaaaataaactagaaaatttagaagaaatggataaattcctggacacatacaccctcccaagactaaaccaggcagaagtcaaatccttgcatagaccaataacaagttctgaaatagaagcagtaattaatagcctaccaagaaaaaatagcccaggaccagaaagattcacaactgaattctaccagaggtacaaagaagagctggtaccattccttctgaaactattccaaaccatagaaaaagagggactccccccaactcattttatgaggccagcatcatcctgataccaaaacctggcagagacacaacaaaaaaagaaaatttcaggtcaatatccctgatgaacatcaatgagaaaatcttcaataaaatactggcaaactgaatccagcagcacatcaaaaagtttatccaccacgatcaagttggcttcatccctgggatgcaagactggttcaacatactcaaatcaataaacatcatccatcacataaacagaaccaatgacaaaaaccacatgattatctcaatagatgcaggaaaggccttcaacaaaattcaacaccctttcatgctaaaaactcgcaataaactaggtattgatggaacatatctcaaaataataaaagctatttatgacaaacctacagccaatatcatactgaataggcaaaagctggaagcattccctttgaaaaccggcacaagacaaggatgccctctcttcccactcctattcaacatagtattgaaagttctcgtcagggcaatcaggcaagagaaagaaataaagggtattcaaataggaagagaggaagtcaaattctctctgtttgcagatgacgtgattgtatattccgaaaaccccatcgtctcagtccaaaatcttaagctgataagcaacttcagcaaagtctcaggatacaaaatcaatgtgcaaaaatcacaagcattcctatacaccaataatagacaaacagagcaccaaatcatgagtggactcccattcacaattgctacaaagagaataaaatacctaggaatacaacttacaagggatgtgaaggacctcttcaaggagaactacaaaccactgctcaactaaataacagaggacacaaacaaatggaaaaacattccatgctcatggataggaagaatcaatattgttaaaatggccatactgcccaaagtaatttacagattcaatgctatccccatcaagttaccattaactttcttcacagaattggaaaaaactactttaaatttcatatggaaccaaaaaagagcccgcatagccaagacaatcctaagccaaaagaacaaagctggaggcatcacgctacctgacttcaaactatactacaaggctacagtaaccaaaacagcagggcactggtaccaaaacagatatatagaccaatggaacagaacagaggcctcaaaaaataacgccacacatctacaaccatctgatctttgacaaacctgacaaaaacaagcaatggggaaaggattccgcatttaataaatggtgctaggaaaacaggctagccatatgtagaaaactgaaactggaccccttccttacaccatatacaaaaattaactcaagatggattaaagacttaaacataagacctaaaaccataaaaactctagaagaaaacctaggcaataccattcaggacataggcatgggcaaagacttcatgtctaaaacaccaaaagcaatggcgacaaaagccaaaattgacaaatgggatctaattaaaataaagagcttctgcacagcaaaagaagctatcatcagagtgaacaggcaacctacagaatgggagaaaatttttacaatctatccctccgacaaagggctaatatccagaatctacagggaacataaacaaatttacaagaaaaaaaaaaccctatcaaaaagtgggcaaaggatatgaacaaccatcaaaaagtgggcaaaggatatgtcacaaaagaagacatttaggcagccaacaaacataagggaaaaagctcatcatcactggtcattagagaaatgcaaatcaaaaccacaatgagataccatctcatgccagttagaatggcaatcattaaaaagtcaggaaacaacagatgctggagaggatgtggagaaataggaatgcttttacactgttggtgggagtgtaaattagttcaacctttgtggaagacagtgtggcaattcctcaaggatctagaaccagaaataccatttgacccagcaatcccattactgggtatatacccaaaggattataaatcattctactataaagatacaagcacatgtatgtttattgtggcactattcacaatagcaaagacttggaaccaacccaaatgcccatcaatgatagactggataaataacatgtggcacatatacacgatggaatactatgcagccataaaaaaggatgagttcatgtcctttgcaggggtgtggatgaaggtgaaaaccatcattctcagcaaagtaacacaggaacagaaaaccaaataccacatgttctcactcataagtgggagttgaacaatgagaatacatggacacagggaggggaacatcacacactggggcctctcagggggttgggggctaagggagggatagcattaggagaaatacctaatgtggcatgatctcagctcactgcaacctctgcctccygggtttaagtgattctcgattctcatgcctcagcctcccgagtaggtaggactacaggtacatgctaccatgcccggctaatttttgtatttttagtatacacggggtttcaccattttggccaagctggtctcgaactcctgaccttaagtgatcctcccgccttggcttcccaaaatgctggtattacaggcatgagccaccgtgcccagcctcttttgcattttcttttacaaactttagaattatgttgttaatttacatgaaaaaacatttggaatttgattgggagtacattgaatttctacatcaatttaaggagaattgtaatttttacaatatcaagtcttccactccctgttcaagatatagttttccatttactttgagtttcttaatttaaagtctggtacataaaagttttagatgtcttttgatagatttaatcctaggcatttgtttttcttatgttactttaggtagcatttttcatgttttttttttttttttcaatttgagtatagaaatacaattgactttggtgtgtttacctaccttgatccagctctatttttttttttttttttttttttgagacagggtctcactctgtcacccaggctggagtgtagtggcacaatctcaggtcactgcaacctctgcctcccagattcaagcaattcccccacctcagcctcctgagtagctgagactacaggtgtgcaccaccacacctagctaatttctgtatttttagtagagaaggggttttgctatgttggccatgctggtctcaaactcctgacctcaggtgatgctgcctgcttcagcctcccaaagttctgtgattatagacatgagccaccatgcccagctttaactcatttattctaaggtatactctagtttcttcagaattttatatacatacaatttattatgcataaagatgagaatttatttttttccttttcaatccttttacttactatttctttttcttgcctgactaaactagcaagggcctcccgtaaaaaggatgaccagaaatgataatagtaaacattctggtcttattactgatctcaacagaaaagctttattcagcatgccacattaagtatgatttctgtagatttttatggtacactaatacttgatatcagactgagaaaggtttgtcgaataaatttgctaagaggttttgttatgaatggatattgaattttatgaaatgatgttcccatactgagtgatagggtcataccgttttcctttattattccactaatatgatatattacagtgattgatacttgaaaagatagcttacattcctggaataaacccaatttggtaattatttattaatcttttttacattttgctagattctatttgctaatcttttgtgtagaaattttgcatctgagttcatagaagttatttttttatctttgtcatgatgtctttgttagtttttcctttctaagtatacatactgtcctcaaaacattagttaaggagtgttcctacttttctgttcctggaggaatatattggtttaatcctttttctttatttagagacagggtctcactttgttgcccaggctggaatgcagtgttgtgatcttggttcactgcagccttgaactcctgggctcaagcaatcctcttaccttagcctcttgggtagctggcactacaggtgcatgccactgtgtccagctgatttaaattttttgtagagacgagttctcactatattgcccaggctggtcttgaactcgtgagctcaagcaatcctcctgcctcaggcttccaaagccctaggattacaggcatgagccaccacccccacgctgtaattcttaaatgtttgatggaattcattccacctggccctggactattcttcatgagacaggtatttttgcagactcccctgtgaaaagaatggaaaccttgagaatcttcattgtccaaggacttctgagaggtagaacagagatagagaaagggaaagagaaggagagagagagagagaaagagagagagagtgagagcgagtgagcagtggtgtcatgtggcatttcaaaatgcctggcattttcctaaaagtaccctgcccagtccccaaccccctagccatacagcccgacccagcgggcttgcagggtgactgatttcgtgaatgtcggttctcaggctgccaggctgctgcttctcaaggatgacccagactyagagaagtctctggtgtcaggcagaggacactgggtgggggayaggaggaactgctcaaaacagacagaggctctttgtttgctttgcttctgtgtcaactgggcaacatttggaaacaacaaatattggttcagaggcccactgctttcttacccacctcctgctggtcagcttttccagctttcctgcacgtacacacaagcgcagctatttctttaagggccaactcrtggttgaaatttgagagttttgccctgtttgcggtgaaagatttggctcatgcttgggttggtctagaactggaagcttcctttatgtcctctatcaatctctttctctttctctttctctctcacctccctccctctctttcctcccccactaaataaataaagagaaggtcaatatcaagaaggcagctgtggtctggagaagggcaagatttaggaagtttgagttcaggtctcagagctccatgaataaggacccatcatttgactgtaatgaccacatgtgataaatggaggtactgatcttatcttgcatggctgccccaatgatcttgccccaggacagtgcctgacacatacaaggggataaaaacatgatattttcttccagctgagcataatcaagccagtccatgtctaaggatctgcagttggtactcagacctctcccagactgaccagcccctgtgctggcaaagccctgggggctgtgtgcttttggagaaatggcaaggctgggagtctcatgtctgtccctctctcggtgtgaccccagatgagctccttggcccctgyatgtcctggtttcctgggagaggcagtgtccctggtggatgtgtacactctggaaccagactgccttcttttgtattctgactttgcagctgaccttgaacaagatatcatcctctcttgtcctcagtttccttgtctcatctgtaagatacagatgctaaagcaccaaagtcagaggggtrtggtaagtgctcagtgaagctcccagtaaatctcagccatcattaagctattaaaagggacagtgattctccaactccagaacatctctggtatagaattaaagaatataaatgagagcacaggtacaagtgtcatggacatggagcgctgtaatgttaacctcttaccttcacatgctcctatagacatatacaggcataggcaccccatacagctagggccatgcacacatgtacaccccaaagctggcctcacccctgcctaccccatccaaggaatggcaagcacgaagctctgctgttgtcctcttgagcaaaagccaaggccctggcctctccatctaggtgtgtgtagatgacgtgggagcaccagttctctatgtcttgtctgagcttccttcatatcccatgaggctgtatatttccttcccagcacctgtcttgggcttggactcaaaggacccttctgaggacagggcatagagctggctgctctggagaggactcagcctggccagtaggtagttgctccctgctgaggggctctggctaggctatgggcctgtggctggaggactggcctcagcggggcttagtctacgaatgtagatgggctccagaaaaggagaatcactgaccatcttctttccatgccctgcgttgagcttccctgagtttgtggcatgggctcaaccttycgtaactgcacttcctgctctctggcagaccctgcaagcttactacagggcctgtccatgcatcagctgtatgtgtrcatgctgctctgctgggtgccttccagttagccttgcccctgacttttcctgctcatctcacatccttacctcaaggtctccaaatgaatccagaccactgcctagagcctgctgcaggggcagtaggaatatggccctcatgctaacagtcttctttccctatggctcaagcacaaggggcccrtggacgggcaaggggggagtaagacagggcagcagtggtcactctccctcgctggtgaggctgatgtgttgggaaagccagacttgacttctgtcctcactgtaaacagaaagcttctgtagtggactctaaagtgggaggtatgtaacccctttgcatatgagataatcttttggagtgtgggagaacataatctaacttccagttatatttattgttattgcaaaagattaacaaattatcattcattcatattgaatgtgtgaattggccctatctcccacctgagtctgcagtcatgacagatggagcctttcaggtgtcctaagggaagatggggttcacctcacaatgctaaaggtgaaaaggggagtgccgaccctgccctttgttttggcatttttatttccatactttgtggtttgtatgtgcccagttaaacggatgtacagattagataatctggctttaactccaaccttcaygagatgcacacatgccttaaaaagattcttacaaagaaactagaattaggagacaattctgacaacacaaaaacaagtgaacaaaaatcaaatgactgacctgacgtgtccactaggcttgatatgagcttggtcaactaaaacatgagacagaatgaatgaccatctggtcaggttggataagaagtaacttttggcaaaatctctgaagtctggatttacacttcgtggaaggaatcttgacctttccccaagtatattatgccttgagataataatcctgtataaggccgcataagcaaaacgacatttgaaaatgagtttcatctttagctcatccttttacaaatttctattccttgtgcatgattgaagtgtacacattttttagttaaaatataagcatatagaaggcacaagttcaatatttttcatgataaggatgtgtaattaaactggttaggagactcatcgactagagggggacatggtggccccaggctgtaagaacaggccacaccgtccactgggccgcttgctttgtgctaagatgacactttgttctgagcctcacagtgtcttgaccatgttcctggaaccttcttgttggagggagttcatcttcccctatgactctgtccctagtctaaggtgtcccacaggaagcttgagggcgggaagttttccagcccaggagcytgagctcagcggggcaggaagagggagcagctcctccgtgggrgacctttgagagcccaggagcaggatttcgagggacacctggtggggagcaaaaggtgctgagtctgtctttgaccttgagcccagcttgtttctcctgcatcctcccccaaaaggggctttgcctgtcattctgcagttctagtgtggggtctgggcgcagttcttttccctctccagcctcggagtcttcctctgtggactgcgcagataggactggtggcacggaccagctctgcagccctggagtcaggagcagagccccccggctcccagcccgccgtagccgctcctggcaccgagcgagccgcgatgacaatggctgcattgtgcttcatgtcccttcccatcaacatttctgtgctggactccttccactcgcgggtcgtctccagagctcagaaaatgaggtgatcagtgggacgagtaaggaaggggggttgggagaggggcgattgggcaacccggctgcacaaacacgggaggtcaaagattgcgcccagcccgcccaggccggkaatggaataaagggacgcggggcgccggaggctgcacagaagcgagtccgactgtgctcgctgctcagcgccgcacccggargatgaggctcgccgtgggagccctgctggtctgcgccgtcctgggtgagtgcgggcacggggtagcaccgcagagtcgctggcccgcgcgttccctgcaacccgggcggccaccgcgcagcctgcatgcactccgcgctcaggctggaagcctgggtgtctgggtgcctttccattgcctctctacgccccacccctggcctttgcttgggcttctagacacctttcactgcactcactgtcttctccccctcctcctctttgtccagtaaatcttgcagcagtgaaatacaataaatcagagcacgtctaaccaggttatcaaaaccctttgctgctgcctcttgtcaagtccgaactccttagcatggcattcaaggcctcccgggtctgaccattcccctttcagaggctgaygtcccctgggtgccctgggagctgtagatgtcctgccaaggaagcggtgccatcgagcggtcagagcatggggtttgaagccagacttcttggatccaagtcctggccggctcctcaccagggagggggtcatcacagcacttgcctgggagggtcaaatgagggtcagcgaggtggcagatgctgagtaccagtggcagatgttgcacacatcctgctatggggcagtggctgacgccacactccccgacctcctgaggtggggcccccttcatactctaacttctgcctgccattcatggggcatttgtcacactgttggggcttccacgtttagttttctctccccataagctagcaattccttgagagaggaccccacgttacttgcctttatccccgcacagagcacttcacaggctgtgcaaggtaatgctccactgaggacacattctygcctatgggaactctggaggcagggctttgtggaggggctgccacaggcttatgttgcctcctaggrtttcccatgggccaagagggaaaatgggggtcgctggggtggccatccctggtggcccctcctcatgcatcctggagagctgtgggcctcctctccacaggctttgtggatcttcttcagagccagtgagtcagccttgctgtggtggcccrcaaggagtggagatgacagagggccttggggacagggcaaaagctcatgtgatagggatgctgtctctgcaaccacatggatwttaatagttacccatggctggcttcagctttttttgtgaatggcagccaaaaagtgtggtgaaaatggagggatagttcagtggagacagaggggagactgttgaatttgtggagtttttagttcttcctraacagagagcaacagacaagagttacagacaaattaattcttttcgttaatttaccctcaactactggccaagaaggggtgtaactcagaatgttttcttcttttgtgccctgagtagcagacccagagtctggagacccagattctaggcctggcttggccaacgacaagcagggtgaccttgggttaaaaaaaaaaaaaggcatcattctctgagtctcactccctcttctcaaaaagatggcaattcctcccccgctggttttccatagttgaggtagcaagccaatgtgttgrggtagctgaaaacgccctgtgcatactgaggcttatgttccatggggggccaggggccaggacagtgatgggaggagacaaggcggatacagaggagcagattgtcatctccagctgggaggtgatggccatgcctgcacccctctggccagcagagggtggtcagtaggaaactgggaggccattagggcaaccttctattggctcagactcagaatgcagtagaacttgtgccctgtagtgttcatggacaggagtgagaggaggacaggactgaggggatgtggctgtcaaggcctttctaggggcgatgctgtctctccctcagcatagggagtgggcccttccacctctggcctctctcccccagggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggtaagtcgctgctgcctaaaagagagtggaagaaagccatactttctctgtttccagtcactttggaacaattctttactcacaggtaggaggctgatatatggggcagtcaaccttgacttactaaaatcacttcaaaagtggaaatggggaggttttctttaatgtgtctggaaagcaaaagtcaaaaagcacattaacttttgctttccagacacagtagacgcaagggtgactgttttgagaccctaggttctctgaacttggcgaaaatataagaatgcctgctatcaggctgggcgcggtggctcatgcctgaaatcctagcactttgggaggctgaggcaggtggatcacctgaggtcaggagttcgagaccagcctggccaacatggcgaaaccccatctctactaaaaaatataaaaattagctgggcatggtggtgcatgcctgtaatcccagctacttgggaggctgaggcaggagaatcacttgaaccggggaggcagaggttgcagtgagccaagatcctgccactgcactccagcctaggtgacagagtgaggctccatctcaaaataartaaataaataagaatgcccactatcaaaattattatataaccttctttggcagcttttgatacacaactgggaagatgagtgatgcatgcagggggaagagtaaagtgtcctgattgcaggtgacagctgatctttttgttcttaggtctacaaaaatgctcttcattctttcaacgttgcccctgcccatctgtacatgtcagatcctgtgctgggcaatggggctgcagtggtgaattaaacacattggtccttaccctcagggagctcatgggctagtcaggagagcagaaaaacacacgaataagtaaactactaattccaaaatgtggggatgtacaatggagggaaaaaggagagtgttctgacagggactcacagaaaaacctgctttgtcctgggtggtcagagrccatctctctgagagagatgtaatgaaggactgagcctgggtgggctccagtgtaaaatacaccaggcagcaaacaagagcatatgcaaagggcctgaggcagagcagagtgggcttatttaagttgctagtgggaggccagggtgatgggagctgtcaaagataagcacagccagatattagtttaggcagtgacaataggtttcattcagtaactgctgacagtgggggaaagagctaggctccattctgatttgtgcagtggtgatgtgagcattttaaagggagaatgagggaggggagaacgcagggctctgtagagtcagagaagtaaaaaggtagaaagggctggtcagtgtaaatgtgaggaggccagctgtgtctgatagctggcagttctctckattaggactctattctcccgcagagactgcgagacagacactctatccatcctgatgattgtgttgcaaaggaatggctctcagtccttgagagagatgcttgtgagtttcaagagatacatattcacagttttaagtcctttttagtaaattctcttggaaagggaggtcaggggcctatcatcagttgtgtgttgagtagaagaaacaggtacattttcctggcagcactgagttttctcaggcaagcactttaaggggaaccgggccatcctagggacacagatttgttctgctaggagccatgccagagtctggtcaggtctcttagtgcagaggtttggacagatgtgtcaagtgtgggaaattctacagttctcagcacaaagcaagcagtaggttagccgaagggaaaaggtggaagaaacatccagatgcagcctggcttccctcaatccccgcgctggggttttcctcctctacccgtgtctttctgctggcttcsccttggcttccctccagccttctctctgtagctttccctcttctgggtttggttattttgacttgtgagagcttgcttgattataatcctgtccctcccagctggcrcaggttcccctgggaaccctgcagctctagggctggacgctgtgttttaggccttagctctttggctccctgagcccccgaggcaccagtgatttcttrgtgtcttggcaaagaaagaccaggttcctgaccactctcccaaccccactgcaatgggcaaagctctcgtttgtttgcttcattttttaaaaaatatatatatattttattatactttaagttctagggtacaagtgcacaacatgcaggtttgttacatatgtacacatgtgccatgttggtgtgctgcaccctgtttgcttcatttttattcaacaatgtgaggactggggaagggaaggtgtttgcagattaaacaaaaccacgaagtgtgtttcatatataaggtctagttgttgtggaacagaaaggcccatgatgtctgttaattttgttttgtattgtggtatattaaaaatatgttttacaacccaaatatccattgatgagtgaatagataaataaaatgtggtaaacacaaatgatgaaatatttttagccttaraaataaatgaaactctgatatatgctacactgagatgaaccttgaaaacataagtgaagcaagctagatacaaaaggacaaatattgtaagattccacttttttttttttttttttttgagacggagtttygctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccagkatggtctcgatctcctgacctcgtgatccgcccgtctcggcctcccaaagttccacttttatgaagtatctagaatagtcaaatttatagaaacagaaagtagcataatgactaccaggggctggagtgggggagaaataggaggtaattgtttaatgtgtaaagagtttcagtttctggagatggatagatgtgatggctataaaacaacgtgaatgcatgtacttaatgccactaaaatgtacacttgaaaatggttaaaattggctgggtgcggtggctcacgcctgtaatcccagcactttgggaggccgaggcgggtggatcacctgaggtcaggagtttgagaccagcctggccaacatggtgaaaccccatctctactaaaaaaaatacaaaaattagccgggtgtgatggcaggcgccttaatcccagctacttgggaggcagaggcaggagaatcgtttgaaccctggaggcagaggttacagtgagccgagattgagccattgcactcaagcctgagggacaagagcgagactgctgatatagtttgtcttacaacatattttatttcatttagaaatactattgtcttattacttgattgtaacacaacaaagttcatggaactatagcttttgctttgtaattttttttttttttttgagagtcttgctctgtcacctaggctagagtgcagtggtacaatctcggctcactgcaacctctgcatcccaggttcaagcgattctcctgcctcagcttcccaagtggctggtattacaggcatgtgccaccaagcccagctaatttttgtttgtttgttttggtagagacagtgtttcaccatattggctaggctggtctcgaactcctaacctcaggtgatccacttgcctaggcttcccaaagtgctggaagtacaaggtatgagccactatacctggcctgctttgtaatttgatcaataagaaatcttcatagagaactggcaagggcttctggaaaaatcattttgattaaagacatttaaaacaaaaaaggagtaaaactatgtgtttaagtgtctaaataaaagatggttgggctcactttaaggatttacataaaaagaaaataaattatagatctagtaagaaggcagctataatatttcaagggacctgttgatgtaaagatgagggcttacagaagcacaaagtcaaaaaggaacataacctgaagtaacagtgtaatgataagaaataaacccggaatgtctgcactgaaatcccagctccatgacttactggctatgtggcccagggaagtgacttaacctttctgtgcctcatatttctcacttgtaaaatggagctgagagagaaagagagatgagctgcccatgtgttggagtagacaattataccagagatgagcaaaaatggaaataataatcaagcttttgatcattcagtacatagtatcaccaagaagctaaacccagagaaagtgcccaatccctcagcaaaagggtcatgcagttttatggacccaggacaggaaggaagagcattgagtactgagtcagagtgaagacgaatgttttcaaggttcccatcttcccccagaaaaaaaatctccacagaagcacctgaggaagacctcaaaggaagtctcaaaataaagagggctctgagcaaaggtcatgggctaggaatgaaaacaggtgtaagaagagcgtggccagcccaagagagctgtgtccttgacagcagagtcccctccagagactgcattgcactggctgtgctctgagtctggggtggcgagggcggctttctcccacggagcctgccaggttaagccttcgtaattgcctacggtaaagtcacgtaggatttttggccaggagctgggcacctcaccggggaaaagagaaacacaatccatcactccctctatgcagaaggaataggaatgtggtggctaagtgcccttgcgagggagacagagtcaactgaagccagcagggctgtgcgtggtctagtcaagttctggccctgggtccgtggagtcctggtagccactctctacttgtgtgggttgaggtgggccttccttggaagtcaaggcttcatccaggactggcctgttctctttcaggcaaacgaagcggatgctgtgacactggatgcaggtttggtgtatgatgcttacctggctcccaataacctgaagcctgtggtggcagagttctatgggtcaaaagagggtaagttctccctgggaccccaggaaggagttgtcatccttattctatatgctgagtgctgtgttttacaggcaggttttggatatcagatataatgaacattcatctttggagagtgagtagagaatgaggggccctgtcagctgccacagccacacatcaaggcctctgggggctttgggctggctgaggactggtgctcctaaaactgagccctgggccaggggsatatgcttatcagagaaacacagcaggctgtgtgcagcttgacctgaaggctactgcggtctactgatatgtctagggtccctggaggcctctggagccataggtaccactcacacaggagrggtcactctggagcacacactcagaggccagcagccctgcaagtcttctgagatcaacctgactgtctctgggcctgtgccaggggacatgaaatactttgatgggcctctgttaccacagctccagtttcctggtggctgaggttggtaggtgtaggcagacacgctgcagggccaggggaggcaaagcattcaggacacatgtgcgtgtggccttcttgcccctgtttgcctggaggggtaatattataaatattccttctatggtcttctctctcccctgcaaccctaggaaggttttcctgattccccactccttatcgcccagtccagtaaaagcatggcctctccgctcccctccctcctcaagagtcyggtggtgatgagccatgtttccctgcaccaggctgagggccttscattcacactgtgcctttgcagatccacagactttctattatgctgttgctgtggtgaagaaggatagtggcttccagatgaaccagcttcgaggcaagaagtcctgccacacgggtctargcaggtccgctgggtggaacatccccataggcttactttactgtgacttacctgagccacgtaaacctcttgagaaaggtaagctggcaggagtctgggtgccctcgagcagctgcctctgctccagatgcccacacaggctgcactagacagtcaccatcagcagacatgtgggatgaactcaggtgggggaaagaggttaacagactttaaactggcaggtctgctgcaccagcagcacttgggaggtggagctgagcttttttctgctctgagcttccaaaaccccagcagaggctgttctgatgagtgaggaaagggcgcaaggctcggcagagggtttcagtctaggcgatggtggttctcttgtccacttctctggatttctttcctggaggtttctctggagccctgcacctctcttaagcagttctcatgtctggggcatggatcccagaggggacctctctctgagctgttccagcctctgacaaagcagggagaaggkgctctgagaaagacccgagataggccttggttagtgggaagcataggcctgtttcctstgatggatggtggccagacagaggtcaacttgttcctattagaaatccttgatcttgatgagttagcataagggcaagctggggctgcatgtgctggtttggttttagtcccctctgttccctgatgggcctgggtggggtgatgccattggctgtggccagcctcactcatgctctgttgtccatttctctgtgctgagcagcagtggccaatttcttctcgggcagctgtgccccttgtgcggatgggacggacttcccccagctgtgtcaactgtgtccrgggtgtggctgctccacccttaaccaatacttcggctactcrggagccttcaagtgagtgagatgtctgctgctccatggtggccaaagtgccaaatgtcctcagggtgagagttctttgctggtccaaagccgagccctgcctgcctacaggggcatcgaggtggcctaatcccctcccagtgagtcagaagcacaacctgggactcytaggccaagccagcccatgttccctttcatctgaccctgacaagtaggtccttttcctggggacccttcctttctccccagagccctcaagcctggtcagtgtctcctctcrgtggatcgggcagagcctgaaaggacaatcatgcctctagtgtctgggcccactgtccagggactggccctcttccctcaatctcagcagtgttacctgctcagcacactgcctgtctcctgcccccatcaccgtctctatctgggaagctgatttcttgctttctctttttaccttgattatatcctaaagttttacaaccagccaaaggcacattttcacccycaggagacactataccattatcttctattccagaagtttaaaagctcttttcacatgaaaatatcttcagttgcattttgcttctttgggttatgagggctttttatctcgtgtgagctcattcccccatctcagcactacgctggaggtctgcacaccatggtgttgcttcagctacggggctgcaccaggctctatcctagtgtgagtgctggacagtgtgatcagactctccaggtgcaggagaagggcctgccctgcaggagccctgctgatgtgtttctttgacccaggtgtctgaaggatggtgctggggatgtggcctttgtcaagcactcgactatatttggtaagaatgggacaagaatccaccagggccactccaagtagtgggtgttctttttctgtgttccctttttcatgctcagtaattggaaatgagcatactgtatttctcctttatcattgcctgggtttccacctgtgcagagttaggtacctacggggtccccatctggattcctgggcctctttccatcattcaatctctccacacggtgcctctgcctctggggtagtgttgccataaccaaagactgggggttggtgctgctaagatcaggctcatggtggaatgaggagcaatcactgctacatgggcatcagaagcctttacctggctgtgggctcttgagcgagtcattctcccgcatgttctctggccttcagtkctcactccagacctctcagctcatactttctatgatcaattgaatttcaasgatgggcaccacagcccatggctctcctgtgttaagctcacctgggctttccctccccagagaacttggcaaacaaggctgacagggaccagtatgagctgctttgcytrgacaacacccggaagccggtagatgaatacaaggactgccacttggcccaggtcccttctcataccgtcgtggcccgaagtatgggcrgcaaggaggacttgatctgggagcttctcaaccaggcccaggtatccccacctgccatcctcccctccagcttagtgctccctgcttggatttgggggttttcctcctggccatcttgtcactctggaagtctgtgtgttcaggatacagtgggagccatgccacatgtcactaagttctctaaaagctgggactccccacagagcagcagggagcctgctgtggtgctaccgtctgccgcccttgcctttctggctggtgacacctgaaraggctctgtattgctctgttgcattcctttctacctaaacttcaaggcccaaagctaaacccctccccaaggaggctttccatgaccctcccagaaggaaatggtctctctccccatgcccctcagcccggctgtgagggggctgcctgcacagcggctttacttcccaagagctgtgtgatttgggctcagccagcttcctcttgccgagccgtcccatctgtccactgagagtttgactggyaaccacacagggcagcctctggattagccacgtttcttgttctcaccgatgtctcaacccgttccgggagacaggcacagaagcaggttcaggsaaatcgcggacccacgagggctacaggcagaggaagtgctgggtgagcaggagcaggtccgactgccctctctcctggcatcttgaactttttcatgttgtttcctgcagagatttcttttctcttcagtcccatttctcagcctcctttcttctgtgttgccatccactattctgtttttctatgaacaggaacattttggcaaagrcaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgtgagtacctgggaagaaccaggtgaccacaagcacttgggaaacctggtgagcacaggggycagagattgagtcttttcagggacctgcacgcctctcctgatgctcctttttctgacctgtctgtgagcccagtgttagactgatgctgaatggcgttagtcattatgagatggccttgatgtcaccatgggctttacaggaaatccacatttaaaatgacgtgggttggttccagtatttcctttgcatcaatcaggactgccttacctactctgtgaaggcaattagcttatcacagagtaagtgaaatagaacaaaattgctatatattgcacatctccagccagtcaacatgtaccataatgaagaggtgctctaagagaggttgatcccagtcctggatttcactgagtcactgtggttttgcttgaccattcatttattcagcagacatttattgaacatctagccatatgctctgctaggtgctggacataggatggcatgacaaatatatatttgattctgttgtcctggaaatttcaaactggggagaagataaatgtttaatgaatagtcatgctattggatgatgaattacaaagtaagagatatgtttaaaaggggaaaaatatgacaacaaaataccatggccctatgagactgcaaaacaaagaaaaataggccctggacttggcgttaaggcaaagcttccttgaggaagtgactcttgagctcagtctgaaagatgagcagatgtacatttattcatcagacatttattatgctgaccatgtgctagcattgccctaaccctgaggatgccctggtgaacaagacaggcagggccctttctgtgttggagcttctgttctcctgcagaaaacctgacaataaacaatgaacakataaataagaacacctccagtagttaagtgctatctgaaaaacaagaaggaaaaaaacagccagaggtcatatagtgcccagaggctggagaggaaagttggcttctcggaagacataaaaaactaaatttaaatgagaagtcaaccaagagattgtgcattgactttgctttctaaggtgattaattccttgaatggggtctgtttgtttattgctggcaaatcccagcatttgcatgaagacagtgagtagtgctgayaaacaccaggcaacagctagggccgcttctgatctttgttctttttttatgccataggcccagaagccccaacagatgaatgcaagcctgtgaagtggtgtgcgctgagccaccacgagaggctcaagtgtgatgagtgsagtgttaacagtgtagggaaaatagagtgtgtatcagcagagaccaccgaagactgcatcgccaagatcatggtatgtcactccagccttcctagggcagcgtccctgtcattgctgcctgctggcccccaagactgagctagggagtgttcctgggaatgatgcaaaaacctggctcccaggaaccttgccctgactatgtgagcacagccccaccggaggttcagaatctttgagcttgtggatctgaagrgtgcccacagggctcagtttcctccttgtatgagtgtatggtgaaagggcaggctgagcagtgcctgcttagggaggctggaccatggtgtgggtgtcctgagaccagtggtgtgccacgatcactgagataagatcctgagtacatggtaggatccaatcaggtacaaatttgctttgttgatcaaaagagtatcctagcckggcatggtggcatgcacctgtagtcccagctacttcgaaagctgaggcaggaggattgcttgagcccaggagttcagggctagcaacttagcaggaccttgtctctaacaacattttttttttaagaaagaatattccatgttggcttacagagaatttttaaaatcctgaatgatataaagaagaaataaaaagtacttataatcatgtaattcagagaaaattcccttattgggatcatttcatgtaggttgcttgctaccttttactcactcacagtatctagtaagcttttcccatatcataaatcattcttgtaaaacctaatctggagcttctgtgttagtgcacacatcgagatgggggagtatggtttgcctagagagaacatgaagtgccaagctccactccccctcctccccacatttcttgccctctgtgtctcttccatttggctattcttgagttggatcctttataataaatcagcaaatatattgaaacaaagatgcatattataaaggtacttcctgccattgtcaacagatttttgctgaaatatgttaattctactttttgagcacttatgaataaccatgtatcttcagaactatctaccatgaagcaaaaagggaccatcaasctcattattttatatttcatacaatttatagatatcactttatgctattttaacatatattccattttaatttttgtctgagtcaagacaagaaaaaccaaactaagttaaagcaaagcctacaaattcaaaacctgagtctatacaaatctgttagcagtttgagtggctgggcttcaatattatactctggatgtgatacaatagataaagttttttacgtctgtaaaaaaaaggaagagcaaaagactcttgggaacatgtgaaatcttaaatgaagattaagtacaaccaaatgtaaacatattttaaaaggttcttcttggacatcataatttgctctcctatgaagatgtcatcgtttgagcctttaatgttggaaatagcttacagatgttggggcagaaaccaaagaccaacattgccatgttctgtgagaccacgtccaagtggatgattgctggataggtatgtttcatgcataacatttagttcataaaattatatgctactttaggaggtccagggcccatggattaatgaaacaaaagtaactaatctcattgctagtaaagaattattggaaacaaagttgaaagacatagtttatttggtcccacacctgtgacacatcatcactgtcaatgggaagccactgacctgtcccaatttcccaaggttgttatcatggacatcatggctgcagtagaaagtgaaggtgagtgtggaaaacagatcccaaagtgaccagtgccctcggttattgcagtaatcatgttcatgagtagacacacaggacttccaaagggagtcatcatctcgcatagaaacatcattactggtattactgggatggcagaaaggattcccagactggaggaggaagatgactacattggatatttacctgtggcccatgttctagaattaagctttgagcttctttgtttttctcatggatgcctgcttggctcctcttcaccccagacttcagtggatcagtctttaaaagtaaaaaatgggctgcccactgtggcatgcagctgtagtaccagctactcaggaggctaaggtaggaggattgcttgagcccaggagtttgagtccagcctgggaaacatagtgagacaccatctcaaaaaaataaaaaataaaaaaataaaaaccagaagcaaagggtgtacttctgggttgagaccaacactgatggcagctgttctggaaatcatggatcagatctaccaaaatgtcatgaattaagtgtatgaaatcagtagtcttcaacacaatctgtttattctggcttataattataaaatggaacacatttcaaaagagcatagtactggattgtgtgacagctttgttttctggaaactgtgaagctagctaggtggaaatattcagcttttattgtatgaaagtgctccactttctgcaacacgcagcaagttcatgaatacagactcactgaacctacaggggctggaacaattacagatgtgtggattacaagactggcagaagtgagagtcccattagtttgctgtgaaattaaattaaagaactgggaggaaggtggatactttaatactgaaaaaccacatcccagaggtrgaattcttatcggtggctaaaatgtgacaatgggatgctacagaaatgaagcagaaacaaaagctgatttatttgaagatggaaatggacagaagtgattatgtcctagagatgctgaagagtttgatggttgtttacagatgatcgatcataaaaaggaccttgtaaaactacaggcaggagactatgtttcccttgggaaagtagagccaactctgaagaatctcccagtaatagatgacgtttgtgcatttgcaaacagttaattgttcttatgtcattggatttgttgtgccaaatcaaaaggaacyaacagaactaacttgaaagaaaggacttacaggaacttgagagtagctctctaacagttgtgaaacagaagatgaggtgcagtagtccccctttatgtgaggtttcgctttcttgggttatacctacagtcaaccgtggtccaaaaatgttaagatattttgagagagagagagagcacattaacataacttttattatagtatgttataattgttttattattgttgttgttaatctcttactgtgcctaatttataaactttatcataggcttgtatgtataggaaataaacattgtatagggtttcaggttccaagactgggggtcttggaacatatcccttgaggataagaggggactaccatacktaaagtactttctgaagctgctatttgggcgtgtctgaaaaagtttgaaaatctattaaaaattggtttgagccctgacccatgaatcctgaaactggtctggtgacaggtgccttcaagctaaaacacaaagaatttaatacacattaccaggcagactctgagcgaatgtgtggaagaaatgatttttctcttttggcatcagtttgctacagtgagytcaaatcaaataggaaattatttgaaatgcatgtttcaaactgtgaggcaaactccattcttcatattcaacctagatttttacttcttaagacatcaccattttcaacagacaggattagtaaaatagtaggagagcaaacttgtgtctgtctttttccttttcccctcctacaactacctttacctaacctgtgactgtattgtcagtataaggagttttctgaatcatagtgaggaagcagatttctaaaacctcaagtttctaaacatgacctatatattcagkttatgtttaaagtttggatgtgtagagggagttatggaaaatatataaagtggctgttggggggtgctttttaacttacagtattaaaaaaatgcaaggctattgatgtgaaattacatacatttcaaatgcttatgaatcaaatcattattgaggataatatttgctgatgtgtaattactatcttgcatgaattaagagaaataaatatagccatacttacrttttaaagaaaaaaatgatattttaagactgatatctattccatagcatggatgtgcttccacttatttagctatttctctgtcattgagcatttagtttaattttctttttgctattataaatcacacctgttatttttgcccacttacacattttgtccaaatagttgcccaccaatctgattgttcttttatggtttattactagaaagtatattgccaggccaaagggaaatcttacaaaccttgttgaatctaagcatctctgaaatttggggcttactagagctgagatttagaacatttgaaaatatttgactcattcattaaacatgttgtatgcaccaaacacggaaatagcactcagccaaggaggctgacattagaggctagagccccccttcagaaggtgctgtgttccacagccacagccacgagtccctgactccactcatccatctgcacgtgagaattcttggtgtcagaaatgtgtcgtaggagtgtctctgggacagtgtgtcctacaagagggcaagaggactgaatgtgggtctttgctcttgaactaggcacctggagttgatgatcagttcatgatggttgggtgaaaatgagagtacatttgattttctctgctgagtgtgcctggctgatctttkgggggttcagtatcagcatctgctatctccctggcattcatgtgctggaaaggctgcttcaaggaaacagctggaaaagtgggtggcacaggaaacagcctcttttcatctgctgtgatttgctgtgtctttgcagaatggagaagctgatgccatgagcttggatggagggtttgtctacatagcgggcaagtgtggtctggtgcctgtcttggcagaaaactacaatagtaagtggtggggagcacctctctgtgttttcttccctcagggccatggagagaggagatggaaaaatcacagtctgattcataccacagctgccataaagctttccctctctgagcacctcctactttgcaagctctgggctccttcatctcaaatccccacagtcatcttgaaggttgggagttatagtacattccagaaatgggaaatgaaagttctgcactgggaagtcctcactaaagatgaccccattgcaaaggacagctgggatttctggcagtcttccaggttccaaaactcacacttctctcactgccctgttgctaggatttaaatatagttggctagcacgcctctgtggtctcagtgcagacagagcaggaaacttgacattcgcagtttgtggataaattctagaggccaggaggtgaaatggacttgcatgatccagagagtctggacttgttgggaattgatgacatgtatagataattttctctgactttctttattcttagctgcagcataaaaaaaaggcatggtttcccaatctataaatcagggtttaatgccttyttcattttcttttctcctgcagagagcgataattgtgaggatacaccagaggcaggtgagtttgaattggtaacctctggagttaaaagataaattcccattgttttggggaattggttagatttaaaattcaagtatataaggtgctgtaagagaccaattttcacaatgcgagagaatcatggaaggatagtaatggataatgatggttatccctttacacttgccatggcttgcacacaggatttttcatttaatgctataaggtaggttttggcatcctctgaggatacacaagtggaccctaagctgagggagtttacagacagatcrtctaggattatacatctaggaagggaaatccaggtctttcccactgatcctcacctgacatgacatgaggcctgcacattttcagataagagtaagcaccaaccaaggaactttgcttatttattccttacagggctcaatagagagcctcacacaggyagatatcaaggaacataaaattatctgaccttctagccagggctgggtccaggaacccaggccaacctggcttctcacccagggctctgggtaagggtacatctgaagaaacagagcaggagcaagtcaggaagtcttacaccaaggtgagcactggccccctatgctcaggcccctgcaggtcacattccagacagccattacygtacaagtctgtccttgccacttccactgattataacctcccagcctctccccatcacttggggagctaagcccttcagcagatatagaaaaagccattcttattctatggataataaagattctgttttctgttggaaactgtaatctgaattaaactggcaaactgaaatcataggttgatgttctatttcccattttaaggaccagtatatatttgctgctgaaaatggaagctgacttgatattgacattttccattttgcatatttattttggtataaaactatattctccttatcagaaaatgtttggctcarttttttctcttttgcttattgatcttttactactatatctcaacatatgttaatttatgaaagtttgtggttacattagctgtttcagtatccattcctctgataggactcattggatggtgaattgctggcttataacttcagtgactttatgcacttagggaagggttatacacccagccattgatctaatgatggtgttttcacaatattttgtttttaaagttcagattaatcttctcctgacagagttccttgtacttcccctcagtcagatactgggaagatcctctcaagacacaatgactgattgaggatatctttgcttccctagggaaattgattggaagcagacactctggaagccccagaggtgttaatacatccttttctggtgtctttcttgtagggtattttgctrtagcagtggtgaagaaatcagcttctgacctcacctgggacaatctgaaaggcaagaagtcctgccatacggcagttggcagaaccsctggctggaacatccccatgggcctgctctacaataagatcaaccactgcagatttggtgagtgaatattgggaaggagggctggtgagggccatgccagaaagcagggtcctgccttagggaagaggagtgtggcataaggtgctgtggsctctggttctagagaagtagaatttggtcaaagaacagtagaatttgctgtcctcaaggacatagcaacaagggctggaaggrctggaactgggttgctgagttgggacggttcatttaggttgaacatattagcatgagtgaatatacatttatctctcaggagaaagaccagaggtgagcagtgcatggctggtatggtcatgagaaacccaggctccttcacactttctgctcctctattctgagcataagacttccatcttcaaggtcaccccatggttgccatcgcatccatgatccaggcagccccagtcaccaaggggttacagcaaatggaagtttatgccacctttttaaaggagctctctaggaagtctaaccagttatttcagcaaacttctcattgcccagaacttaggtacatcaccatacctagctgtaaaaaagaaatgtaatygttcatctggaaatgtccctaccccagataaaaccagatttttgttacaaagtacaaggagaaacagatattgggtagacaggtagcaatccctgccacaaggttttgtatggtatgtgagtgtgggagatcccgggtctcttcatggtgttggcaatctcaccaagtccctacccagctcctaggacccttctaagcagtagaaatcacctcattttctatgtcctctgaataccaccaggtatgagcttatttctaccccrcttaaacttttaagtgtaagttctcctacagacagatgttttccagtggttctgatttacattagcttcctaagtactttgtccctgccacctccaaatttgggcaactctttaaaaaagaaaaggcctctaaatctggttattaacccagaaaaccctgtggggtcagggaagtggtgatgagagtatgcctctgtaccagggtgctttgtgacaccacttagacatgaagcaaagtgtggccaaggtgacattcagaaaactcaggatccccactgacaaaggcactacctctgccctcctgaacctcctagcacttttatggccacaggagagcagctgagctgcaaagaaaattccccatccctttcctgaggttggagatgtagcaaaggctcttctaatgaatggcagggaatggggacatctgaaaacaggtggcacaagctcaggaagcaagaccttcagtcttcatctttttctgttccctttcatgacatttttcatctcttctttgtttagcgtagtgatgacatcattattgtgctcaaataaatcccctctgccctgaattgtaatggtcattaactccttttcccaatctcaataggttcccctttaaagcctatagcctggcaagtcctgggttggtggtggctggtcacagaattaatgaatatgttctacttattatgggccatgcagccctgttatctcttaaataaaagctgcttgcattgactcaggaaaagctgacttcctcttgtccttctgcacagatgaatttttcagtgaaggttgtgcccctgggtctaagaaagactccagtctctgtaagctgtgtatgggctcaggcctaaacctstgtgaacccaacaacaaagagggatactayggctacacaggcgctttcaggtgagtcttttaaccctgaaacaaatagaataatatacaagccctggccagatttcttttaggaactaaggtaagattcttaggttcctattccattagtgcggcatgtattaagagagtatatttcacaaccagatatagagccacatggggaggggcagccagactcccccaggatgctgacatggctgtcaaagacagcagagacttgtgtttggtacagtttagcagttgtcaacgggtgatttgacccccacgggacatttggcaatgtttgcatatattttttattgtgacaatgttggggtgggggaggaagtgctactagcatctaacacgtagaagccactaaacattcaacaatgcacaggatagcatggtacaacaaacaattatccagccccaagtgtcactagtgcctcggcaatgataccctactgtagttgaataaacactgagtggagtggagagtttggctcaagcttttccaygcacctctggataatccagaacaatactcatctggaaatacagaatagtacatgattcctaaattcctaactacaattgtactttatggagtgcctatcattcattttcatagagatacctgtgtascttgctatttttttttttttttttttttttggagacaggagctctctctgttgcccaggctggagtgtagtggcacactcatggttcactgcagcctcaacctgctgagctcaagcgatcctcccacctcagcctccctagtagctgggattacaggcatgcaccatcacacccagctaatttytgtatttttttgtagagacagggttttgccatgttgcctaggctggtctcaaactcctgggctcaagcaatcctcctgtcttggcctcccaaagtgctggtactcacaggcgtgggccacgtctggccctaccttattactttttaactacccattctgctttaggccttctgttatttggtggttcatgaatccatgaactgcacaatgatgatggtattataactgagcttccccgtaatgatgtaaaaaacaaaggtcattcctattttccagttagagccactttgtaagttagattaagtacaattcacattccccaagtttctaatttcacaaagtagagcatgttgttttcataaagattgaagagtttgggggacttaaaatagagttcccctttgcatttttgtaccttgtctttttctggtgataacatatgtttgagaattataggtcatgagaaaaggctcaaataacatgtatgtataaacatgcttaaaataaatgtgtataaaggcttctttttctaaacatgtcttataaaacttagctatgaagtaaaatgtaccagactgataaaaagactccaaactccaaagaaaataaaattaaatcaatatgtggcacaataggtaccccgtcttctcagctagctacccccaaaactcttgaaccgatgcagtaataggcaggttcttttccttgaagcaaggggattaaagtacatggagagcagggttcagtccattgtccaaaagtccaacccactcggctcattgaggagggccttgtgtagattttgaagtacacactagttcatcatctgtgtggtatgccctttcaaaggactggaagacagtcaaaattaaaattagaaccctactaaccagagtttattttgttattatttcttttctgaaacttcttggggacttgtagctcagagctgtgttacaacccccattaccacacccagagatatgtggcctgggagttagtagagtcaggtgcctttatgccatgttttgccatattctctgcatttctcaaaaacaaaaacaaaaaamcccacaacatagcaaatgctccataaatgttaaaattctttttcaaaggaatgaaggacagcacaaattgcaatttgtgatggagtttcagtctctcacaaatgttgcctagacattcgccttgtatgagaacctgaaggaactgagtttttcattcatatgctgggggaggcatcacctcactgaaaatcaattccctactatccttgttgatgtcagggaaattatgtcatctctcagagaaacagtacaaaaaattaagatttagtatgtggaactgagattgtaaaactacaatcaattcagagkgttttgtttttgttctctttattccttacattgcttactgttagaatggaagttacagttgctgttttcagatggctgtcctgaatctataaggtagccccctgaatgacagataagtcactctgaccgcctttttttttctctcccacttctggacctctgcaggtgtctggttgagaagggagatgtggcctttgtgaaacaccagactgtcccacagaacactgggggtaagtgcacctgctcctctgtccccctagatcactagatcctggtcactggtattcacttgtattcagggatgcctttgtggaagtattatgtacactgtcagacttcaaagctctgattctcagtctgtctgctcagtgaagagagacatgttcacctgagtgcrcagaatgatcaggattatggggcccccaatggccctaaatcctccccaacacacactcccacagctgcaagccttgtgctcctttcccctaaatacttcagtgcctatttcctaagaataagacaatctcttgcatacccacagtatgattaccaagatcaggatcttttacattatgtggatttaatactcgtcacgtccacagtccacatttaactgttgtcagttatcccagtaatgccttttatagctatttactgtacttctgggttgtgtccattgagaaggcctagaggcaatggcataccagcaggagtaagcaccaagatattggcttgtaagtactcttctttactaaaaggaaccagaactccttggaaaaatagctgacttcagggctggggcaggaaaaatagatgctgagcctagaacaacacactgaagtgctcmaacagtgatgggacactcaaagcatacaagaaccaatttgaaggatctcctgttgccaagtctgggaattttgagcattaaaataaataatgatagcagtaagggataatagcccattgaaagaaataagaatgcatgaggcaatactgattaaacaaatgaagaagggaaaactaatcaatgtggaaggaatgatagagttagaaaactatcacttggcaaccaatatattgataactgattcaagcaagaatcaatgggtgttaagccgggcgcggtggctcacgcctgtaatcccagcactttgggaggccgaggcgggtggatcatgaggtcaggagatcgagaccatcctggccaacaaggtgaaaccccgtctctactaaaaatacaaaaaattagccgggcgcggtggtgggcgcctgtagtcccagctactcgggaggctgaggcaggagaatggcgtgaaccygggaagcrgagcttgcagtgagccgagattgcgccactgcagtccgcagtccggcctgggcgacagagcgagactccgtctcaaaaaaaaaaaaaaaaaaaaaaaagaatcaatggktgttaacttgtgggtgaacgttggacagccataatattaataaaaacaaacaaaacaaagcaaaacaaacattggccagactgagcactccacacctgacccctcagtatcactaagtgctagcagagcccactggaattcaagctgtgaatacttccctgccttctctcatgttcattccccaactcctcacttttcctgggcaactcatccagaatgaaccggctcagcaccagcccctccaggaagccttcccagatggcataccctgtcctacaagaagactcctctgttcatattgccattatgattgaattcaccacactctgtaatacactttggctacagaaactctttgagctctttttcttcatcttatattcccagaacctagtgtagcacatagtacacagcagttgctaagaatttgtttgcagaaatattgggttgactaattttcctttcttccctcgtattattgctttttcctttaagagagtgttaccctaagcttggctctttgccacccttgatttcttttggtacttttctgagtagagctcccttctttaagctttgactctcttactctttgcaatgactcaaaaattcttccctcctgcatagaattaagataggaggcctgacatccaatctcaattccattccagtctatttcccaaggtgtcacttttatgtagagagtacattggcattgcaattgtatttttttacgtgtgtatatggatgtcctcatatattgtagttgtatatatacaatccatatacaactcaactgtcctcatctttctgtcaacgttccctcctcttctcccagcctctatccttatagagaatcctgctatactccctgcccatcaggcctagattaagtctgtcagtcaatatcttatttcttcaaaacgtgtcttttttcaaactaaattttattgtgtgtatttaaggtagacaacatgatttttaagagccaaagtaattttgatgtattgtaagtttgggaactactggtctaatacccctgacttaatatcacattcctgataaatattactaaatgtaagtcacatcatgtctgattcatcatacttatattttgcaccttcttaccttcttctgttattaatttgttgctttttcaacttatattttagattgagggtacatatgcaggtttgttacatggtatactgcatgatgctgaggtttgcggtatgattgaacctgtcacccaggtagtgagcatagcacacaacaggtagcttttcaactcttgcccccctctctccctcctccaaaatctgtcttaagtgctatggtatatacaagaaggaagacacaaaaccacgtgggctttttttttttcttttttttctttttgagatggagtctcactttgttgctaggctggagtgcagtgatgtgatctcagctcactgcaamctccgcctcccagatttaagtgattctcctgcctcagcctcccaagtagctgggactacaggcgtgcaccaccacgaccagctaatttttgtatttttagtagagacggggtttcaccatgttggccaggatggtctccatctcttggcctcatgatccgcccacctcggcctctcaaaagtgctgggattacaggtgtgacccaccgcgctcagcccacatgggctcttttatcacaatttgtgtgkgtgtgtgtgtgtgtgtgtgtgtgtatgtgcatattataggtgtgtgtaggaaaaagaatgttagaaatgtaccaattttgaaggcgtagactatgaaattacaaatgcttcaaaattttcttcccaatacttacgtggcattttataaatttccaccaataaacgtgtattatttttattgaaaaagcatatttttaacatgcccttctagatgccctcctagccagactgaatcacctcccatttgatttttcttaattttctacctttaggttctggctcattcattaacatcaatttccattcataagtcctcacaaacccacttttcctcttgcctgagtgcctcacataccctactgcctgagatggttccagaggcggtctcctctctcccttagaaacaccaggcacacacctgcccccagtctcgcctgcactctcctttcctcccgcagagaggcattcctttctcctcctctcatcctacacacactataagagacaactgaaatcttgcctcctccagccagcttcttaattcatttgttctcaaagccctggtttgagctcacacagcatctagagtgttttacaaaatataaaatattattatccctgccctgaattttttgttttggtatgtgtgttattttcccctccaataagattgtgccttggagagggctgagaacatagtatcatagataaatgaataaaataacataaaataaaataaaaatacatataccctttgaactaactattccacttctatgtaagcacaattatatgccagtaacactcattttaacgctactttagtggcaaaaaattgtaaacacctcagatgcctattaaaagaggaatggtttaaagatactattatagccacactatgaaatataatacagtagttaagaagaacgagcttgatttgtatgtactgacaagaagaatctataaggtatgtaaacagttgaaaaaaaagctacagagttttacatttgtcaagatctaacactaaacaaaattagaaacatgtgaaatccatatacacacgtagaaaaatacatataatgagccgtggatggaaactcgcaaatgtgatattaaagactagcactataagactgagtgagatttggagagtataggaaaggaggcttttagttaatatagagagatattcaaaaatttatgagtgtgatctcatgtattagttattcggttaaagaaacaaaattaaatgaaaaatacatttttaaaaaggttgcaattctgaattatgggagagaaataaaaattagcaaaacatatttgcaaagtggctcaggaggaaggagctgaaaccctaagaatgggtgagtttttttttttttcagagacaatacagaaaagaagaggcaaaggggccgagatgggatacagacctgtatcacacaggtgtgtgcacattctcatttagaactggaacaagggagtcagayttaaaattctggtgcagattccaaaggtgttctctgaggaaaagttcttttgtttggagatgccatgtgttacagcacagaaattgatcaacctggcttagagcgtcacattcttcctctgttggagcaagaggtacagaaggaattggaatttagtggaattgaagatctttttgaacagcatctgcagaatgtagttcattctcacctggctgggtagggaaggttggaaggggatggtcaataatcattcctggtcactgtgagtctggcatcaccttgtagaccacatgggtgtctcttcctgtccacatcactgtaaccccagtgtgggcacttctgctggcgagaaggcccaggttctctacacaccactgagtcagttccatctccccagcggggcaccttgaccaaagccatcagctgaaccaccttcttcctgtccctaggaaaaaaccctgatccatgggctaagaatctgaatgaaaaagactatgagttgctgtgccttgatggtaccaggaaayctgtggaggagtatgcgaactgccacctggccagagccccgaatcacgctgtggtcacacggaaagataaggaagcttgcgtccacaagatattacgtcaacagcaggtatggaccagccaggtcctcccaccttttcttcctagatggccataggctattcggggggagtttamaacaaagtgcagccatgactccagcactttctttttgaaaactagaattccatgcattgtgcatttcatgccatgcattgtggactagagtatcagggttcaaatcacagctccacagcttcctagttgtgccatcttgggtatgttacataacctctctatgcctcagcttcctcatatataaaattgtaataataatatttttacctacttctcagttaacatgagtattaagtgaagacatgcacccaaacggcataggaaaattccatttcctataggacgtgctcaaaatatgttagctgtgtaattatggaacyagacctctcaggcccagctctgcttctagctcctggtcactggtgattagatctgatccatgtactcttgggactaggaatctgcctttctgctccccctaaccttgttcaggggtaccctcatttcccctactcctgtccttcccgaaaatgaagaagacagctccygtttcccagcgcttgttgatacgagtcatgaagagtggatttctgttcctcttgcctaggcagactgagcactgttctcaacagtctgaaaaacacaggacccttgccctcggagagcctgccctctgggggaacaaccactcagggccagccttgttgaagacaggggctgcctgagtattctaatcctaaaggcccctccacacacacacatcaccttccttttgggcatagctgcctgctgttgattcaccattacctttttttaaaaaaaataagagtatatttgaagtccttttaaggtacatgacaataataagcatttaacatacatttcctagctgctatatggaaagttcaacattttgcagtcatcatttcacttacaacctttggagatctggagaagctgagtggcttgcccaagaaaggattcaaaatgcrgtcaaacatgaacttttaagaactacctctgccactcctctgggagggttcacatttaacatcttctttgacaataacatctgaagggacatgttattgtcctctcatttcctataagcagcccccagtgaagggcaatgaagtggggaagagaggtcagagtaggcaggcatgggtgtgggtgggagggacttatcagaggaaggtgggamcagggaccctatagatgattttgggggcatcatgaaagcatgcagctggggccctaagtggataaatggcagataaaggaggtggaaaattcccaagacatactccgtagcttccctttttccccagggctggttcagagctttcagactcttctcatccatgtgttcccagctgctaaagaccacaaggtcctcacggactttctgttcacttgacagcacctatttggaagcaacgtaactgactgctcgggcaacttttgtttgttccggtcggaamccaaggaccttctgttcagagatgacacagtatgtttggccaaacttcatgacagaaacacatatgaaaaatacttaggagaagaatatgtcaaggctgttggtaacctgagaaaatgctccacctcatgtgagtaggaggaacagcatggggaagtggcaaccaaacatggtggtgagtgctgggatggtgggtgggtacaggaggggtaggctgtggcccttgggataggacaacatggacaaaatgaaatggtgagtgaacaatctaagcccggcatgtatgacaggctagactgtaggggcagatagtaaggggatacaggctcagagcactaaggtagtgaacttattgggtatagagaattccatcttatttctaagaaaaggactgggtttatgtgtacatgccattgctctgcagtaaacttttgattagagttgccttgtccaatatggtagccaccagcaagatgtgactatttaaatttaagttaattaaaattaaactaaataaaagatgtatttcttcaatcccacctagctgcatttcaagtgctcaacagccacatgtggctccatattggtcagcaaagagaaygtttgcatcatcacagaaagctctttcagacagtgctgctctagacagcttcaacaatgataggttctggtaaccataaagttgctatgcatactactcatttggaacaccagtttctgagaactgaaatagaataaaacacatctttgcagtataactatgttgggtgtaactgagtcacctgaaaaagtttggaagctggggaataacatgtggtgtagggcagttagtctttccacaggagtatgcagataagggagtcttgatccttattaaaatgctgattctcagagccttgagatactgatttagaaagtctgtgctaggtcaggtatccgcatttgaaaagctgcccccatgtaattctgacggaagcagcaatgtgcttgtctaggttcgctattgtgagaatcaagttgatatttacctaacctatatcctccacaaaagcagacagtctggctctgctcttctttcctccatccttagcccacagcacagaaactggcacattgcaggtgctttttgctatgtcagttcctcacctgcttaaagaggtcagggaggacagtcttcctgggcgactcctggcctcaggaactcagatgtgtgagcctcgcccataagaaacaaggtggaggaccctgtagggcaggaaaatcatgttaacagctttggcgtggggcactccccaggataggcacaggagctgtgcaggcaagtagaaaagagcactgggagaacggcccagttcacagaagaggaggcagcaagtctgcacactttgtactatgctgaaattgttcaatcactcgacagttcagaaataaatataggaagattttgaaaatcctacctctctgctctgctccacagcactcctggaagcctgcactttccgtagaccttaaaatctcagaggtagggctgccaccaaggtgaagatgggaacgcagatkatccatgagtttgccctggtttcactggcccaagtggtttgtgctaaccacgtctgtcttcacagctctgtgttgccatgtgtgctgaacaaaaaataaaaattattattgattttatatttcaaaaactccattctttcctaaatattttcaacaaaggatttctttatgcattctgcctaaatacctatgcaactgagcccttccttctcagctcaagattcgtctggtctttccctacagctttgtgtgtgccatggccacatctcctgggtacagttcaaggagacatcttttctaaaagggtctgcgtgatcattaaaatataatcaaatgtatactggtgtgtgtgtgcacgtgcrcgtgcgtgtgtcatgctaaggaaggggcaagaaggaggatgcagagtgagttacagagatcaagtactcaagtgagtacagaaagactacagaagacttacctttatttggtattttaaatgaattccatcaggctgaggtcctgattctaactagctgaaaaaagtgaaacactgacatcttttttgctgaaaagcattccctgagcttgatgccacagcagttactgccctgtctcctgcccttctcagcccagcttcctgtaaggtggaggctgacttttctgtctcacttattattggctgaacatacagaatttggtcttctgcttcaccaacttacctgaatgtaccctggcaaaagtcaccgtctacctgccaactgttaaaccaattcaggtcttccattcctgagcccatttcctgcagttgataaagttgaccactccctcctccttggaactcttttcctcagtttctctgacatggcaggtctctgctttgattcctacctctctctgttcatttgtagtcttcactgtgggctcatcctactggcctggaaaccttagggaaatcttcctggggttttctcttgatctggtcagtgctcctctcactttgcaggccctccttcagtgatgctcatgactcctaggcatctgtatctatagctgtgaccccagcctccagcagtatccctgcacttatacatcctactacctacctgtgggtctatactcgagtcttgcagcagtcagaaacccaacaaatcaaaaattgaagtgatcatcctgttcttctctctcttgcttccctaaaccaactgttgttatagtatattccatatcagctgaagacctggtcatctacccaatcacataagccataaatagaggggtgaaatttcagttcgccattttccctcacactacatccagcgtcaccaagttctgttgattttgctttctaaataacttcagttggctcctttcttttcctgactcctaacacagcctcatcttatactcaaatacagaagtgcagataaggggtatctggacacaacattccacacctctctcaactgtctagtattcaagaaaataggactctgggtccactttgcagtccagacctgatatggaccgttttacacacagccctgctttcctctgagcctatcaacgatctgccttatttaatattaacctaaacttaccccaaatcctataactctgccttttcctttgtttggtgagataccccatggctcccctgggacgcagtctgtctcattgcaatggatcaataaacctaattttattacactacaggtatattcctggaagtcttagacaactgggctaaaacaaaaatattcaacatccattcttaattattaaattagttactaaaataggatagacagatgttatttggccataattttatatacatgtaaacaaaagctaatacatacctaatgatgaagaaacagaagcattcctactaaagttaggaacatgaaaaaaattgattactatctatcttattttacagtgttttagaacaggtggccaatccaattatacaagaaaaataagttataatatttaaagaaatgccaaaattacttttatttgtaagtgattatacacctaggaaatccatgagaaccaaataataataaagtattatggccaggcgcagtggttcatgcctataatcccagcattttgggaggctgaggtgggtggatcacctgaggtcaggagttcaagaccagcctggccaacatggcgaaaccccatctcttctaaaaatacaaaaattagcctggtttggtggcacacacctgtagtcccagctactcaggaggctgaagcatgagaagtgcttgatcctgggaggcagaggttgcagtgagccaaggtcgcaccagagcactccagcctagtgacagagcaagactctgtctggaaaataataaaaataataataataggcagggcgtggtggctcacacctgtaatctcagcactttgggaggccaagtcgggcggatcacctgaggtcaggagttcgagaccagcttgacaacatggagaaactccatctctacttaaaataaaaattagccgggcgtagtggtgcatgcctgtaatcccagctactcgggaggctgaggcgggagaattgcttgaacctgggaggcagaagttgtggtgagccgagatcgcaccattgcactccagtctagacaacaagagcaaaactctgtctcaaaataataaaaataataataataataaataaagtggtaaaagtggtaagataaaattcagtaaagtgaaaggaaatattaaaataaaaaataactttcttttatacaaataatagtgagttaggacaataataattaacaagaataaataaaatgtatcatttagtaaattaataaaagctacatttaaaccacacttatcaaagtaaaaaataatgtaaagaagacatattgctttggataggaagactcagtattgtaaagatgtcaattctccctaaattaatcaatatacaattttttaacttgacaaaatgatactaatcctcaactaaaaaacaaaagtgagacagataagaaaaattctgatgagagtggaagagctcttccagctgttaaaatgtaatgataagctcctgaaccttggccttagcaatgattttttggctatcacatcaaaagcccaggccacaaaagcaaaaataaataaatgggactacatcaagctgaaaagcttctgcatagcaaagacaacaagcaacaaaatgaaatggcaacctatggattggaaaaaatatttgcaaactatatatctaataagatacaacaaattgataaagaactcatacaactcaatagcaggaaaacaaatgatcccagttaaaaatgggcaaaaacctgaaaagacatttctccaagaagaaaaatggccaagatggatatgaaaaggtgttcaacatcactaatcataagggaaatgtgaattgaaaccattatgagacactagataataataggatgactattatcaaaaagtcaaaagatattaatcataaacgtggataagggtgaagagaacagaaaacctttgtgcattgttggtgagaatgtacagccattgtggaaaacagtatggaggtttctaaataaactgaaaatagggctacatatgacccaacaatccctctttaggggatatacacaaataaaatgagatagccaccttgtagagataaatgtgatcccacgttcattgcagcattgcagccaatatagggaagcaacctaaatgcctgttgaagaatgaatggataaagaaactgtatacacacacacacacacacaatggaatattattcagccctaaaaagaatatcttgccatttgccacaacatggatgaaactggaggatattaagtgaaataaggcagatacagaaagaaaaatattacacgatttcactcacatggggaatctaaagaaaacactcaaatacaggtatacagagataacaaaacctgaggtggaggagggtggagagatgtaggtcagaggatacaaagcagcagataggagggctaggcgcagtggctcactcctgtaatcccaggactttgggaggcagaggtgggcagattgcttgagtccaggagtttgagaccagcctaggcaacatgacaaaaccccatctctgcaaaaaaaaaaaaaaaacaaaaaaaaccccaaaaaaccaaaacaacaacaaacaaacaagcaaacaaaacacacacacacaaaaaaaattagcgaggagtgctggtgcccacctgtagtcccagctactcaggaggatggattgagcctgggaggtcgaggctgcagtgagcagtgatttgatcgtgccactgcactccagcctggggacaggagaccccgtctcaaacaaaacaaaaccaagtagcagatatgcatgatgaacaagcctagagatctaatgtacaacataaggaccacagtataggtaataaattctactttatttgggattcctccttcactgtagtaatctttttttaactatgtatgtatctcataacatgttgtataccttaaatatattcaacgaagcttattttaaaaaatgaaatgtataatgatgactggaaagggtggtagtcacatggaaataatgaagcagaataaaagttccagatattaaatgcaaatgagaatttattacatgataaagctggcattatactcgggggggacagataggctactcactgaagtgtttagaagcagagtagctgaaaattttggcgcagaagaaaatctcgtggacctccaacttaccggttaaagtaaaaactttcgaaacgtataaaggtttaaatataaaattaaaatcgtaaaaacaattactatgttaacatatttcttatatagtacttagattttccaacattccacaaacctagtagcaattaaggaaaatattaatttcagatcatataaaattcagaagtcctgtaagacaaaaatagacaaataaaatgtgaagatttttaagaaagaacaaagggctaatctatattttgaaatcagtataaaaagacgaacagaatttgagatgtgagcgcggacagctctgctgggccctccaggccctccgcccggtagaacccggagccctggccgcggctgccccaccgggcccatttcttgaagcagcggcgaaccacttttcctccccgacctgccggctgcagggtctccccgcccaaccctgccaggctcagacgaagcttctgctgagccgcctggacgcagcgcccctgggtggcggcaggtatagcagggcgggaagcagggaggcggccccaacgccgcggaggccaccagcgggtgcagagggccaggaaagctggtctgcgcgcggctcagctgcctccgtaggccatggagccgagcagatccgggtcttcgggtggccgcaatgtcccaagtggacgacacccacctagtcccgaggacaaccgacaaagtccttaatgggcccagaaggtgaggggagtccggcaatgaggggtggtagggttagcggccatcgcccagctcgtcttccttctaccagacgctggtgctggaaaagagaagtgtaagaataacttgcgccattaggcccatcggaaaggcccaccaccctttaggaagattactggctgtttatagaaggcccgtgtatatcctatgaagaagctgctctcaacttcccccccagccttttaaaagaaaacatttgctacatcgagccgttctaggtgtaaagaggttgtgacttatgatagagttagaaaatcacacatcttgtaaattcccatttgttaaaaaaataataataataataataataataataataataataggacataaatggcttctggagatgactttttgcaatgaagttgttagaccacctctggaagtgacagcaggagccacacatccacgtttattaagtgagttagagcaggagtccccaacccctggatctaggttgcacgctccttatgagactctaataatgcctgatgatctgaggtggaacagtttcatcctgaaaccatgcccctaccttccatggaaaaattgccttccgtgaaaccattccctggtgccaaagaggttggggaccactgggttagaggacatggggcagaagacctgagaaggaagagaggacagttctgtgccacactggtcatatttagaagacattttcatattccaaccattgttctgtgtgtgcattttatttctcacgactgtatatgtagttaacaatactattttttgaactatctaccctttctagatgttctgaaatgcctatgttaaaattagagatagtaaaataacaca

SEQ ID NO: 12275 - DNA, 57579 bp, Homo sapiens
  misc_feature (1)...(57579): n = A,T,C or G, or insertion/deletion polymorphism (see Tables 1-2)
tgtttcacttaatcctcaccacacttgtgggaagcaaggtgaggcaattattcctatattacggcggggtgatctggtgcttgaagagggtaggtgacttgcccaaagtcacacagccagcaggtgtttgacactgctgtcataagccacactcaacactgtgctgtactaagcaagctgagttgcctgagcttcaatggcattttaaaattatttaaaggactatcacttgggagtaggtgtaggttgctctgagtggtcccaagagaaggaactgggacaaatacttggaagctacaaaacagattgtaactgaatataaggaaaacattctaatgaatagtaagagttgcccaaagatggaaggagctttggtgtgtgaaggtgaaactagctcaatttcccccgagaactgatgtttgccatttttttcctattaaagctagaaatggaccctgcttttcttaatgcttaaaacttacatttgtcttatctgaattcctttttcaggaaaccctccgacttccagataatatcgaggaagtaaaactcacatcaccacatccagataacgagacaccagactcctctccttactcctccataattcctgttttcctaaccaaccatctgcttcccgttgaccaattgttcttccttacccctccttaattcctgttttcctgtgggtagctacactccttccccactatatacaccccaatttaagttggtcgaagatctgagacttatctccacttatctttatttggcagcaccaaagaaagccttcttcccccaaaaatacttgatccagtgattggctttctgtgctgcaagcaacaggacctaaactgaacccctggtgtttcagtaacaaaatattgcattccctacctgtgaattgggggtaatactagcacatgctgcgtaattgttgttttaagtaaataagtgactgtgcagaactcagaacggttcctggtagtcgtagcacagtactttttataagcgtttcttaaatttaaaatgaaaattaatgaacatgttcaagcagacatggggcattgcctgagtcaacgcagaagacaacttctcaggattttccccagttactaccacgtccttcctctaagaacggcctctctttccatcctcaatgaggagagggaaggccatgtttgtagccctgtttgtgcctcatggtctctgcacactaacctcagtttagggtggacacaggaccaagctagactcatcagagtctctctcttggtactgatggtcactgttctgagtttctgttcattgctgcaggtgaggtgagatagactcaggctctgtgcatggagggcagaaaactccagactctgagagaagcatgaatcagatgtgcagagagaagtggagatctcagactacttggtcccagaagagagaagcagcaactgggagaccagctgcttgactgctgagggttctgccatgtctggtccaggccctcccaaggcctggctgcatttcctccctgcctgtgagtgcatgtgtgtaaacacggtagctattttttctttaaaccaatctaaaatgagtttctgttgtttgcaatccacagagatttaactaggatgaacctagatcactgagctgcaaggcaagaactccatgagaggaattccaggtagaaggccaagtaggtgctcaggggagagatttgagaccagaaagtgtcaggcaactcctgtcttcactccctccctctctcaaggctatgtatgcactgttctctatttcctcttttcacggttccatttgtccccctctgctgaacagcttctctctgctatcatccccttccatgtcccctggagctcacctggcttcccagctacacttccctccctgactcaatttgttgagtcagtttgttgagttgatttgctgagtcagtttgtttctcaattctgtttttacattccttggagagagtatctgattggctgtgcttgggccaggcattcattattgattccatccctagtgaacagggggtgtggccacctgggggttggggctgccccttccagggacgtgagcagagcagattccatgaaaggggtatggagaaggaagaatcttagtgcaacagccactcagctgggatgttgtagaggagattcaggcttcaagtggtttcatgacttctaatcttaggaaaggtccttcatttctgttgtaataacaacaacaactagcatttattgaacttctataatgtgtcagatgcccttctaagcacttcacatgcactgacttaacttattcgatgcctgtaaaagtacttagatgggcagtagtggggaggggagggcaacaaaaaacgatgtcactagggtgttgctgtagattggatgtttgtaaccccccaaaattcctatgttgaaacctaatgtgatgatgtttgcagtggagaatttggaagatgattagggcatgaaggtggagccctcatgaatgggattagtgttcttataaaaaagatcccaggccaggcacggtgcctcatgcctgaaatcatagcactttgggaggctgaggcagccagatcataaggtcatgagttcgagaccagcctgaccaacatggtgaaacccagtctctactaaaaatacaaaaattagccaggcgtggtggtgtgcgcctgtaatcccagccactcaggaggctgaggcagaagaatcgtttgaacccaggaggcagaggttgcagtaagcagagattgtgcctctgaactccagcctgggcaacagagcgagactttgtctcaaaaaagaaaagaaaagaaaagaaaaaaatcccagagagctccctaactcctcccacaaggtgaggactcagtgagaagactgctgtctatgaaccaggaagtgggccctcaccagatatcagcgtctgccagcaccatgatcttgaacttctcagccactagaattgtgaggaataaatttctgttgtttagaagcctcccagtctgtggtattctgttacagcagcccagctaagacacaggttatctcattccaacattcaacaaactgacctacgaagtccaatctcaatttgatccactcttactcttaatgatctatcttataaaacagaaacacatcttcctgacattttcatcctcacataaaaattcttctatccattgataaggttttgatgtttaggcttttaaaacaaagatagtttatttctgaaaaaaactgaaaagagaactagaaaaagaagataaatcacaatgcacagtgcaatgaaacttcgtttttaaaaaatagccttattaacatataattgactatacccacttaaaatacacaatttgatgaactttgatcaatgtattcaccagtgaaaccatcaccacaatcaaggtaatgaacacacctatcacctgcaaaagttttcatgtgcttctctgtaatcccttcccttcctactcaaactcatgcctcttgtcacaaggtttctccactctggctgttgggaacgaactattgcctggccaatgcaagctcagaagtttttctgccagcttttttctagtggttgcctctctgtcttgggaagtttcctcacatgcatgtacctggtcgaacttctgctgaagactcagaggaaccctgcacagatctccagagctccctccttccgttgcactctctcctctctggtactctagccaccctggcctccctgaattctcagctctattttccaactcagagtctcttttggttcgcctgtctgcattgcggcttggaaaccctctccaggcagtaagctggagcaagcagcatgttcacttcctttgtctcccttctcttgggccctgcattgcctgttgcccaatgtctgaaaaccattgttccatacatttttttcacagatttttcatttcaggtcacagagtaagtccagtccttgttgctccctcctggctgaagcagatgtcaacacttatttttaaaaaatagaaaatcatttacaacaagctcattgcaaaaaaaaaattcaacaaagtcttataaattataaaagtcagtatttccccttcagtacttgcaactcacagcccagaaataaccactgctcacggtaaacacaacattaaataatttccacttctcccaaaaagacctattgtaaagttgcagatgcaggaaaatctttgatggtgctggagggatttagaaatgaatgcccctgagaaatgctgtcctctcccctgtccacttccctaccacggaacatgtgagctagggctcactctatactgacttctctttcacggtcccaaaggcaggagtgaggtggtcaaagtctctgtgaaggcacataaaatcatgtatgtgaaagtgtttggcaaactttgaaatcatgtacaattcttagttaatattatatattatcatgttatttttaatattaataacttatataacaactagtccttggagggtttgatgataccctcagtcagcattttcatcactagtgaaagtttctcctcataacaatcctgctcaagctctccaaggtctatggcaaaaaataaaaataaaaaataaaaagcattatgttgcttcaaggtcatcttacaatgactgcagttgtgtgggatgagtatgccatatgaggaagaatctccaggccgaagtggtacagtccagacacagcctttagagctaagaggccatttcttttagcctcaaaaatcactcaaatatacccctgcaaaaactttataatttctccctttgatggaatggcaagtaacattgagcttttttctttcttttctattgctaccttttaattttacctcctactctgatctggatctgcaagcaatgggttcctaaatgtcaactctggagataataaacacatagcagagactgatattttcccaccaattatttattctttcaatcctaaaaaatacagacacttaacagtgttctatttacaatgtgcgcatccaggcaaaaatttccggacaggctaaaaagcaagaaaatgcgatccacaatcaggagaaaaatgaatcaacagaaactgattcagaaacaaacaagatgcagatgctgctcacagaagtctagaacgccaaggtgaagcccccactgggttggacattttcttattccttatgtcatttaaagcacaactcccgagattttacgtgatataaccgctagaggcctctctgtcacaggctgtattactcccaggtccccatgttggctgtgttcagattttttgttatatttgtggaaatctgagtgcatgtgacgactgctatttatgggttttgtttttatttttaaagacagggtcttgttctgtcccccaggctggagtacagtggtgtgatcacagctcattgcagtctcgaactcctgggtccaagccatcctcccaactcagcctcaggacttacaggcgagtaccacctcaccaggcttgatttttgtgtttttaaacagactgaacatctttcagtacttcccatccccacccctcccggccctgactccgccaccccaaccccgccccactttgtactacccaagcacatcttgggaacatgatgcggaaagtcagggacgctggaggtgaaggactgatgacgcgctacggtggtcctaggtgcgcgtgccccctctctggagtagtcccgggggtcacgaggatttgaagacaggccctcccttcccactgcccccattcccccgaatgccaagcccctgtgggcaggcgccctgggcaggtgtggttggttgctaaagcctgctgggcccagacatgaaccctgccctagctgggcagcggcgcgggagcaaagttgttctgaggctgccctccccggggcctgctctcccagccctggaggagccggcgcgagacgcgcgggggcggggccgcgcgggggggcgggrctcaccaaggctccwccccgccgcggccactgttcgcacacacctggtgctgatcaacgccgaggccgactcgtcgccacccagcgcgccgcaggccggggcggagaggcgcagggcgctgggcagtctccggcgagggcaaggagcggtgcccggctgggccggctatgtctcccgctactgcggttcccgccggcgcccgcgacctcgggggagcagccgggttcgggggcgccgcgctgtgaggccggggcctagagccagccgcggccgcgcaggaggggcccagggcccgcgctcgcccgcgtccccgccttcctcccgcgctcagccccgcctcggctcgctgcccttggctctcgtcgccatggcctccgtcgcccaggagagcgcgggctcgcagcgccggctaccgccgcgtcacggggcgctgcgcgggctgctactgctctgcctgtggctgccaagcggccgtgcggccttgccgcccgcggcgccgctgtccgaactgcacgcgcagctgtcgggcgtggagcagctgctggaggagttccgccggcaactgcagcaggagcggcctcaggaggagctggagctggagctgcgcgcgggcggcggcccccaggaggactgcccgggcccgggcagcggcggctacagcgcaatgcctgacgccatcatccgcaccaaggactccctggcggcgggtgccagcttcctgcgggcgccggcggccgtgcggggctggcggcaatgcgtggcggcctgctgctccgagccgcgctgctccgtggccgtggtggagctgccccggcgccccgcgcccccggcagccgtgctcggctgctacctcttcaactgcacggcgcgcggccgcaacgtctgcaagttcgcgctgcacagcggctacagcagctacagcctcagccgcgcgccggacggcgccgccctggccaccgcgcgcgcctcgccccggcagggtaagcgcgcgactgaggggccggccttggccagagcgctcgagacccgcagcgccctcgccaagttggaagcgaaacacactcgtgccaagttattttagccgcgggcacccagaagagtttctggcatgggtttctctgtcttagggaagaggaagcccagtagtttggcagaagcgggcgggcgggcgcggtgacgtgctactggaatttttctaggcttgaagagaaaggctgatctgagaggattcgtggaaatatgacttaaaaggggagaaatgctgagagaaaaaagtttgttttagtctcatgggttgtataaggcatggtttgtgttaagtaattgcaagagcaaaatctaattagatgccgggcttctcgtaacacccactcctttttcttgacgtggctctcctgactttgcctgcggtggctttcatcatacaaaaatgggaggaaaacttctggtcccttttataaaaagtgaaaagaggggacttgattttcgttgaaaataagaaactttaaggccgggcgtggtggcttatgcctgtaatcccagcactttgggaggccgaggagggcggatcacctgaggtcaggagtttgagacctgcctgaccaatgtgatgaaaccccatctctactaaaaatacaaaaattagccagagctggtggcatgcgcctgtaatcccagctattcgggaggctgaggcaggagaatcgcttgaacctaggaggcggaggttgcagtgagccgagatcgcgccattgcactccagcctgggcaacaagagcgaaactccatcttaaaaaaaaaaaaaaaaaaggaaaagaaaataggaaactttaaagcgtgtttcttaaggactaaaaatgatgctgattcgacggtttgactttttgtagatgctctgaatgagagaatcaggacacatacaggaggcacaaaaatggtagtggttggacatgaatgtcacggagggaataagagaccttgattgtgcccacgtgtggtcaggctccgtgtgtttaatcatgccctgttgctgtttgatttataatagcacgaatgatatcagcaagatgggggcggagctcagcccctttggaagtgtggattctccaaaacctgtggatccattgaaagagtctggaaatctgtgtccatcacatcctgcctccctccccacctctaccttagatgaggctcagartccttgtcaggggagcagatatcaaagggtcaccctgcgactgcttggccttgaggcaaacactgggaaggactccatagctttccttctgaagtggaggcaggcagcactttcacttggaccccccatcagcatctctgaggcccaccacggctgttgcacacacatcctctctgcccaaacacagaccaaaatatcccagcagcaaagaaacaaagtcttttctctgtgttctcactacttacctggaagaaactgacattgccaaagtgagctttcctataaacccagaggaaacctttgaaaaggaaaataaacaaggaaagaatatgccatagaacaaaaattttaaagtttagattacttggagacgccaggcacggtggctcataactaaccccaggactttgggaggccaaggcgggtgaatcacttgaggccaagagttagagaccagcctggccaacatgacaaaacccgtctttgctaaaaagaaataaacacaaaaattatcctggcatggtggcgcctgtctatgatcccagctcctcgggcggctgaggcaggagaatcgcttgaactgtggtggtggaggtcgcagtgagtacagattgcgccactgcactccagcctgggcaacagagggagacactgcctcagaaacagaaacaaaaacttcaggttactatgagaagtktctgggttgtttttcctcttgcttgcttcgttgcccttcctttccccaggggagtttgtctagraattgttttgtagatgtttgggatgaaaataggcgagcgcggtgctggtcctcatttctgggagaacactgctgtgctcagacttcctgaggtcccagcaacatggaaacgcggaaggtgcggctcaggttcctgtasaggctcatttgttctctctgcgtggaggtcaaaaattgttccccagtgtcctgtgtgtcccctgctcagatgcttgacaggttgaagttgtttatgcttcasagactaagtttttccttcttgaattgttcgtttttgggttgtgagcatgtgaaaatggtttagaagagcccttgsagaggagctgtgactggatccatctgaggtggatgaaagcaccatgaagaaatggtgatgggatagcacgaacttacagcaggacacaccagccctgttttcatgcccacatttgttgactttggtgttaggtgctgtcctcagccctttgcacgcatgaactcactctgtcctcacaacaacacaaaggcctaggttctgttataatccctagtgtatacaaggcttggcaagcgaaagtaacctgcccaagggtcacacagcatggggttgtggagcctgaactcctatgctttctccagcagcaccagcagaagctgagaaagggatcactaggctgggactgcgagggtagaggtagggaaggcgggaggatgcaggaatgagtgagagatgctggagagaggtgtcttgtagtgactgagcctgcctgctagaatctgtagaacagaggarggtgcttgaagttctggggcctggcgtctccacaaacaagtccctgctcatgcccccaggacttggtgtctgcttgtcctccatcccaggctgtcgtgaggttcaaggggggacatgctttgtgagttaggaaggtggcacgcatgtacatgatactgttctaggaacctggttgggtcatgcccatgactagagggttgggggactggatgtcatgataaaaagtgaagaacagcaggagggagggagggagggaggagaggtagaagctagagctgctaggattccagaagagcagggaatataacctccaaggactcaaggacgataacctttatgtggtttttgctggatattcagcctgaagtccagtatctcggggaagaatttgggaagtgggccccttgccttgtgtgtcagggaaaatcaaagctattaggcagaggtctgctctcctctctgcagacccacctgctgccacccccagcctttccctgtctccgccaagtgcaaacaaaagagttgaccttcccattcaaggttaatccctctgcagatgcttgaccactctccctctccaagggccttactttctcacattcttatcttctcccttttgtgttataaacaattatatttaataaataatagtaagataactggttggcagtgtcagggaaagtacatttagacctacaactctgaccatacacaaattccagatggattaaagaattaaattttttttaaattaagccatagattactccatacataaaaaaacttaaaggaagtaaacttccatatctggaaggaagacaggtttcaaatcaattaaagaggtcacaaagaaaggggatagattatatgcacatttataaaaaacttcatatcaagaaacaaaaggaattgcaaacaagagtctgggaaaaatgtgacattatttattcgtagagtttatgggccaggcacagtggctcacacctgtaatcccagcgctttgggaggccaacgcaggtggattgctggaggccaggagttagaaaccagcctgacaaacatggtgaaactccatctgtactaaaaatagaaaaattagcctggtttgttgacacacgcctgtagtcctagctactggggaggctgagacatgagaatagcttaaaccctggagtcggaggttacagtaagctgagattgcaacactggactccagcctgggcgacagagcaagactcggtcaaaaaaaaaaaaaaaaatatatatatatatatatatatgagtcagcaagaaaaataaaaataaatgggcaaaggacatgagcagacacttcccagaagaggaggtatggtggataaacatggaaaaatgttcgaccttagaatcaaagaaatgtaaataaggccaattttcatttattaacttggtaaaaataggtttactcatattggcatgcatatgggagacttcatatacacttctgtgctcaccgatggtgtaaattgctacttccctcttggaaaccagttgggaartatgtggcagagaccattaaaatattcatttcatacttctggaatattttttaggaaaaggaaccatgctgaagagaacatatgagcaaaaaagtgttttactcatattgacatgcatatgggaaactttatatacacttctagctcactgatggtgtaaattggtacttccctcttggaaagtaattggaaaatatgtggcagaaaccattaaaatattcatacttctggaatattttttaggaaaatsatctatgctgaagagaacgtatgagcaaaacatgtttattatggcattatttataatggtgaaaaagtaacaaagtaaatgtccagtagtacagattaggaaactcaagtggcaattgtgaagcttaggttatcacatgggcagtgctaagatatatgaagaaatatcaataacaggaatataccaataagttgatggattaaattcaggatgtaaaattatatttattgtaactggaatacacctagggttgtctcgaagtatagtggaaggatagaacctttgagttagaaataactgggctgcattcctgggtatatattcaaaggattataaatcatgctactataaagacacatgcacatgtatgtttattgtggcactattcacaatagcaaagacttggaaccaacccagatgtccattaataatagactggattaagaaaaygtggcacatatactccatggactactgtgcagccataaaaaaaggatgagttcatgtcctttgcagggacatgggtgaagctggaaaccattctcagcaaactatcacaaggacagaaaaccaaacaccgcatattctcactcataagtgggagttgaacaatgagaacacacggacacggaggagaacatcacacaccagggcctgtcggggtgggggtcaagggaagggatagcattaggacaaatacctaatgtaaatgacgagttgaagggggcagcaaaccaacatggcacatgtatacctatgtaacaaacctgcacgttgtgcacatgtaccttagaacttttaagtataataataaaaaaataattaaaaagaagtatctgatctgacaaatttatcgcctgtgtgatgtaacttagccctctgagcctagtttctgcatcagtattatgcagatgataatacctacctcagagattcgttgtgaaagttaagttctttctataacttcacctggcctggtacctggtacaaggaaattgtaaccgcccaatgggttctccttgcccactgcctacacagagctgatttatcaagacaggggaattgcaatagagaaagagtttaattcacaaggaactggttgtgcggataaaacacaagaccagatgagccagtttatcaacctaggtactgccaacggggtgctgccaaccatcgaggacagggtctataaaatatctcaagcactgaacttaggttttataatagtgatgcctaagccataatttctaatcttgtggcttatttgttagttttgcaaaggcagtccagtcctcaggcaagaaaggggcttatttggggaaagggctgttaccatctttgtttctttttacttttttttttttttttgacacagggactcactttgttatgcaggcaggagtgaagtggcacagtcttggctcaccgtagctttgaattcctcagccccccaagtaactgggactataggcatgtgccacacatcaggctactttctgtatttttagtagagatggggtttcaccagttccaggctggtctggaactcctgggctcaagcagtctgcccacctcagcctcccaaagtgctgggattacaagcatgaatcaccacacccggccgcgtctgtttcaaagtcagactgtaaaccaagttcctcccaaaattagttcggcctatgcccaggaatggacaaggacagcttggagattagaagccacatggagtcaggtcagatctatttcactgttataattttctcagctataatttttgcaaagtcagcttcaaaatccctcagtaaatggcaactattataattattatcagcagcaccatagggagaaggactggatcagtacataccaaaaatcacaataatcatattggggttgcggataattttttttccgaagtgttgcagttggaaatccatgatggattttgaccgcatgtatctgagcctcttcccctagtctcgccccgcttccgtaccctgacttcagggttctttccagttgctctgcctgagctataccattcgttcccacacagcacagaatgtcttccttgtcatggaggctctgtgcacagtagcgtgttgtgaatgaggctggttgatattatattacacttctctgaataaaatgccaccttgatttgctcattctcaatcggcaggagtcttatttcacctctgtaggtcttactaagtgtgtttagttttcaaaagaaaccagtgtttccctagtacttaacatgggtttattacatttttttgacaaaaattcaaaattacatatattttgttcttcattagcaagtcacacattttaaaatggcacactcccttcctcttcstgttgttatttgtttattttaaggactgtttctgggtagataagctctgggttattttaaaatacattttacaatggaaatggcctggacttgaactgaaaaggaaacattatctgtgttatttcagacacatcagtgatcagtttagaagataggatgatttcactaagcttataattcatcttaaagctcacctaawtaaaagtaagtgactaaaatgatctttttcttccaggagaggtaggattaattaattgtataatgtgtggaatatttcagcgcttatctgattcttccatcttaaatctttgagagtttttaaaaaattatgtgtccattactgtttatatcacatagacatattttcatttgtctacttaaaaatgtatttttaacaaagtttaaatagctgctagctgtaatgtataactgctgagttataagatgctttccagaattataaagtcataaaccattgtgtggaaacaatgaacctttcagaaccaaagaaaagrtcaacactatgaaaggactatcaaaataatgcaagtgtcctatctctccttacctggcagaagcagcataaagacatcagacactccgtgtttgttcagaggtggaaaaaggcagaagaacaagtttcttcctaggcaggggattgtttacttggcttatttaaatcacagttactagtcctcactcttaagtgactggaaaaatgggacacgtcttctccatagttagcaatagcatgtaaaaagcaattgtgcttaattcctcataatgtgttttttttttwaaaaaaaaaaaaaaggcatcttccctttgtggctggcagcagcattctcattcagaaaagccgcatctctaagagccccagacccctcacataaatccccttgttcctggatgatcaaggtccggctgctttttctcgctttccaatgagatgcagacagactgggaaagaagggagtttatttctgcaactggtgacaggaagatggtgggagtgactcaccagaccaactcaaagttacaagtttttcttcagtgtttatttacattcaattcaacctctatgcctgtgtgagagtgtgcacctacaagcaggagtgtttcattcagtctaatctttagggtctggggtctggaaagtctctagagccttggaaaattttctttaatcttaagtggccttgatacaaggtatatgtgtaagaatgccttcgatcagatgttagggtctgagaaagtccaggcgaggtcttaatgtatttgttttcacattccaggccttgtactcaggcaccagtttctccagcttgaatgtttaacttatgcattcatcagaattacaggaaagggttagtggaaactggctgctctggttgctgatgacaacctgttgccacaccctggtgctgggcattgagggaaccactagaagagaagagaatcctggagggttaggtcctaaacatctgaaaggcaatggtaacttgctgaagggtttttcctactcgcagaatgaccccgtcagattagctttccagaagagtcatttcagctgcaatgtatcaagagtggtcaccttttgttccgtaatgagacactgaggtgggattgcagtaagccccgaaactcaagcactgggatgtgtggcttggccctttagaagtttgtgtaggtagcaacattggcccctgtggaggaaagtgatgggctcgaaagcaggaggagaggcggtgccttgcagcactgtgcagggtgagccaaagaggggcaagcccagccagcactygaaccagagctttggcactgaaggaatggggaagtggatgccaaagagggcgtggtacacaaacctgtagagtttttccagttctgttgctgtttctttaaaatatgtgtgcatttgggtgaatttactaagaagcttacatcaattaaaattttggtaactatgctcttagaaatgttttctttgtacagcttatcctttcggtcatccctgtagcagctgtcagtaaagtattaatattgaaataaacataattaaccttatattatttagtaccattctaggttaaaggtaaatataggctgggtgcagtggctcacacttgtaattccagcactttgggaggctgaggtgggaggatcacttgaggtcaggagttcaagaccagcctgggcaactctcactacaaaagagtgaaaataggtgggaaggttagcacacacctgcagtcctaactactcgggaggctaaggcaggaggatcacttgagcccaggagttggaggctacagtgagtgagctatgatcgtgcaccagcctgggtgatagagaccctgtctcaaaagcaaaacaaaacaaaaacaaaggtaaatacagatttattttgctgttgtagtcatctgagcctgctggcttctattataaaaattagttattagaaacggtgaacgtcttcaattttcctagatgaaaaattggattccagagaatttacatgcaggctttattttgtatggctctaaaaatttgccttaacttttcaaacttaatatatttcccattcattgaatactttatatcactcctatttttaaaacttgaggataagaaaaaaagaaaatccatattagaggtgaatttggtgtttttcaggtttgttttaataatcttttcaaggccaggcgcagtggctcacgctgctaatcccagcactttgagaggccgaggcagatggatcacctgaggccaggagttcgagaccagcctggccaacatggcaaaaccctgtgtctactaaaaatacaaaaaacaattagcaggatgtggtggcacacacatgtaatcccagctactcgggcggttgaggcagaagaaccgcttgaacccgggagggagaggctgcagtgagccgaggctgcaccattgcactccagcctgggtgacaagagcaaaactccatctcaaaataataataatcttttaaaataaatttatttaacagtattttgaacttaagtgattttaaaattaagtgaaaaatccactctagaaaataaaactgcttctccatatttacacattggtgggacctcgtatgctgccttgtacccaaaatygctaccagccaacactccacacagcctcttctgcgcatattatagctaaattccacgatcataaaataaatagaaaaataatttccatttaatatggattctcttagcagttatttgccgaatcatatctattcagcaaacaagatacctctccataaattagaaaaaataagaaatcatcttttatgaattatttattttctttctcagaaaaggatgcgcctccacktagcaaggctgggcaggatgtggttctgcatctgcccacagacggggtggttctagacggccgcsagagcacagatgaccacgccatcgtccagtatgagtgggcactgctgcagggggacccgtcagtggacatgaaggtaacgcatgttgtcactgctaacaaaaacgagtatttcagtgaagtggtcttttgtaatgtcctgccacttcatgctccctaaatgtctgtacgctagcagaaggcataaaatggagactgtataaaactgattatgccaaaatggtttattatctcaatgtgcttttctgctgagagtgagcagcaatctcgatcatttgtcttggagcctaccctccttctagctgctgtttgtgacttgtctagaggacaaagacacttcaaggaagaaggctcatgctttgttttaatgactcagattacttttttaaagttctatttctttttctgagctcaagatccaggtagaaaatttgaaactacaaaggagtctaaagaggacaataacaataggatgaacttatccttcacatgagccggaaagtagacagcttacctggcagctaggtctgctggggcacaccgagcctgtgagggagggaggccagcatgcggtgctcctgcccggggctcctgcccggggctcctgggatagccgccgatggaaatcagccatgtggctggtggctgcctatgctcaggaagtcttgggtggtgagacaagtggctttttattcaccctctcagggtggattcctggcttaggcaaataagcacttcctggcttaggcagataaactgcatccaaaccacttcagttagaggaagtggagaaagagggtgaggtaaggaggcactgatttgtactctactggaaccaaaacaaaaacaaatctggaagtccctcatcactggtttaagtaagagtgattttactccctgattatattgcattagaattggactcaccctcgtccagtatggtttgcctttgtccccacccaaaaatctcatcttgaattgtaatccccataatctccacgtgtcaagggagagaccaggtggaggttactgaattatggaggcagtcacccccatgctattctcatgatagtgagtgagttctcgcaagatctgctggttttataagtrtttggttgtttctcctgccaccttgtgaagaaggtgccttgcttcccctttgccttctgcggtgattatactagtaagtttcctgaggcctccccagccatgtggaactatgagtcaattaaacctctttcctttgtaaattacccagtttcgggcagttctttgtagcagtgtgagaatggactaatacacccagcatccttcccagcctctcctccaaacaagagtgccttccacaacaccccttccaaggctcatctgccatctgtctgacttttccaagggcagaagctcactacttcacatcatgtccatgacattactcatcactgtgttgggcaagcaggctacgcctccccttacttctgtgcattggtgttgggtcttccctttggaaaaacactgaactcatctttttatcctgtgtaaaagctttggaagtctttgaaaaaaagaaagaaagaaagaaagaacatcaccaattggtatgctgttctcagaactcagcaccccacagtttgtcagatgttcctcatatgaattgatttttcaggcccgccactatcctgccttgtctggattttctcatattaatccatacccttcttaacatctaatacccctaattgaaccccatatttaagctttggttttctgactcattcattacctactgtgatccagatattgcctctccttctattaatgagcttcgttacatgaactgtgtcagtagctgcatcacacagtgggttcgtgctgcatttttcttgccttcaagaggaaactctgaaccagttcccaatcgtgtataacagtgacggcaggtagacctcaagttatgaagccatcatctaaatgacagggcctgtactaggggaaacatctgttaccaatttgtgactgtcttagaatgatatacattcatgaatgtcacccaaagttaacactcatcctgctgagacttcatcataatcaaagcccccacggattgagcacccactgagtgccaggcagcttagagagatctgtaatccactggacaccctcacttgtaggcacatccccatttggtggatgaagactgtcaggaaacattgtggaagactttgaggtgggcaaaagattactaagtacctttcaatggaatgctgggttggttagtggatccttcagggttaacatctataagttgcagaaaactgatagtaaccaaatgattcttgtccatagaaatgcaaaagaaaattaggtatataggggtaattgactttcaccctagagaaaataagatttcaaacatgacattttagtacatgtagatactaaccgatctattagtagattcatttcagtactgattagcaaacccatttcagttttgcatctcctagcaacttctttttggcattcatgattgcctgtatatgtgtagtcttcagattctttaaatcagttgaacaccttattggttccctctttaactaatgtctttgaaaaatattcatattatatttgtgtgacagtcatagctttactattttgagaattttcctttaacagtaattaaccctcaggagctatgcctctgatccctttaacttgagcagccttatttcacaccccaacatttctgccaggagaattgggcctctcaaatcaaattcctttttctctgagaatggcttcctgctgactggaacactgatgcactccgccctcaagctgcaaaatggggctaagtttgaaggttgttgagaatagagggagggcagtcacacagcaaaatagttaagttaaaacctgttattggatgcccttgttcctaagtcccttgactgtccctagcacccaagagtgtccattgattgggctttcccctgagcgcccatctcctcctcttcttgagccattcatccctcctctcatctcccctgctctccaccatctgcacgggctcctcacccttgctgtctgttctcaggcagagtagtgatctctccctttgcctcgtgatactttaagatcagcttctagggcccatcttttcatgtccaagtgacccagacaggtattcaacctgcaaggaattatgctgtcagattagttatgaaacaattaatagttaatttttaagcatctggtatgtgtccagtactgtactaggcactaagcatacaggaaagctcatgttcctgacttgtctcattcattcgtttattcattcattcattcattgacagggtctctgttgcccaggctggagtgcagtgagtggcacaatcatagctcactgcagcctcaagcagtcctcccacctcagcctactgagtagctgggactatagtcatggctaattttttttttaactttttgtagagatgaggtctcactatgctgcccaggctgatctcaaactcctgggctcaagcaatcctccctccttggcctcccaaagtgttgaaattacaggcatgagccacagcacctgatctgtctttttcatttgtgaagacagaatggatgattggtcagaaccaagaggctatccactggatttaaagttatatattttatgcccttgaacaggatattttacatccacttaactgaatatttataatacatcaaaatgcaagatgacacatatttttcaggcaacccattaaatgatgctgactttcatggttattaaacataatacatttaaatctgaagtcagaatgtaaaatatgacatttaggaacatgatacaaagtaggacattcaggagatttggaattcataaatcagtatattgatttacattcgtcagttgcttaaaattttctaaatgattatcttagtccatttggtctgctataataaaacaccatgactgggtggcttctaaagagcagaaatgaatttctttcagttctggatgctgggaagtccaaaatcaaggtacaatcagctttggcgtctagtgaggacccatttcytattttataaccagccatcttctcactgtgtcctcatatggcaacagaggcaaggcagccctctggggcctcttttattttatatttaaacatattttaacttttaggttaaggggtacatgtgcaggtttgttatatagataaacttatgacttaggggcttggtgtacagattatatcctcacctgrgtattaagcatattacccagcagttttgttttttttctaaacctctccctccttccatcctccaccctcaagtaggtcccagcgttgtgctgttcccctttctctgtccatgtgttctcatttagctcccacttataagtgagaacatgtggtatttggttttctgttcttgcattagtttgctgagaataaggacctccagctgcatccatgttcctacaaaggacatgatcttgttgttttgtatggctgcatagtattccatggtgtatatgtaccacatattcttcatccagtctaccgttgatgggcatttaggttgattccatatctttgctattgtgaatagcgctgcagtgaacrtatgcatgcatgtgtctttatagtagaacartttgtattctttgggtatatacctagtaatgggattgctgggtcaaatgatagttctgtttttagttatttgaggaattgtcacaccactttccacagtacaccacttttcacaatgggtgaactaatttgcactcccaccagcagtgtgtaagtgttccctttgctccacaacctcaccagcatctggtggggttttttttgttttgttttgttttttactttttaataacatgggacctcttttataagggcactaacctcattcatgagcacgtatctccaaacgccatcacactgggcgttaggtttgaacatgtgaccttgggagggcactcagccattcagtctacagcagtgacttcagaaaaccacacgtaaggaagcttgctaaaggatgggcattatttaaaccaacaacttcattattaaattaaaactaactgcatcctggcctacctgctgtacataatttttttaaatagacaggtattactaagtctttgtaaccaagtatatacaatgtgtgtgtgtgtgtgtgtgtgtgtgtgtgtgtgtgtgtgtgtgtgtgtgtgtgtaatttagtttagacatatatgagaagcccaaacgtgtattgctagccactgaattcctagctaggaagatggggttgagtcagacaacaggctgagtcattcattgatttggccagaagccaaccaccaaaggctgttactgctgaacagggatcttgagcagagattgggagctcctggtttatgatcatgtctttttccaagttacaaattggatatgttgtgtgtacatatatagatagttttttatcctgatacttggaacatgtctgtgaaacactgtaaaccctctctccagtgtcatcctaatgggagaaaatgtatagaagggtcacctgggcccttaaagggaaagcatccgtgtgacagttctacatcttctaaatatctgaatgcaggagagacagctctcgttagctaaaagagctagggaagggacattcaatctggatagatctaaactggagtgtgctcaggaggctgaggtgatatcatcatctgcatctggacccagtgttgcctgtatcagagaggcagtgcctgggcaggcaggggggaagcatgccaaggccaggtgtgaggatggcccctgacccagggatgctctgtcctttcagccccagtgttgacaagaggcttgctagtgaaccgcaggcctgcagagtttagtctgacattggcactctgagctttgacacccagaagctcagtgactcactgacttttgcagggagctctggcacagggtgacgccagcagcctcatggatggtacacccagctccctggcctcagtgcttccttggttthttctattctattctattctattctattctattctattctattctattctattctattctattattttattttattttatattgagataggatctcgctctgtcacccaggctagagtgcagtggtgcaatcttggctcactgcaacctctgcctcctgggttcaagagtttctcatgcctcagcctcccaagtagctgggactacaggcatgcaccacctggctaatttttgtatttttagtaaagatggggtttcaccattgttggccaggctggtctcraactcctggcctcaactgatccacccacctcagcctcccaaagtggtgagattacaggcgtgagccactgtgcccggccccttggtgttttttaaaatctctgttaactttgtctccactccgatggccactctcagaatctggtcatgactcagcatccccgtcacaccaaccttctaaatctctgctccgaatcaatcctgcagcccacgcctccactcacataccatggcagggggccagcacctgctgctccctggcagtctcagggcttcttgtctgctttcaggcggagcagctgggacagagcagctttcttgtgtcaccttacttgactgaaggctgcagggtctcacctagacatactccagcatgcctgtcatttgcagccatgctcccttgtgttcctaagtcccaagagacagtaaatgagggcataagctattgcactgctgcccaccagcctggttccragctaggattaaagagagccagagcctgtgacacacccgcccacctctccacttatgcagctctgagcttcaccacctgcaccttgccctgtctttgtcttgccttggttcagcctggtgcccatgggaagaggccataactgaccttcctctcactgcggatgaaggtgggaggaaaagtttccagaaaaaaggagacagcagaccctggtcttcccagagctcaggcctcctggccactgcagtgacccaggcaagagacaggctggggtcagagcaaggtggtaccygcggacagggtgatacatggtcaaattctggatgtgtttttaaggcagaccccatggaaattcctgatggattggaggtgagatagaaggatcattaaatgcaatcttgaggtctcaaaccagagttctagtcttgttttcactcttatttatctgattctctgatcttatctatctgacgacagataagacctgagccccaagtcttatctgatcagattaagacattatctggtcttgtcctgtctcagactgacttccacttttatttcagtgggttctgattcctagcatcagcagcccactccaggctctttggaagttctcttattgtcattagagctctctctgctgcccttagtattttagcactcacgtaaatgacccgtttggcattctgtcagtgtagttgggcctgaaggtaatgtaacagcgtggcagtgagcactgcttaacatctctttgaaataaacaacaaaaggcaggtggccgtcattgccagccctccaaagtaaggcttytgcagggaaagtggtggacagcttgtaggccagtgtagactgttttacaactcgaggtctcaattctgtcactgtcgcagtgaatgaaaatcacttcacggggattcgtttctttgtctgtaaagagtcattgtgtaatgttcagttagagataagaatcaaccagtggagatggtggatatatttaagcgcttactatgggccaggcccagctcttttacatgagttaccttatttgatcctcatcaggtaggtgctattattacttccattttacaaatgaaaacaatgaggtttggagacgttaagtgacttgtacatcatcagccagctggtacggggtagggctggcattcaaacccatgtctattggacaccgggttctgtgctcttaaccacgcaccagtgtttctttcagtgtgatcatgggtcacctgggtgggcttggtaagtgtagaatcctgggtcctgctctcctgaccaacccactgactctgactctctgaggctgggacctggaaatccatwccttagctaaagtggcataacatatgacaaccacggtaatctcattatatctaaatgattgtaaagcatcctatgggtgtgtatatgtaatgttgacaaatcctctaagcctaagtcagtccaaattctaggatttcctaattaaaaacaagcagatggttcttataatagtacaatcccatcctctgtaatttccaaagtccattattaacgcatcaatgtaatagaatgtcaaatggtcagcattctgcagaggacaatatccagactagttcatttaagcagaaaggaatttttttaaatagaatattaaataggtaatagaatcattaggagagctggaaaaacagtcttcaggctgactgtccagcagtgactcccaaaatcctaccacagagctgagcttcagaagctgttgttccagcatgctcagcaagctgcctgtgaatgttgggagagcagagggcaagcatggagccctgggttagggagtgatcagaactgaagcccaggagggcttctgcaatgaatgactgggggaacttggatagaaaaggaggccaaggaagcaggggttttcaaacagccaaagtggccagcatggccagatacagtaagagggccagttaaacatggatttttttttttttttttgagatggagtcttgctctgtcagcagattggaatgcagtgggtgatcttggcwcactacaacctctgtctcccagttttaagcgattctcctgcctcagcctcccgagtacctgggactacaggcgcacgccaccatgcccagctgatttttgtatttttagtagagatggggtctcaccatgttggccaagatggtctccatctcctgacctcatcatccgcccgccttggcctcccaaagtgctgggattacaggcatgagccaccgtgcccaaccaagcatggattttttaaaaatagtattgttggtcttgacacctaggagacttttgctaggtcagttagtgagttttgccagcactgtttcagggggatggtggggaaagcagctacattgggtgggcgaagactaaatgggaagtgagcaaacagaaacagcaagcacggcacagccaggcctttcagggagccaagtggagatgggaaggaagcggggctgtggctggtgagcccttagagctcagggaattttttttatttgttgttttgtttgtttcttaggatgagagaaacttgagcatagtaatagcagagccatttgaaagagaaatgagtcgatgtgtcagtgttctaaaggtcctagaaagaaagggggcaaggactagaaggaggggttggcctggaacacaggagggacagcttctccctgctggctgtcagaaggaagtgacagtgggtacaggtagggtaccaggaggaggtgggtggtggagccctagtcatggtcctgattttctccctgaagctgatgagtccccctgctgagacggcagggcctggatcctgagcgtgaggctggggatgaggtgcaggtttggagcagcaactgctgcagacaagtgaagggattgtcagtcaaggccttggccacctaaataaactagaacttatgagttcaaggtgggccagctgccaacagtgtgtgatgtagttcagcagcctcgggcnggagtgcagaggcaggtcctggggctgctctgaggacatggactttyggttgaggatggtgttgggctcggagctcaagtctgctgctcgacgtgatgtgtcccatctgtgtggcaggtgcctcaatcaggaaccctgaagctgtcccacctacaggagggaacctacaccttccagctgaccgtgacggacactgccgggcagagaagctctgacaacgtgtcagtgacagtgcttcgcgcagcctactccacaggaggtgagaagaaagtccttccctcgcttcccactgcttgtggaaggcaatgtcgggttggcgctttgtcctctggctctgcgctccatgggctcttccattttatttttggttattgctgaatgagagagtctttgctaaaaacacaataacaaaagcaggctctcttctgttttgggcttagccgatgctactgggttggggtggaggragcactccaggggatgagaagagatgctcccgcttctcttgactcgacttcatcaaagacaattgcttggctattctgggagaggactttgtttacagatggatggtccatttgctgcatctgttccaagagggaagctaaggagtttagtgaaaccagttgaactcgtggaagcagagagtggaatggcggttactggaggctgtgcrggggacggactgggaaaggagagacgctggtcaaagggtacaaagtgtcactgagaccggaggaacaggttctggtgatctgttgcacagcatggtgactatagttaatgataatgtattgtctgtttcaaaattgctaaaacagtaggttttaaatgttgtcatcacaaaaagattacaagtaggggagatgatagatatgtcagttagcttgatgtaatcattccacaatgcaaacatatatcaaaacatcacattgtgcctcataaatatatactctcctcttttgtcaattaaaaatacatattaaaaaaacaaggaaaaggcataccacaggattgaagaaagacttggctcttgggtgtaatcaattgctgatataataagtcacttcaaaaattttagaaagagaaaaagagtgcagctaaggagtacggttaaaattaattgaaatacgcaaaggacccatcaatttgaaagtgctacctacacattttcatagacactttacgcagatgcagttatattaataatataactttaaatacatatgatggttctcacattctgttgtacaatgtaacaatgtaaaacttatttcattcatctatgtttcttacttttctaaacatctacattttttttttgagagggagttttgctcttgttgcctaggctggagtgggagtgcagtggtgcagtctcggctcactgcagcctctgcctcctgggttcaagtgattctcctgcctcagcctcccaagtagctgggactacaggtgtgcaccaccacgccctgctaattttgtatttttagtagagacagggtttcaccatgttggccaacctggtctcgaattcctgacctcaggtgatccacccgcctcagcctcccgaagcacttagactacaggcgtgaaccaccgcgcccagcccaacgtctacatgtctaagaaagattaggtcatcaaattttttaaaatatccattgcatggaacttagcgacactaaagatattgtagtattgtagagggaacccctcaccayacacacaattcacttctggagaggtgctaaggtcttgtacatttaaatatcctgttactcggtcatcgtgtattttcttagtgtatgcagtgtgcagggtccttgccaggcactggggatagagtggtgcactggtggtccctgactctggtaaacttgcagtaagtctgtgacatttttgaattctcagtattcaatactcaggatccagatggtaattaagccagcagagtgcagaatgaggataaaagagttggaacaggactgtgatttacttgtactatattggatctagccttctatcaaaaactgaggttagtatgcatactggaaatgaaattttctaaggagttagagattttaggatcctaaggacttgtcaactttgataattttcataggcggcattaaaaatttgtttggctgatgacaacctgtccagccaggggttaagcttactgtaaggaagcagggtaaccattcacagacaggacaggcaccaaactccagcccgtgccagcactgtgaggtcaccagtgatagcgagtaaacagtctgtccagctcagcccggattccatcagccctgctaattcattgcagctggacaggagagccagccagctactcaaaacattgttgagtccctttgctgggcagctactcaaaacatcattggtcccttggccaccaggaccagtggagacatgacattgtctccagcagggatggctcacttctgtagatctgggcgccctctagagggctttccccctgggtaccrggactcacctggacagggtctgagtcaagtgctgactctgggaggaagggactcttgggaaaaagacacagataccctgtcatccccacagaaatcagaaaaggattgctcttgtacagctgaagtgcctgggagggaggaagggcctgcactgatatgagcagatggccagcacctcaccggccacttgtttgtcctggtttatttcctcaggcagctttccgggctccagaggtaaattgccagctgtaaatttctggcccttctccaagatgataataaactgtatttgaagtagcagagagtggtrtgtgaatcatttttgattactcagtggccgcttgagtataggtcttgtgtgggtaactttatatggaaaataaaaaggaattggtgaagtactaactgctgtctagaatcacttagtggttatattggaataacatgctatgaattaaagttaataaaacaccacagagagacattggaaaatagaggtagaagagacaagtgtttccctcccctgcattgtatgtattggtcttgcaatgaatgacccagatgttatggtaaccaagggtgacactagctgaggtagacagatgagcaggtaccctgcttatatgatyataacttggttcaatttttaataagttgacattttgaacatttttcatgcttagaaaaatgatcaaacagcaagccagcaagctcttccaacatgatctaactcagcagtctccaaacaggatgcccytgagttgttcaagacatttttagggtgagaaagaagacagcagagtttatatttttgctgatttttaatttttttccttaaaatttgagtatattttataagatacaccccatgttagtacagtagtatgcacgtattatttataaataaaccggactagccrgatgtggtgggacacgcctgtaatcccagctactcaggaggctgagacatgagagtcagttgagcctgggagctggaggctgcagtgagctgagattgtgccaccgcactccagcctgggcgacacagcgagactccgtctcaaataaatagataaataaataaactggagatgcctgttcaacaatatattattgatcaggatgcatgatcaaaaaagtttggaggctgctaatccaaaaatagatagaaaatttacaaatatggatccatctccaaaatcaccaaagaataaataaaaccttgagatatctgggattttcatgccatgaatttaagaaacctgacgaggaactgtatcctgcttgatatccagcgtgtcccccacctccgctccctgcttcttcccagtggccggagctgactctccttcaggcccatgttctcagtcataactgcaggctctttgcttcctcttcttccgcaggagcttctatcaccatttattttctttaacttctcttcctcctggatcaatatatcttcaaattgcctcacaccaagatagactccttttccaacctcttgatttaaccacgtttcaataaaagatgtgtccaaggccgggcgcagtggcttacacctgtaatctcagcactttgggaggctgaggcaggaggattgcttgagtccagtagttcaagaccagcctgggcaacatagtgacaccctgtatctacaaaaaaaaaaaaaacaaaaaaaaaccaagtgtatgtccaagatttcacttgggtttgtgaactgtgctcagccatttggttttgaaggaatatcatataatctgccacttccccatgttcctgagagaattgtctagtccactctgtccctgtaaaaccgtggagctcctgtgacctgcttctagccttgtgccttagtccatgttgccagtaccagatagtcacccggttctcctctagctaagtctaataaagttggcttaatcaagggagagggaaaatgcatttcaggaaaatatttgtagctcctatgaattgcactgcaaattaaaagctcctaagaactccagaagggagaaatgtcgttatttctttctttttttttttttttgagacagagtctccctctgtcgcccaggctggagtgcagtgtcacaatcttggctcactgcaacctctgcctcccagactcaagtgattctcctgtctcagcctcccgagtacctgggactacaggtgcatgccaccaagcccggctaattttttgtatttttagtagagacggggtttcaccgtgttagccaggatggtctcgatctcctgaccttgtgatccacccgccttagcttcccaaagtgctgggattacaggtgtgagccaccacgcctggccaatgtcattatttcatgaaactaaattcatgccagcccataactaaattttgtttattctctacagtaccagggacgttatgataatcaacaaataggattcaatagtaaaaacttaatctcagtgaaaagtattacttaggagacaagaatgtaagacatagcatatgtaaaatagtacctctgggccaggcacggtggctaacacctgtaatcccagcactttgggaggccgaggcaggtggatcagttgaggtcaggagttcgagaccagcctggccaacaaggtgaaatcccatctctaccaaaaaacacaaaaattaaccgggtgtggtggtgcatgtctgtagtcccagctactccagaggctgaggcaagagaatctcttgaacccgggaggcggaggttgcagtgagccaagattgtgccactgcacttcagcctgggcgacagagtgagaccttgtcttaagtaagtaaataaataaataaatggtatctctgttaaaacatagccaactgccatccaggggatgggatggtattaggtgccctcctgcagagcaatcgacagccagaagaagaggttccaacaatggtttctatgaatgaatgaatgaagagggagacagctgaggcggggaatcaagggtggagagagacctgggctgttgcttctgtgtgccacctcctggcaaggcaagcatggagaacagccctcagaccaagagcccctgaggagtctgaagaattaagtcgggaggctcaaaaagagccctccaacctctccagaacctgttgctggaattgttaggtttgcctcattatttgcatctcttccccgaagtgcattttatcatccccacggactcccctttgtcatccccatcttgagagtctgaacttctgcactcgtgtgacttgagatttgtttacaaataggatgtttgcacacttgctcacgctaccacttcttctgtgacgatggctgctgcattgacatcacgctcgcctgcgatggagtgcagcagtgtcctgatgggtctgatgaagacttctgccagaatcgtgagttggctatgtcacattgctaggcagtggctggaagggatggagttgggaggtctgtgttctgagaatgaaatgcaaacacagtgtccttcccctgcttgattttagttataactttacatgtaaaagctatgccttaaatgagaattcaatatgtctctagtctaagtctcaaatgtcaaatttttagtattgcttatgtttttaatttttttcaattttccaggttctttctatcctaaaaatgctgcatgtcatgtgctttcttaaaaactgmagtgatttgatgctttgttttgataattttttaaagaaaatttgcgatacaccagggtgtggctaagtcagagctgtaaatcagtcttataatatcatacacatagaaacaccctgtaagaaagaagaaaaactgaagaaaatgtaatgaagtatggatttgaggaaggacgaagagtctcaaaaccttaagtttacgtttagtctttgtccatttcttttttcttttctttcttttttttatgagaccagttctcactctgtcacccaggctggagtgcagtggcataatcatggctcactgcagcctcgacttccccagccttaggtgtttctcccacctcagcctccccagtagctgggactgcaggcatgtaccaccatgcccagctaatttttgttaattttttgtagagatggggttttgccttgttgcccaggctggtcacgaactcgtgggctcaagtgattgcctacttctgcctcccaaggtgctaggattacaggcatgagccaccgtgctgggccccgtccatttctttatgtgtaacatttggaaagctgactattggaagaagaaagaacagattacccatttgaaaacgtgagaatagatttttatggtcctctgacatgtcttagatgagtgggctgttacatccaaatatccgtgattttaaatcagctgcagatgtagtgtttttagtattaaagctcagaaaagaaatccagcaactaacagtagctcttccacacttcagtgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccaggtaaggattcacggtgggttctcaatgaagaaccttgttttctgtagccaaacttggctcacaattaagtttatgtttgaagagtgttaaggaagtatcttgaaataagagttaaaattaagaatttggccagaaaggcggggggaaatcttgacatttgcactaatttgtagtaagggacacttactaaatacactcatgtacctactccagagacacyaatacatttatttgtaaatacattaacacttagcttacgtaaaccaatacccaaagtgttaaattttaggttgttttgagatgaaacagcataaccattatgtatttgtgtaaatcctcttcacccaagcaagtgaacatttaaacaagttgtcttgaaagagatgcatgtgctagtaattcaacgttatgcctccaatttaactaaatctatcactaaaaaaagtaaggctaatgagatttatttttattttttttgagacagggtctcactctgtttcccaggctggagtacagtgacgcgatcacagctcactgcagcctcagcctcccaaactcacatgatcctcccatctcagcctcctgagtagctgggactataggcgtagtagctgggaccaccatgcctgactaatttttgtattttttatagagacaaggttttgccatgttgcccaggctggtcttgaactcttgggctcaagcaatctgcccacctcggctggcctcccaaagtgctaggattataggtgtgagtcactgcacctggcctaaaatacattaacatgactaaagcattacagaatttagccagatgcagtgactcacctataatcccagctactctggaggctgaggcagaagaattgcttgaggccaagagtttgagaccagcctgggcaacatagtgagaccttgtctcaatcagtcaatcaataagtattacaggattccatcattttttacacacttattatttgcatgattatgtgacatgagacagaaatagagattatyacatttccaaaagcttttctaatgtcttttcagactctgcataagttgtattgaaataacctgacatgattttagtaagtttattaagaaaaatttttgttcattgtacaagatacggaagatgcaaaataatttaagaaggaaagtgaatttaaaataccacctcttttgaaaactgcttttaatatttgttatatttccttccactcttgtttatgtgccttgtagattttaagtgcctccataaaaatatgtctgcaaaacattgcattctatcaggggcttttctttctgagttttggttaagaatgctgccaagtgtctgcttttttggtccattcctggttggtactgccacctactggtaaaatcggtcactacatgcaagcctttggatgtggttttagtgggttttctctgcttaagatagtttgtatggagaagagcatcacaatctaagaaacagagttgggcagaccaggcatctttggcaggactgccgaaggggtgaagagtttatggagagatctgtgttatcagaggccaggatggatgaattcctaccacattactgtggtggagagaaccacgtgagcatgaacaaattagctgaaagtagagtcgagaccaaagcccaggtcttggctctacctttagaaccttgaataagtcacttcatatctctggacctcagttgcctcatctgttaataagggacttcaaccagatgtcctccaaggtgcygtccagcactgaggaatgataaataggctgacattcatactttaccccatcagcccttacccatgctaggtgtcactcattggtcccagcactgtcccatggggaatgtggacttagctcagaatccttttgaaaatagtgctccaggctagaagccattattctcagcaaactaacgcaggaacagaaaaccaaatactgcatgtcctcacrttagaaatggaagccgaatgatgagaacacatgaacatatggagggaaacaacacacactggggcctgtcagagggtgggaggtagggggagggggagcatcaggcagaacagctaatggatgctgggcttaatacctagggatgggatgatctgtgcagcaaaccaccatgacacgtttacctgtgtgacaaacctgcacatcctacacatgtaccccggaacttagaagttggagggaaaaaaaagaaaataatgctccaggctgccacctgcggctgatgggagtcagcacccaatttccaatctatttatgatctctccttttgctttttgataatcagcctttggatttggttatgaagatgtaaagagtggtctttcacagatgcagagagattagatgtacagttattatattagggctttttctaattattaaaataatatggatttactgtagaaaatatagaaaaatacaaagaaagttaaaagcatctagcaaaactcaccattaaaattttgtcgcattttcttctggttacttctattcatacacatatacatatttattcatttttaacaaaagcaggataatgcttttataaaacttttttcttactcatgagcattttcatgtattattaactattcatcaaaaacacactttttgaaagtcctggggtgaagaaagtgggaagaaaaaaacaaaactgaaaatgttagaaagagccmtcacatcctgtagtttctgttcagacagtagctgtccctgccctccccctctgctgtccctaagaccaccagagtagagtcctcagcctctgatttcatgtaagttaaagacccataagtagatttaaaagtgcattattggccgggcacggtggctcacgcctgtaatctcagcactttgggaggccgaggtgggcggatcatgaggtcaggagatcgagatcatcctggctaacacggtgaaaccccatctctactaaaaatacaaaggccaggaacggtggcttacgcttgtaatcccagcactttgggaggccgaggcaggcggatcacaaggtcaggagatcgagaccatcctggctaacatggtgaaacgctgtctctactaaaactacaaaaaattagctggacgtggtggcgggcacctgtggtcccagctactcgggaggctgaggcaggagaatggcgtgaacccgggaggtggagcttgcagtgagccaagatcgcaccactgcactccagcctgggcgacagagcaagactccgtctcaaaaataaaataaaaaaataaaaataaaaatacaaaaaattagccgggcatggtggcgggcrcctgtagtcccagctacttaggaggctgaggcaggagaatggtgtgaacccaggaggcagagctttcagtgagctgagattgcgccactgcactccagcctgagcaacagagcgagactccatctcaaaaaaaaaaaaaaaaagtacattgttgttcatgacacatgcctgggttttaagaagaccatcagctagtacaataaatatgaatgagttaaattcactgctgcctccttcctgcacagacatgtggtgaggacaaataagacttagctcggctgggcgcggtggctcatgcttgtaatcccagcactttgggaggccgaggcaggcaaatcacgaggtcagttcaagaccagcctggccaacatggtgaaaccccatctctactaaaaatacaaaaaattagctgggcgtagtgtcaggcacctgtaatcccagctactcaggaggctgaggcaggagaatcacttgaacccaggaggcggaggttgcagtgagccaagattgcgccactgcactccagcccaggtgacagagtgagactccgtctcaaaaaaaaaaaaaaaaaagacttagctcatggaagacttgttaacaagatactaagattaatactaacagtgtagcatgcaaagtagtgagatgtagtttttcacctatcacattgacaatgatgaagaattataataattaatgtttctaagagtagagagaaacaagtctcacactctgctggtagcaatgcaattagtacgtccttccagaggccagtttctgaaggcttaaaactatgtatatgatcgggtgcagcagctcacacctgtaatcccagcactttggaaggccaaggcaggtggattgcttaaggccaggagttctagaccagccctagcaacatggcaaaaccccatctctacaaaaactacagaaatcagcttgtggtattcacctgtaatcccagctacttgaaaggctgaggtgggagaatygcttgagcttgggaggtcgaggctgcagtgagctgtaatcccaccactgtaytccagcctgggtgacagagtaagacctcatctctaaaacaaaactatgtgtgctttgacccaattgtcccacttttggggatttattccacacaggttactgaggataaaatgaaggtatgtgcagacattcagttacaccagcgaatgcatgctcagtacactctgagccaccgggcaggaggagcacagagctccagtgtggcctgtgtttgctcagcatgtaaaggcacaatggctggattgttgaccatggtcatagccgtagggcctgttctctgtgtggtccatgtcattcattaacaattccaccctcttgtatccaagctaccccgaggaaagaaatctggtttccagccctacraagggctagaaaagtggtgctacatccacattcacgtggaatctgctttttgaaacttgagaattcctgggcatgttaaagtatttcttccggatcatgcctgcatgctctatggcagctggaaatgaaatgaaaacagcttccatccagctgccaattccctctgtgaatgtgtcgccatgcatagtaaacataatacattcagaagaaaggaaaaatggtctcctaagacatgtaactcttccagaaggatcattaccaaaagtaactatttccagaagcaagtgatgtcattgttttgttttgtttcgattcgccacactggctagagcctgtgattggatgtgtgaaagtgaagcatttctctatggcgttccttatgctgaaatctaggaaaaatgaatcaggcagactgggaaatcatagggaattccttcatggaatgtaaacagcagaaattcacatttcagttacccagaaggcagggccaggttcctgggtaatcctagagtctggggcaactgcgccttctgaagtctcccatgcacactgcccgctgcctgatacctgatccctccctacatcaccatcttcctctccccagggaataagggcatttaagaaaatgctgtttaaaaaaatttttcttaaagaaagaaagtgctctttaattttgacaactgaagattcagaaagaatttgcatagttttttacatgaacccacctgtgaggttaggtcccttttgcaagtacagttagccaatttctctactgcatccttaataaagctttgtccagaaccttcctaaaaatcatttaaaagtgtgtgattttgcctgggtatgagtaaataaatatagtattgacttggttcttggagtaaaaaactcgtatttgctagttgtgaccttgagagcagtatggttcaatggaaaactgctttggatcagtcctgggttctaattccagcaccaccaattactagctactargtaatcaacttctctaaacttcatttccttacctgtaagaggataataatctcagctgggcacggtggctcatgcctgtaattccagcactttgggaggccacggcgggtggatcacctgaggtagggagttcgagaccagcctggccaacacggagaaaccccatctctactaataatacaaaaattagccaggcgtggtggtgcatgcctacaatcccagcttctcgggaggctgaggcaggagaatcgcttgaacccaggaggtggaggttgcagtgagccgagattgcgccagtgcactccagcctgggcaacaagagtgaaattctgtctcaaaaaaaaaaaaaaaaaaaagaggataataatctctcataatatggctacaaagattgcaggagatattatatgtaaatataattgatgtctctcagtaaatgttagtgctgtttgaatttttgctagaacattcaagtccagtggtattcgctaggaaaccagggtaagagagcgccaagtgtataaggcagttaattcaaataaaaaatagaaatagtgcagtagtgtttccagtactgagttcctttaagaattaagatgagcaagctctcatcttcattgggaagaaacagtgaggtgaacactgtaaatgcagttatcttattttttttattgggtgaaagacaaaccagttagtcctctgaaaaaaatcgggagttggtgaattttggcactttgtttttattcctggctcatttttaattttatttttatttttattttattttattttatttatttttttagatggagtctcgttctcttacccaggctggaatgcagtggcgctgtctggggtcactgcaacctccacctcccaaattcaagcgattcacctgcctcagcctcccaagtagctgagatcacaagcgtgtgccgtcattcccagctaatttttgtatttttagtagagatggggtttcaccatgttggctaggctggtctcgaactcctgacctcaagtgatccacctgccttggcctcctaaagtgctgggattacaggcgtgagccaccatgcccaggccctggcttattatttttaaaaagtaggacttgagtttcccaccatgtgatcttcccacttccaaatttattattggagagagagataaagcagaatgcatagaagttcctttgcaagctaacctggcagtacggcatgggggaggaggaaagggatgaagggagaagtgccacaagtggtttttaggtaacttagcagtttgatttccaagctgtttcagggctgctagttttgtgtgtgcggctgctggatggactgttttgcatatcactgatttatatctctacagaacaaatcttgtgtttcttttggagatccacgagcaactggcatttgaaaaaatcaggcattattgactttaaaacacagtaatgttttctatatctctaccaagcaaaagctcaggaacattcactggagtctctgtagtaatctaaacaaggcttacattgaaccttcaaaatgctattgaaaatattcatatttttaggtcaggtgctgtggctcacacctgcaattccagcactttgggaggtcaaggcgggaggcttgcttgagctcaggagttcaagaccagcctgggaaacatggcaaaaccccatctctacaaaaaaatagaaaaattagtcaggtgtggtgatgcttacctgtagtcccagttagttgggaggctgaggtgggaggatcacttgagcctgggaagtcgaggctgcagtgagctgagattgcaccactgcactctagcctgggcaacaaagggagaccctgtctcaaaaaaaaaaaagaaaataaaacatactcatattttcaatatggatatcaacaccatgagatttgcaccataaaagcagtggttaaatatgtacctattaactacctcacccctgagaaaaagtgtaaaaattacttgccacaaaaattgcactctggtctgtctactagcagtaaaaatataataaaataaaaaagctgcatggtcttatttttctgtattaaatagtgctttcctatgtcagcagatgtttacagtacttctagtatagcttcctaggccagaatcatatataataaaatcttttttttttttcttttgaaaaggagtctctgttgcccaggttggagtgcggtggcatgatcttggctcactgcaccctccgcctcccaagttcaagtgattctcctgcctcagtttcccaagtagctgggattacaggcgcccaccaccatgcctggctaattttttttttttttttttttgagacggagtcttgctcagtcgcccaggctggagtgcagtggcgcgatctcggctcactgcaagctccgcctccagggttcacgccattctcctgcctcagcctccccagcagctgggactacaggcgcccaccatgcctggctaattttttttgtattttaagtagagacagggttttgccatgttggccaggcatgagccactgcgtgcggcccttatgtaatacaatcttatagaactacctggcctgggatcaggtatcatataagagaatccaggtagctggagaggtccttggtgaccactgtcgtggctactgcagtgagttggacagtaacagaactctttttgcagggaaatctgatcctgcagcctatgagcaatggctgtgctttcctcatctctctccttctgtctgagctcagagtttatggagaaagcccaaattattggctgtatgtaggaccaacatacatggaactttctagagtaacaagacacagtagactgtccccaaagtgccaggattataggcatgagccagtgcacctggccaactttgtgacttagtaaatttgcaaaatgcaagttaccaaagaattttatatactacctttaaatagtcttatttcatttgcaggaattaggaacatttatgttgatgccatatgagtaaagaagctttaaaaattttctcaataaaatttgtcagtagattatttctaattcattgccattaagcattgtaatactcaaaaatcccacttaaggctgggcatggtggctcacgcctgtcatcccagcactttgggaggctgaggtgagcggatcacttgagcccatctggggaacatggcaaaaccccgtctctactaaaaatacaaaaattagcgaggcatggtggcacgcacctgtaatcccagctactcgggaggctgaggcaggagaattgcttgaacccaggaggtggacgttgcagtgagccaagatcgtgccactgcactccaatctgggcaacagagactctgtctcaaaaaaaaaaaaaagtaaataaataataataatttccccctcagtattataacttaatagttaagtaatatatcattaaattagaagtactggtctctaccaagaaaccagtttgcatcccagccctgtgacccacttacttgtgtgaacctaggtacgaacctgaccctgagcctaaccagaaagaaaattgagctatttatacctgccatccagagttgtgagaaagagaaagagcatgtctaaatgccttatatatgcccattgtttattcttcaaagaaaaacctttctggtttctgcttttcatggcgtgatatccggagactccctgtgactcttctagcctgagatctcccttctccaagaggcgtggtggtagttcggtgcagggtgtgtcttccgctctctctgtcggtggtttcgtattagctgcgtactttgctttattcagtgggtcaccttagttatttactgcttaactatcaaacataggcctttgtttagtagagaaataaacagttcttctctaagtccatcttaaaaaaaaataaggctgtattttcacatttgtttcctgaagtttctgatgcatacaccttcaatatatgttctctttcttttctgcagatagtagttcctcagggaagaacagaaaagaggaaagttatatatttgagtcaaagggtgatggaggaggaggggaacacccagccccagaaacaggtaaatgtccaccttggaaaccctttgcagactgtagtcttctcagaactgcatgccctctggctgaggatattccctgaggccatgagagctcaggacaggaggagtccgtcagtggaccgaaagaactgtctcctcgttgcttgtattgcactgcgtcttggggctcctgatagtaaccttccatctttggacctcagctgccttttctatacacccttccaggtgtgacacctgtggaaaatgtcatacttgtggcatggtgggagaacacaagctttagagtcagatgccacaattcaaatccttgctcaaagctgggcacagtggctcacgcctgtaatcccagcactttgggaggccaaggcaggaggatcgcttgagctcaggagttcaagaccggcctgggcaatatggcaaaatcctgtctctacaaaaaatacaaaaattagccaagtgtggtgacattcgcctgtagtcccagggaggctgaggtgggaggatcacttgagcctgggaggtcgaggctgcagtgagataagattgtgccactgcactccagcctgggtgacagagtgagaccgtctcaaaaaaaaaaaaaaaaaattctcacttacccactaaactgtatgaccttgagcaggctatcttatctctctggatctcagtttcctcattcgtaagatgaggatagtaacaatacctgcctcatagggttgctgagaagaatatatgggataattaatctcaagcattgaatgcactgtgtggctcatatsatgagccaaatatagaaacgatggcagttattactcagttatttacgatgaaagaagagtaaaggtcttagaatacctagttctctttccaagtgccctagtgacaaagacagaaaacaacagaaatgagggaagggtgtaggaagtagaatatttactaagtggaagaagaatacaataatttctttaattttggttgattttaactaggaagaaaagactttggaaaccatcctttagaaaggcaggctttagtcttaaatcccacaaactagtaaaagaagctttagaagaacaaaatataagcttaagttataaacattgagaaaactttctttttaccctatttataatatcaggacaatattaaaatataatgtttaaacaatagatagctaagaatactccagatgtcaagtacctgggtgacccccttggtctgctggcctcctggacttagcctgtcccaagatatttgaataaaaggggccctgtcccctatcaagggaagagggaaaccagcctgcctcttgcctccccacacatatgtatccagagagtctcagctctagttggctgttgcctattctggttgttacatatttttgttttgttttgtttttgagacatcgagtctcactctgttgtccaggttggagtacagcggcgcgatctcagctcactgcagcctctgcttcccgggttcaaacgattcccctgcctcagcctccctagtagctgggattacaggtgcatgccaccacacctggctaatttttgtatttttagcagagatggggttttgccatgttggccaggctggtctcaaaacttctgacctcaagtgatcctcctgcctcagcctcccaccatgctgggattacaggtgtgaaccactgtgcccagcctgttacatattttaaatgtcacccccattcatatgaacagaatacataattcatcaccctagctggttactgagaatagcatcatggtgtgttttagaaggagctagaaagttgtaaatctcaaattatccaaactaagccaactaaatattaaaagtcaagaataattttcaatattctggcaagtacttttgggagatttcattttccttgtcataaaagcattaaacaggaatcagatcagacagttcagcagcctcatatctgacttagcaaatagaacattttcccagatctcgtctgttttattgttaccatagctaaacctgagccccggcattgggattggcatcttcaaccacagcttcataaccctttagcctaaatgctgatgctcatctttaagcaagtcccccggactggggctgggtgttgcggtccaattcatgagaaatgatttggggttcctggggttttctgtgggtattgaccaaagtctctttttttgtcctgttcctttgtaacatatgcaacttataggaaggtggagggagaatgacaccttggggccacttagccttgtcagaacttctttcatcaggtggagactaggaggcagtagtagctactgaagccccaaactgctggcatggagagaccaggcagccatcttgacacctccagaactgctgtgtatggaatgagacagccgtagaatccaattccagtccatagggttatcaccgatttgtatctttcacaattctctggaggaatgctggcctcttccagaactttgtttgatacctaacagtctctaaagcagctttcccatcccctcctccggcaaccagacactttcaaactgttcttgagaatcttgttcaggagttttacctgggattctaaaaatacaccagagttcaagtgccgtgagtgtgtcatcagctccaggtcctcttgtcttcaagaggcggccagctatacctgggaccagttttaagcccagtaaatcaagactgtctggagtgaacttcctcagctacctgccccccaaatgtaaaaactcatctggttgcattcacccctcttcctcccctccagtactaaaggaagaggtgtcgcctctttccaaggtctctccctgatctggctaaagcccctgatttcctcaggttcatttctcatcatctcctagctctcccgtgtttttcatctctgtttctttactggctcattctcctgactgtgatcatgttcagatttcttaatgtgtaaagaaacaaagtagcatcctccatcttctgtactcccataaatgaattaccaattgctaaatccagggggctctccaggcttcacctcacttgacatttccttagcatttgattcagctgaggactttcttcttggacgtctctttcctcagcttccaaaagcccactccctactatagcggttgtcctcctatttctctgactggtcttcttctgtttttttttggtcctctgcttttgtctgccctctaaatgctggtgtttcccaggacctcgttcctggctcacctttcttcttcctttctctctggctgtcctaacccctattgtgactgcagctaccacctttatgctaaaggctcccacatatttaggcccagctaatccaaaagcctaagagaaaattccacctgatcgctgataggcatctcaatctgaaaatgtcaaaaaataaacttacctccttcagccacccaacagtctctatcatacatcaaaatcactcaggcaaaaatcctacagaccaggtagatggaccacctattttattaatacaactatgcttcatctataattctatcatagtaagtataacactttgttgcattttttcccatttaaatgtctgtctacccagacttactcgttcaaaaactgtctcatttacattttgtagaagtagagtaccatagtggatagaaccacaggctctggggctgtcctgtctggggttatttgctagctctaccacttaacaatcttagacaagtcacttcagtcttttttttttttttttttaagacaggatcttactttgccacccaagctggagtacagtttaagagctcactgaagcctctacctcccagactcaagtgatccttctgctttagcctccctaagtattgggattataggcatgagccactgtgcccagcctcacttctcttttttttttttgagataggcccttacactgtcacccaggctggagtgcagtagcctgatcatggctcataacagcctcaactttctgggctcaggtgattctcctacttcagcctcccgagtagctgggactgcaggtgcatgccacaactggctaataattttttgtagagacaaggtctcgccatgttgcccaggctggtctcgaactcctgggatcaagcaatttgcccacctctgccttccaaagtgctggtatcacaggcctgagccaccgtgcctggccctcacttcattgttgatgccttagctccctcatttgtaaaatggggataataatagcaccaacttatgtggtggttgtgagaattcartgatttaagctataaagctggtattcttggccttagcttatcttgaggggggtggtatttatttacaaataaaaggattatcagcacttagctcagtgtctggcacatggaagaaggcttttaatgaatgcagaatgaatgaataaatgagagcaaatggtayagaatgagcctacacaaaggagatgtttctcctctagttctaccagttggcaagatccctacagctaaaaacagttccaccatataatctccagacctggcctggccacagagtagatcagactaaaaatagagcctgctaagcttgataaaaaagactgatattggcacaccctgtccttccagactcctgcaagcctcgctacttctactctggtgtctagaatccacctcacaggaaaaactaaagaaatgttttcctttaatgtccaaaatcacaccagcatatttggaagttagttttcaacaaaggttctactgactgagtcagttccctggatttagaaggaaataaatttcttaagccctaactagaacaagaaatcaggagttagttcatacttagttgaagaatgatcatgtatgaattcataaatatagtcaatgactacaacaaaaaaatttcgtgatcagaatgcctatttcagttggatatgagtgatcagatggtagtatgtgtacccattgatgccatacaaattttgtaggaagctggtagagaatttggttttaaagaggtctgtgttggccgggcacggtggctcacgcctgtaatcccagcactttgggaggccgaggcaggtggatcacgaggtcagaagtttgagaccagcctggccaagatgttgaaaccccatctctactaaaaatacaaaatttagctgggcacagtggcaggcacctgtaatcccagctactcgggaggctgaggcaggggaatcgcttgaacccaggaggtagaggttgcagtgagccgagattgagccattacactccagcctgggcaacagagcaagactccatctcaaaaaaaaaaaaaaaaaaaagtctaggtttgggacctgaacctacaacttacagcctcctaggcaaataagcaaattacttaaccttggtacaccttagttaatctgcaaaatagtgataatactaataacaatttgtttggattaaataaaatagtgcatgcaaagcgcgtatcatatagtgaccagtagctgtcactgtgactaatcactggcttgccctcttcatgtctaaccttctcaaaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagkttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttacttagggtgggtatacctaaattataaaccttatgtacaagtcagtaagccttagggaaggtgagtgtgggtccttcctaatccctctgacgtcatgtcatataggtggctgcctccttagactgacctttgggagaaaaaaaccccagactttgaattagtaacagctctaagatggtcatgcagtgagataggaaatcaagatggaagcagagaatctggcatgccaaaaactaacagaaacttagttgaaggcaaagagagcaaggagaamgtttaatacttcattacatcaaatcaacactgctccatggtgagagcacagcaactcatttatatatatatatataggctttgttgatgaaaaacgacaattgaagagaggacgttgagtggattcctgggtacagcttttgtaaaaatgtcaccatggctttcatccaatggaatgagtcgatgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattattaagcctttttttccttttaatataatcataagttgctattattgactgagctgttactgcattatttggattcaatcataccaaccctattttacaacgggggaaattgagtattagagaaagtgacatgcccagggccacataaagcatactcgagggaaggagaatcaaggtctacaaaatatttatatcaggtagactgaatgtgacttttaaaagtgatcttcttacctgtagattatctgattgaaggagttctgcatctaagacaatggaaacataattttaaagggaaaggtgtccacaatttctctcttaaacatgttcttgtgttttacatgtcttttcctaaggctcactaactcctcctgaacacttaaaacttactttttcctttcattcttagtagatagcagctactcctccagccttccacagcattttactgtttcaaatcagctgagtacccaatacattctcttccataggaaaataacaggatttttttcatcttgctcccaatgacttcaaaacctgtgttctggccccacaactcagtgccactcagcaacacctctcttcagttactgatggctgttcacatggccctttactagattttcctttgacccacacatagagatgctctttttctttttttgggaccgagtctcactctgttgcccaggctgtagtgcagtggcatgatctcacctcagctcactgcaacctccgcctcacaggttcaagcagttctcgtgcctcagcctccgattagctgggactacaggtgtgcgccaccatgcccagctaatttttgtattttttttagtagagatggggtttcaccatgttggccaggctggtctcaagctcctgacctcagatgatccacccgcctcggcctcccaaaatgctgggattacaggcgtgagccaccatgcctggccgagatgcatatttctatttccctttccattttgctgttcaaggccaactctgttgattacttcacctgtgtaaacaaacaggtgtgctgtgccccagaacacaagccaccatccttaccttcagatgttccctcaacatcatgttgatgatgcctcttaacacagcatctgagcctgagattccgtaatttgggctccttgttaaattcaactatagcatctcaaaacaatttcatgttttggcttactttctcaaaatggattatgccactttattcctagcagaattactttaatgttttgttttctggactccaggttttctacaacttttcagattaaaattgaatgagaatttctaacaaagaactgcccaagctgaatacaaagagggagaagcttagtttgcagtttgccattcacaaatttctcgtctcgttggctttttaagcatctgtgttgcagacttttctgttcctgtccccattttccgacctactggattctagtattctaaaaataaaatgaatattttaagttatagctactttagtggataaacacagattctccagctaaatagaaaaccaccaaggacaaaaataaggttcgacatcccaaagctgaatgtttttgggaattgactggttagaactgagccttctcctatatttcccatatttaggtctaagcatatcttccttcctacttattttaattctcaaatcacatcagtttttaaaatcttatgtcatcaccctgcaaattggaaagagatcaatttataatattattcagcttaaatccttttatgaagttatttcaaaatttaggaaacttctcaaaatattttaatacaaaaataatgttaacttttacaaaaatagcttagggaaattggaccaggtgcagtggatcatgcttgtaatcccaacacttcgagaggcgaggtgggcagatcgcctgaggtcaggagtttgagaccagcctggccaaaatggtgagactaaaaatacaaaaattactaaaaatacaaaattagctgggcatggtggcaagcctgtaaagcccagctatttgggaggctgaagtgggagaatcgcttgaacccaggaggtggaggttgcagtgagctgagattgtgcactccagcatgggcaacagagcaagactccatctcaaaaaaaaaaaaaaaaaaaaaaaaaaaaaaggccacgcgcagtggctcacacctgtaatcccaacactttgggaggccgaggtgggcagaccacgaggtcaggagttcgacaccagcctggccaacatagtgaaaccccgtcgctactaaaaaaaattagctgggcgtgctggcacacgcctgtagtcccagctactcgggaggctgaggtaggagaatcgcttgaacccaggaggcagaggctgcagcgagccaagatagtgccactgcactccagcccgggcaacagtgtgagactccatctcaaaaaaaaaaaaaaaaaagctcaggaaaatagtgtacgggcttttttttttaaaggtgctctttcattttcatagtcatttcatatgaccaaatactcaaaatccaaatgaatcaaaagagttcttacatataaacaaaacagttctacagatgaaactagagatcttgataaatctgtaaatatatgatctagagatttgtgtatagaaaaagaaatcagaaccatgaactgcaatctgtgagaccacagctttaactttttttctgccagggaggtggaaagatgaggaaaaacaggggggtgagaggagggacagacagaagcatgcctcagaggttctgagggccccctagcacagcacagtactatatgggaactgaaagttagattttactctattttctctcccagcaagcaaagggccgtttcacagagattcctgactgaaacaacacaaagtcagttaaaaagatgaagctggggctgggcatggtggctcacgcctgtaatcccagcattttgggaggctgaggtgggaggatcacgaggtcaagagatcgagaccatcctggccaacatggtgaaaccctgtctctactaaaaatacaaaaattagctgagcatggtggcgcacgcctgtagtcccagctacttgggaggctgaggcaggagaatcacttgaacctggcaggcggaggttgcagtgagccgagactgcgccactgcactccagcttggagaaagagtgagagactgtctcaaaaaaaaaaaaaaaaaaaaaaagccagaaagatgaagccggaagtggggaaccaacaatcattattgtagcaatgatattagaaggattaaggataaggaaattattggacttgattccctcttttttgttttttttgagagagtctggctctgtcgcccaggctggagtgcagtggcgtgatctcggctcattgcaacctctgcctcctgggttctagtgattctcctgtctcaacctcccaagtagctgggattacaggcacccaccaccacacccggctaattttgtatttttagtagagatggggtttcgccatgttggtcaggctggtcttgaactcctaacctcaggtgatccacccacctcggcctcccaaagtgctgggattaaaggcgtgagccaccccacccggcctgatttcctttttatcatattacaatacacaaacattccttggccccttgggtcagctggttttcttcaagtgggattctttcaccagccctctatttgagccacgtgctaggttcagtgagaacacaacactcatctttctggaaaatggtcagaggaatccagagatccaactgaaatccaatcagaacccatttgttttactgttcagttctttaagaacacaataagttgtaggcaatgatttatacctagaagaatgttagcacttacctaaaataatgtattagcctctgaaccccatttagaacactaaaaataatccattagttcatttacaatattagtgttcagttaccatactcatatattttagtaaaatatcaaactattgaaaatttgttaacatttagctgaaaaccaaaaatacccacctggctaatgaaacaaaactaagcagctgtttcctggctgacaatcacacaccaagaatagcttcaaaaattcatgagcattattactcaaagatgtcagtctattttagatcaattgaatttttaagatgctttaatagaggtacattatataccaattttaaaagttcagtgggccagggacggtggctcacgcctgtaatcccaacactttgggaggccaaggcaggcagatcccagggtcaggagatggagaccatcttggctaacccagtgaaaccctgtatctactaaaaatacaaaaaattagctgggcatggtgacgtggaaggctgaggcaggagaatcacttgaacccgggaggtagaggttgcagtgagccgagatcgcaccactgcacagtgaactttttttgaacaatggcagtatttaaaattagggcagtggaatttaaaacacttgcatgaacaatgttaatggattattttcctcccagaatgtcattttcttctaatgttattgactggaaaagagttgaaaccctcgaccgggtgtggtggctcacacctgtaatcccagcactttgggaggctaaggtgggtggatcacttgaggtcaggagttcgagaccagcctgaccaacatggtgaaaccccatctctactaaaaaaatacaaaattagccgggtgtggtggcgtctgcctgtaatctcagctacttgggaggctgaggcagaattgcttgaaccccggaggtgacggttgcagtaagctgagatcacaccattgcactcaaaaaaaagaaaccctcaataaaaagctgatattcataattcaggcttagattatataagtggtttttgttttaagagataggcttcttaggtttctattagaagggtggaggaaaagagtttttaaaaaagagagggagagactgagtcttactcgttgcccaggctggagtgcagtggcatgatcatagctcactatagctttgctcactacagcctcgaactcctgggctcaagcaattctcctgcatcagccccccaagtagctaggactacaggagcacatcaccatgcctggctaatttttgtttttttgtagagacaagatgtcactttgttgctcaagctggtcttgaactcctggcctcaagcaatcctcctcgctcggcctcccaaagtgctgagattgcaagtttgagccaccatgcctgggcaagattacataaattttgagagcttgatttggcctttaataaaaccaaatctgtagaaaaaatctcatttcaacatgatctcactagactgaaactttttgaaatgttttcattgttgcccttcatattatgtaaaggaatcatgtctattaaggaaaatgacataaggaaatgttttagaaattatgaatactaaagattaaggagacttttcttgcctgtaacctgtacacacacacacacacacacacacacacatcttacagaaaaaaaaactcttaggcctagctaaaatccattatttccgtttctacccatttattcatgctcccttaaagcccattcctgtttattcaacattctacaattttaattcataaacatgtaaagtccaagagcagtgcttgaacaatgctgaaggcatagcactgtctgtactaatcaggtggcacttaagtttgtcttgtcatatttatataattgtctcctcaaacagacttcacacttttgagagtaagggcccttttctattcccaaaaccaaacatagagactcatatatagtaaaatgttggtaatggctatgaaagacacagaccagtggatacatttaagaattaacttcagttgtaaggaatatctgaccttggctgggcgtggtggctcacgcctgtaatcccagcattttgggaggccgaggtggggggatcacaaggtcaggagatc

SEQ ID NO: 12276 - DNA, 68021 bp, Homo sapiens
gagtccctgtgtcaaaaaaaaaaaaaaaagtaaaaagaaacaaagatggtaacagccctttccccaaataagcccctttcttgcctgaggactggactgcctttgcaaaactaacaaataagccacaagattagaaattatggcttaggcatcactattataaaacctaagttcagtgcttgagatattttatagaccctgtcctcgatggttggcagcaccccgttggcagtacctaggttgataaactggctcatctggtcttgtgttttatccgcacaaccagttccttgtgaattaaactctttctctattgcaattcccctgtcttgataaatcagctctgtgtaggcagtgggcaaggagaacccattgggcggttacaatttccttgtaccaggtaccaggccaggtgaagttatagaaagaacttaactttcacaacgaatctctgaggtaggtattatcatctgcataatactgatgcagaaactaggctcagagggctaagttacatcacacaggcgataaatttgtcagatcagatacttctttttaattatttttttattattatacttaaaagttctaaggtacatgtgcacaacgtgcaggtttgttacataggtatacatgtgccatgttggtttgctgcccccttcaactcgtcatttacattaggtatttgtcctaatgctatcccttcccttgacccccaccccgacaggccctggtgtgtgatgttctcctccgtgtccgtgtgttctcattgttcaactcccacttatgagtgagaatatgcggtgtttggttttctgtccttgtgatagtttgctgagaatggtttccagcttcacccatgtccctgcaaaggacatgaactcatcctttttttatggctgcacagtagtccatggagtatatgtgccacattttcttaatccagtctattattaatggacatctgggttggttccaagtctttgctattgtgaatagtgccacaataaacatacatgtgcatgtgtctttatagtagcatgatttataatcctttgaatatatacccaggaatgcagcccagttatttctaactcaaaggttctatccttccactatacttcgagacaaccctaggtgtattccagttacaataaatataattttacatcctgaatttaatccatcaacttattggtatattcctgttattgatatttcttcatatatcttagcactgcccatgtgataacctaagcttcacaattgccacttgagtttcctaatctgtactactggacatttactttgttactttttcaccattataaataatgccataataaacatgttttgctcatacgttctcttcagcatagatcattttcctaaaaaatattccagaagtatgaatattttaatggtttctgccacatattttccaattactttccaagagggaagtaccaatttacaccatcagtgagctagaagtgtatataaagtttcccatatgcatgtcaatatgagtaaaacacttttttgctcatatgttctcttcagcatggttccttttcctaaaaaatattccagaagtatgaaatgaatattttaatggtctctgccacatatttcccaactggtttccaagagggaagtagcaatttacaccatcggtgagcacagaagtgtatatgaagtctcccatatgcatgccaatatgagtaaacctatttttaccaagttaataaatgaaaattggccttatttacatttctttgattctaaggtcgaacatttttccatgtttatccaccatacctcctcttctgggaagtgtctgctcatgtcctttgcccatttatttttatttttcttgctgactcatatatatatatatatatatatttttttttttttttttgaccgagtcttgctctgtcgcccaggctggagtccagtgttgcaatctcagcttactgtaacctccgactccagggtttaagctattctcatgtctcagcctccccagtagctaggactacaggcgtgtgtcaacaaaccaggctaatttttctatttttagtacagatggagtttcaccatgtttgtcaggctggtttctaactcctggcctccagcaatccacctgcgttggcctcccaaagcgctgggattacaggtgtgagccactgtgcctggcccataaactctacgaataaataatgtcacatttttcccagactcttgtttgcaattccttttgtttcttgatatgaagttttttataaatgtgcatataatctatcccctttctttgtgacctctttaattgatttgaaacctgtcttccttccagatatggaagtttacttcctttaagtttttttatgtatggagtaatctatggcttaatttaaaaaaaatttaattctttaatccatctggaatttgtgtatggtcagagttgtaggtctaaatgtactttccctgacactgccaaccagttatcttactattatttattaaatataattgtttataacacaaaagggagaagataagaatgtgagaaagtaaggcccttggagagggagagtggtcaagcatctgcagagggattaaccttgaatgggaaggtcaactcttttgtttgcacttggcggagacagggaaaggctgggggtggcagcaggtgggtctgcagagaggagagcagacctctgcctaatagctttgattttccctgacacacaaggcaaggggcccacttcccaaattcttccccgagatactggacttcaggctgaatatccagcaaaaaccacataaaggttatcgtccttgagtccttggaggttatattccctgctcttctggaatcctagcagctctagcttctacctctcctccctccctccctccctcctgctgttcttcactttttatcatgacatccagtcccccaaccctctagtcatgggcatgacccaaccaggttcctagaacagtatcatgtacatgcgtgccaccttcctaactcacaaagcatgtccccccttgaacctcacgacagcctgggatggaggacaagcagacaccaagtcctgggggcatgagcagggacttgtttgtggagacgccaggccccagaacttcaagcaccytcctctgttctacagattctagcaggcaggctcagtcactacaagacacctctctccagcatctctcactcattcctgcatcctcccgccttccctacctctaccctcgcagtcccagcctagtgatccctttctcagcttctgctggtgctgctggagaaagcataggagttcaggctccacaaccccatgctgtgtgacccttgggcaggttactttcgcttgccaagccttgtatacactagggattataacagaacctaggcctttgtgttgttgtgaggacagagtgagttcatgcgtgcaaagggctgaggacagcacctaacaccaaagtcaacaaatgtgggcatgaaaacagggctggtgtgtcctgctgtaagttcgtgctatcccatcaccatttcttcatggtgctttcatccacctcagatggatccagtcacagctcctctccaagggctcttctaaaccattttcacatgctcacaacccaaaaacgaacaattcaagaaggaaaaacttagtctctgaagcataaacaacttcaacctgtcaagcatctgagcaggggacacacaggacactggggaacaatttttgacctccacgcagagagaacaaatgagcctctacaggaacctgagccgcaccttccgcgtttccatgttgctgggacctcaggaagtctgagcacagcagtgttctcccagaaatgaggaccagcaccgcgctcgcctattttcatcccaaacatctacaaaacaattcctagacaaactcccctggggaaaggaagggcaacgaagcaagcaagaggaaaaacaacccagaaacttctcatagtaacctgaagtttttgtttctgtttctgaggcagtgtctccctctgttgcccaggctggagtgcagtggcgcaatctgtactcactgcgacctccaccaccacagttcaagcgattctcctgcctcagccgcccgaggagctgggatcatagacaggcgccaccatgccaggataatttttgtgtttatttctttttagcaaagacgggttttgtcatgttggccaggctggtctctaactcttggcctcaagtgattcacccgccttggcctcccaaagtcctggggttagttatgagccaccgtgcctggcgtctccaagtaatctaaactttaaaatttttgttctatggcatattctttccttgtttattttccttttcaaaggtttcctctgggtttataggaaagctcactttggcaatgtcagtttcttccaggtaagtagtgagaacacagagaaaagactttgtttctttgctgctgggatattttggtctgtgtttgggcagagaggatgtgtgtgcaacagccgtggtgggcctcagagatgctgatggggggtccaagtgaaagtgctgcctgcctccacttcagaaggaaagctatggagtccttcccagtgtttgcctcaaggccaagcagtcgcagggtgaccctttgatatctgctcccctgacaaggattctgagcctcatctaaggtagaggtggggagggaggcaggatgtgatggacacagatttccagactctttcaatggatccacaggttttggagaatccacacttccaaaggggctgagctccgcccccatcttgctgatatcattcgtgctattataaatcaaacagcaacagggcatgattaaacacacggagcctgaccacacgtgggcacaatcaaggtctcttattccctccgtgacattcatgtccaaccactaccatttttgtgcctcctgtatgtgtcctgattctctcattcagagcatctacaaaaagtcaaaccgtcgaatcagcatcatttttagtccttaagaaacacgctttaaagtttcctattttcttttccttttttttttttttttttaagatggagtttcgctcttgttgcccaggctggagtgcaatggcgcgatctcggctcactgcaacctccgcctcctaggttcaagcgattctcctgcctcagcctcccgaatagctgggattacaggcgcatgccaccagctctggctaatttttgtatttttagtagagatggggtttcatcacattggtcaggcaggtctcaaactcctgacctcaggtgatccgccctcctcggcctcccaaagtgctgggattacaggcataagccaccacgcccggccttaaagtttcttattttcaacgaaaatcaagtcccctcttttcactttttataaaagggaccagaagttttcctcccatttttgtatgatgaaagccaccgcaggcaaagtcaggagagccacgtcaagaaaaaggagtgggtgttacgagaagcccggcatctaattagattttgctcttgcaattacttaacacaaaccatgccttatacaacccatgagactaaaacaaacttttttctctcagcatttctccccttttaagtcatatttccacgaatcctctcagatcagcctttctcttcaagcctagaaaaattccagtagcacgtcaccgcgcccgcccgcccgcttctgccaaactactgggcttcctcttccctaagacagagaaacccatgccagaaactcttctgggtgcccgcggctaaaataacttggcacgagtgtgtttcgcttccaacttggcgagggcgctgcgggtctcgagcgctctggccaaggccggcccctcagtcgcgcgcttaccctgccggggcgaggcgcgcgcggtggccagggcggcgccgtccggcgcgcggctgaggctgtagctgctgtagccgctgtgcagcgcgaacttgcagacgttgcggccgcgcgccgtgcagttgaagaggtagcagccgagcacggctgccgggggcgcggggcgccggggcagctccaccacggccacggagcagcgcggctcggagcagcaggccgccacgcattgccgccagccccgcacggccgccggcgcccgcaggaagctggcacccgccgccagggagtccttggtgcggatgatggcgtcaggcattgcgctgtagccgccgctgcccgggcccgggcagtcctcctgggggccgccgcccgcgcgcagctccagctccagctcctcctgaggccgctcctgctgcagttgccggcggaactcctccagcagctgctccacgcccgacagctgcgcgtgcagttcggacagcggcgccgcgggcggcaaggccgcacggccgcttggcagccacaggcagagcagtagcagcccgcgcagcgccccgtgacgcggcggtagccggcgctgcgagcccgcgctctcctgggcgacggaggccatggcgacgagagccaagggcagcgagccgaggcggggctgagcgcgggaggaaggcggggacgcgggcgagcgcgggccctgggcccctcctgcgcggccgcggctggctctaggccccggcctcacagcgcggcgcccccgaacccggctgctcccccgaggtcgcgggcgccggcgggaaccgcagtagcgggagacatagccggcccagccgggcaccgctccttgccctcgccggagactgcccagcgccctgcgcctctccgccccggcctgcggcgcgctgggtggcgacgagtcggcctcggcgttgatcagcaccaggtgtgtgcgaacagtggccgcggcggggwggagccttggtgagycccgcccccccgcgcggccccgcccccgcgcgtctcgcgccggctcctccagggctgggagagcaggccccggggagggcagcctcagaacaactttgctcccgcgccgctgcccagctagggcagggttcatgtctgggcccagcaggctttagcaaccaaccacacctgcccagggcgcctgcccacaggggcttggcattcgggggaatgggggcagtgggaagggagggcctgtcttcaaatcctcgtgacccccgggactactccagagagggggcacgcgcacctaggaccaccgtagcgcgtcatcagtccttcacctccagcgtccctgactttccgcatcatgttcccaagatgtgcttgggtagtacaaagtggggcggggttggggtggcggagtcagggccgggaggggtggggatgggaagtactgaaagatgttcagtctgtttaaaaacacaaaaatcaagcctggtgaggtggtactcgcctgtaagtcctgaggctgagttgggaggatggcttggacccaggagttcgagactgcaatgagctgtgatcacaccactgtactccagcctgggggacagaacaagaccctgtctttaaaaataaaaacaaaacccataaatagcagtcgtcacatgcactcagatttccacaaatataacaaaaaatctgaacacagccaacatggggacctgggagtaatacagcctgtgacagagaggcctctagcggttatatcacgtaaaatctcgggagttgtgctttaaatgacataaggaataagaaaatgtccaacccagtgggggcttcmccttggcgttctagacttctgtgagcagcatctgcatcttgtttgtttctgaatcagtttctgttgattcatttttctcctgattgtggatcgcattttcttgctttttagcctgtccggaaatttttgcctggatgcgcacattgtaaatagaacactgttaagtgtctgtattttttaggakkgaaagaataaataattggtgggaaaatatcagtctctgctatgtgtttattatctccagagttgacatttaggaacccattgcttgcagatccagatcagagtaggaggtaaaattaaaaggtagcaatagaaaagaaagaaaaaagctcaatgttacttgccattccatcaaagggagaaattataaagtttttgcaggggtatatttgagtgatttttgaggctaaaagaaatggcctcttagctctaaaggctgtgtctggactgtaccacttcggcctggagattcttcctcatatggcatactcatcccacacaactgcagtcattgtaagatgaccttgaagcaacataatgctttttattttttatttttattttttgccatagaccttggagagcttgagcaggattgttatgaggagaaactttcactagtgatgaaaatgctgactgagggtatcatcaaaccctccaaggactagttgttatataagttattaatattaaaaataacatgataatatataatattaactaagaattgtacatgatttcaaagtttgccaaacactttcacatacatgattttatgtgccttcacagagactttgaccacctcactcctgcctttgggaccgtgaaagagaagtcagtatagagtgagccctagctcacatgttccgtggtagggaagtggacaggggagaggacagcatttctcaggggcattcatttctaaatccctccagcaccatcaaagattttcctgcatctgcaactttacaataggtctttttgggagaagtggaaattatttaatgttgtgtttaccgtgagcagtggttatttctgggctgtgagttgcaagtactgaaggggaaatactgacttttataatttataagactttgttgaattttttttttgcaatgagcttgttgtaaatgattttctattttttaaaaataagtgttgacatctgcttcagccaggagggagcaacaaggactggacttactctgtgacctgaaatgaaaaatctgtgaaaaaaatgtatggaacaatggttttcagacattgggcaacaggcaatgcagggcccaagagaagggagacaaaggaagtgaacatgctgcttgctccagcttactgcctggagagggtttccaagcygcaatgcagacaggcgaaccaaaagagactctgagttggaaaatagagctgagaattcagggaggccagggtggctagagtaccagagaggagagagtgcaacggaaggagggagctctggagatctgtgcagggttcctctgagtcttcagcagaagttygaccaggtacatgcatgtgaggaaacttcccaagacagagaggcaaccactagaaaaaagctggcagaaaaacttctgagcttgcattggccaggcaatagttcgttcccaacagccagagtggagaaaccttgtgacaagaggcatgagtttgagtaggaagggaagggattacagagaagcacatgaaaacttttgcaggtgataggtgtgttcattaccttgattgtggtgatggtttcactggtgaatacattgatcaaagttcatcaaattgtgtattttaagtgggtatagtcaattatatgttaataaggctattttttaaaaacgaagtttcattgcactgtgcattgtgatttatcttctttttctagttctcttttcagtttttttcagaaataaactatctttgttttaaaagcctaaacatcaaaaccttatcaatggatagaagaatttttatgtgaggatgaaaatgtcaggaagatgtgtttctgttttataagatagatcattaagagtaagagtggatcaaattgagattggacttcgtaggtcagtttgttgaatgttggaatgagataacctgtgtcttagctgggctgctgtaacagaataccacagactgggaggcttctaaacaacagaaatttattcctcacaattctagtggctgagaagttcaagatcatggtgctggcagacgctgatatctggtgagggcccacttcctggttcatagacagcagtcttctcactgagtcctcaccttgtgggaggagttagggagctctctgggatttttttcttttcttttcttttcttttttgagacaaagtctcgctctgttgcccaggctggagttcagaggcacaatctctgcttactgcaacctctgcctcctgggttcaaaygattcttctgcctcagcctcctgagtggctgggattacaggcgcacaccaccacgcctggctaatttttgtatttttagtagagactgggtttcaccatgttggtcaggctggtctcgaactcatgaccttatgatctggctgcctcagcctcccaaagtgctatgatttcaggcatgaggcaccgtgcctggcctgggatcttttttataagaacactaatcccattcatgagggctccaccttcatgccctaatcatcttccaaattctccactgcaaacatcatcacattaggtttcaacataggaattttggggggttacaaacatccaatctacagcaacaccctagtgacatcgttttttgttgccctcccctccccwctactgcccatctaagtacttttacaggcatcgaataagttaagtcagtgcatgtgaagtgcttagaagggcatctgacacattatagaagttcaataaatgctagttgttgttgttattacaacagaaatgaaggacctttcctaagattagaagtcatgaaaccacttgaagcctgaatctcctctacaacatcccagctgagtggctgttgcactaagattcttccttctccatacccctttcatggaatctgctctgctcacgtccctggaaggggcagccccaacccccaggtggccacaccccctgttcactagggatggaatcaataatgaatgcctggcccaagcacagccaatcagatactctctccaaggaatgtaaaaacagaattgagaaacaaactgactcagcaaatcaactcaacaaactgactcaacaaattgagtcagggagggaagtgtagctgggaagccaggtgagctccaggggacatggaaggggatgatagcagagagaagctgttcagcagagggggacaaatggaaccgtgaaaagaggaaatagagaacagtgcatacatagccttgagagagggagggagtgaagacaggagttgcctgacactttctggtctcaaatctctcccctgagcacctacttggccttctacctggaattcctctcatggagttcttgccttgcagctcagtgatctaggttcatcctagttaaatctctgtggattgcaaacaacagaaactcattttagattggtttaaagaaaaaatagctaccgtgtttacacacatgcactcacaggcagggaggaaatgcagccaggccttgggagggcctggaccagacatggcagaaccctcagcagtcaagcagctggtctcccagttgctgcttctctcttctgggaccaagtagtctgagatctccacttctctctgcacatctgattcatgcttctctcagagtctggagttttctgccctccatgcacagagcctgagtctatctcacctcacctgcagcaatgaacagaaactcagaacagtgaccatcagtaccaagagagagactctgatgagtctagcttggtcctgtgtccaccctaaactgaggttagtgtgcagagaccatgaggcacaaacagggctacaaacatggccttccctctcctcattgaggatggaaagagaggccgttcttagaggaaggacgtggtagtaactggggaaaatcctgagaagttgtcttctgcgttgactcaggcaatgccccatgtctgcttgaacatgttcattaattttcattttaaatttaagaaacgcttataaaaagtactgtgctacgactaccaggaaccgttctgagttctgcacagtcacttatttacttaaaacaacaattacgcagcatgtgctagtattacccccaattcacaggtagggaatgcaatattttgttactgaaacaccaggggttcagtttaggtcctgttgcttgcagcacagaaagccaatcactggatcaagtatttttgggggaagaaggctttctttggtgctgccaaataaagataagtggagataagtctcagatcttcgaccaacttaaattggggtgtatatagtggggaaggagtgtagctacccacaggaaaacaggaattaaggaggggtaaggaagaacaattggtcaacgggaagcagatggttggttaggaaaacaggaattatggaggagtaaggagaggagtctggtgtctcgttatctggatgtggtgatgtgagttttacttcctcgatattatctggaagtcggagggtttcctgaaaaaggaattcagataagacaaatgtaagttttaagcattaagaaaagcagggtccatttctagctttaataggaaaaaaatggcaaacatcagttctcgggggaaattgagctagtttcaccttcacacaccaaagctccttccatctttgggcaactcttactattcattagaatgttttccttatattcagttacaatctgttttgtagcttccaagtatttgtcccagttccttctcttgggaccactcagagcaacctacacctactcccaagtgatagtcctttaaataattttaaaatgccattgaagctcaggcaactcagcttgcttagtacagcacagtgttgagtgtggcttatgacagcagtgtcaaacacctgctggctgtgtgactttgggcaagtcacctaccctcttcaagcaccagatcaccccgccgtaatataggaataattgcctcaccttgcttcccacaagtgtggtgaggattaagtgaaacacagcacataaagcacttagcacaatggctagtgcgctaaaggctcctaagtgttagctgggatcatcccctctcagttcatcgattcatcacatcgtgaggcttgcagatctccattctgtcatctaacctgttttctatcccacctggctttgttattgttgcgtttttcagcattactgaggtataactgacaaataaaaattgtaggctggagcagtggctcacgccggtaattctagcactttgggaggctgaggcgggcaaatcacgaggtcaggagttcaagaccagcctggccaacatagtgaaacccgcatctctactaaaaatacaaaaaaaaaaaaaaatagctgagcataatggctggcacctgtaatcccagctactcgggaggctgaggcaggagaatcgcttgaacctgggaggcccaggttgcagtgagctgagatggtgccactgtaccccagctgggcaacagagtgagactccacctcaaaaaaaaaattgtatgtatttgacaaatatgacatgaccattttacgtacatatatattgtgtatgattaccacaatcacattaatgaacatatccatcaccacacacagttaccattgtgtgtgttgtgtgtgtggtgagggtacttaaggtctactcttttagcaaatttcaagtaaacaatacagtattattaactatagtcaccatgctgtacattagatccaacttaacatcttataactgaaagtttgaccaactttaaagtttgaccctttgagcaacatctcccccagcccctgacaatgaccgttctattctctgcttaagtttgactttttagattccaaatgaagaaaaatcatataatattttatgttgatgtctagcttacttaagtagcataatgtcctaatgttctccagattcacccatattgtcacaaatggcaggatttcctcctttttatggctgtataatactccattgcatatctatctgtatctacatctatctgtgtatctatatcacattttcttaattggcctgtcagtgaacacttaggttgtttccatatcttggctattgtgaacagtgctgcaataaacatgggggtacagatatctcttggagatactgctttcagttcgtttggatacatacctagaagtgggattgctgggtcatatgttagctctgtttctaatagaacttttttttgtactgttttccataatggctataccaatttacattcccactgacagtgtgcaagggttctcttttctccacacactcaccaacacttgttatttcttgtgtttttttttaaatgataacaccactttaacagatgcaaggtgatatctcattgtgattttgatttgcatttctccgattattaataatgtggagcaccgttttatgtatttgtcacccacttgtaggttttctttgaataaaatgtctattcgtgtcctttgccagtttttgaaaagcaggttttgtttttgtttttgctattgagttatatgagttctttctgtgttaaagacgaacattggatattaattctttatcagatacatggtttgcaagtattttctcccattttgtgggttgtcttttcactctgttgattgtttcctttattgtgcggaagctttttagtttgatacagtcccagctgtttatttttgcttttgtgtgcttctggtgtcacatcaagaaaattattaccaagaccaatgttaagaagctttttccctatgttttcttctagtagtttcagtttcaggtcttacatttaaatcttaatacattttgggttaacttttgtataggttgtaagataaaggtccaatttcattctttggatgtggttaccacttattctcaataccattgactgaagagactatcctttccctattgcatattcttgacacccttgtcaaaattagttgaccatatatgtgtggggttatttctgggctctctgttctgttccactattggtctatatgtctgcattgatgccagtaccatactgttttgattactatagctttgtagtataatttgaaatcaagaagtgtgatgtctccagttttgttcttctttctcagattgctttggctatttgagttcatttgtggttccatttttttttttttttttgagatggagtcgtgctctatcacctaggctggagttcatggcataatcttagatcactgcaacctctgcctcctggattcaagtgatcctcctgcctcagcctcctgagtatctgggactacaggcgtgcaccacaacgcctggctaatttttgtatttttagtagagacggggtttcaccatgttggccaggctggtcttgaactcctgacctcaggtgaccagcccacctcagcctcccaaagtgctgggattacaggcataagctattgtgcccagccttgtggttccatttgaattttacgattgtattttctatttctgtgaaaaatgtcactggaattttgatagggattgtaatgaacctgtaaaacattttgtgtagtatggacattggaacaatattaattcttccaatccatgaacacaggatatctttccttttatttgtgtctactttaatttctttcatcaatgtctatatttttcagtgtacacaccttttacttcctttgttaaatttattcctaagtattttatgctttttgatgcaattataaatgtgtcttaatttattttttagataatayattgttagtgtattgaaatccaactgatttttgtatgttgattttgtatcctacaactttgttgtatacattaacttatttatttttgagacagggtcactctgtcacccaggctggagtgcagtggtacaatcacggctcactgcagacttgacttcctgggctcaagtgatcctcccatttttagcctcctgagaatgagggtctcactatgttgcccaggcaggtctcaaactcctagcctgaagcaatcctcctgccttagccctccaaagtactgggattacagttgtgagccaccatgtctggcctactgaatttatttattagttctaatggtttgggggagtagtttttagagttttctatatataagatcatgtcatatgcaaacaaagacaatttaacttgttcctttctcatctgaatattttattttcttctcttgcctaattgctctggctaggatttctaatactttctggaatagaagcactgagagtgggcattcttgtctttttcctgatttttgggggaaagctttcaggttttcacctttgagtatgacgttagctgtgggcttgttgtatacagtctttattatgttgagatacatttcttctacatctaatttgttgagagtttttttataaaaagatgctaaattttgtcaaatgctttttctgtgtctgttgagatgatcatataatttttatccttcattatgttaatatggtgtgtcacatttattgctttgcatgttgaaccattcttgcatcccagggataaatcccacttgatcgtggtgtatgatccttttaatgtgctgttgaattcagtttgctggtattttgttgagaatgtttgcatctgtgatcactggggatattggcctgtaattttcttttcttatatttttcttatctggctttggtgtgagggtaatgctgctcttgtaaaaggagtttggaagtgctccatctccttcaattttttggaagagtttgagaaaaacagatgttatttcttctttaaatgtcttgtagaatttactgatgaagccatctgaccctggccttttcttcctgaggagatttttgattgttgattcaatctcctttctcactaattgtctattctggttttctttcttcatgatgcagtcttgataggttatgtttctagcaatttatccatttcttctaggttacccaatttgtgggtgcacaattgtttatagtagtctctcatgatcttttgtctttctgtgatatcaattgtgatgtctttcatttataattttaatcatttgagtcttctctgtttttcttcattagtctacgtttgtcaattttatctttcataaaaccaactcttagtttcgtttatctcatctattgtttttctagtctcaaattcatcgattatttctgctttaatttttattatttccttccttctgctgactatcaacttagtttgctttttttttttctagttccttgggatttaaagttacattatttgagatcttccttttttcttttgttattatttatttattagacttaatgttctgctgaatcttttttaatctaggcatttattgccgtaaatacctgtcttagtctgttttgtgctggtataacaaatacctgagattgggtcatttataaataccataaatttattttctcacaattctagaaactgagaagtttaagatcaaggcactggcatttggtgtctagtgatggccttcttgctgcatccccacatggtggaaggcagaaggacaagctagccaaatggcacatgaaacctcttttataagagtagtaatcccatcgaggtgggaggagccctcgtgacmtaatcaactcttaaaggcccacctcttaacactatcacagtggtaacacctgaattttggagagaacacatctagacaatagcaacatccttcttagaactgcttttgctgcattacataagtgttagcatgttgtggttccattttgtttgtctcaagatactttttgctcacctggctttgtatcctctataaactgatgatcctgccttctatgtcttcatccaagaaatccatgtaaaatatggactatgagaaggccaaggtgagagccttgagacacttcattaaaggcttatgccaacattgatatcaattcattaatttgaatcctctaactatgattattaggttattttattttaatttttttttgagatggagtttcgctcttgttgcctaggtgtacaatggcataatctcatctcacagcaacctccgcctccygggttcaagcaattctcctgctttagcctccccaaagtagctgggattacagacatgcgccactatgccaggctaattttgtatttttagtagagacagggttctccatgttggtcaggctggtctcaaactcccgacctcaggtgatccgcccgcctcggcctcccagagtgctgggattacaggcatgagtcaccgtgcccggcgattattagtttattaatccacccagttgcccttatccagcccatgtatttccatcttctccacaaacatatgcaaaattgttgaaaatcttggagttgaggttattgtattctcatacttgccaatttataacagcaatttaaaaaataaaaatataccggggaatttagtaagcaatttaaggttctgatgagcatygttttttttgtcagaattttccaaataggccctcaaaaactgttgctagaatcttgtacaggattgatattggactggtatcgtctttgcaaaataaactatactcccctcttgacgtttgttatcttttgcccatttctgtagtctagacacctttgataatgtccataatctctcaaaggtcacaaacaatggtccagtcctctcatttgcaaattggtatctgggactgtcattcatgtagatcaggaaacctgggctcaccgagagcagttaggactccctgatgttcgttcctcccctaactagtgtttgttctccctggttagtctgaaaatcattccctttgccaaaaaagaaatactcaatgcccaagcacctaagtttccatggcacctataaaatactggaagctgacagtatttctgattgaataggtgataggaaaggggtaggggccagacactggagaggactggagagaaagaaagaaaactgtttctcttttcagatgacatgaatgactgtgcacgtagtaaagctttgtctgctatatccaacatctggattagttcagagtttgtttttattgactgcttttttttcttgagcaacattttcttgctactttgcaggttgcactgatgatttttgctttttaaagaaaacaaaactaaaacaaccattccaaagattaatagtttaaaacaacaaccgttttatgggttcttatagattctgtgggtcaggaaatttggagagggcacaataactattgtctgtctctgttccatggctggaaagaccagaaagtggtgactcagttcttggtggaatgacatggagattcctttactagcatgtctgatgcctgggttaagatgatttgatgtctaggcccactgactttactacccacatgtggcttggctttctcacaccattggcctgagtggtctgacctaaacatcttccaaaaggcctcacatcccaacactgttgcattgcggattaagtttctgacacatgaattttgggggacacattcagactatagcacccaccgagaatcaaggggaaaaggcagagattctacctcttgatgggaagtgtgtcaaagaattggcagccattttacaaaaccaccatactgtccagagatttttcattattatatcttgactattattgatgacacgttgtagaaactctggattctgttgttttcctctgaactgtgttgatttttgttccagtaggcaattcaatgacctgttaaccatcttgaactttagaaggcttggttttatgctctattaggtagatctgtggaaagtccacgcagttcctatgaccttctaaatgcaacttcaaaactctgtctcccctgctcatcttgacagggattgattttaagctttgttgggtagatctcactctgggaygtgacccttatttctaagctatgrccttaggatgttcatggtgttaataaagtattaacaacatctctcctctctggctgggctggcccccaatgtcctgcaacatgtctctgcctctactatctctgtttcaaccccatagcagtgrttctctggcaaacttcaggaggtctcactctgagcaagcactactcggccaaggactycccccacagacttctgcccctcctctccacttggcaatcccctctttggtgacctgtcctgcaaattccagtcactttagctgccccaatctctgatctctgccttctatgctagtgaggcccctgtgctgtgtttggacttcagctcatagcaccatggggaactgtccccggcagacagttgtagggctcaccatgggaatgtcccctctctcaaggatagcagtcttgcactgtctgttgtccactgcctgacaatagctgcctattttctttattcctgggatgcaaggtggtttaacatatgcaaagtaataaatatgattcaccacatcagcagaattgaaagcaaaaaccatatgatcatctcagtagatgcagaaaaagctttcaataaaatccaacataccttcatggcaaaaactctcaacaaactagtcactgaaggaacatacctcaaaataataagagctgtctgtgacaaacccacagccaacatcatactgaatgggcaaaagctggaaacattccccttaagaacagcaacaagacaaggatgcccactctcaccacttctattcaacatagtactggcagtcccagccacagcagtcaggcaagagaaacaaagaaaagacatccaaataggaaaagaagtcaagctgtcactcttcactgtcgacatgatagtaactagaaaaccttaaagactctgccacgaggctcctagaactggtaaatgatttcagtaaagtttcaggatacaaaatcaatgtatacaaattagttattccatacaccaataatgtccaagctgagagccaaatcaagaatgcagtcccatttacaacacacacacacagacacacgcacacacacacccctagaagtatatctaaccaaggagatgaaagatctctacagggataactacaaaatcctgctgaaagaaatcatagatgacacaagcaaatggaagaacgttccatgctcacaggttggaagaatcagtaccattaaaatggccatactgcccgaagcaatctacagattcaatgctattcctatcaaacttccaatgttatttttcacacaattagaaaaaactattctaaaattcatatggaactgaaaaacagccccattagccaaagcaatcctaagccaaaaaaaaaaaaaaaaaaaaaaaagggagaggcatcacatcacctgacttcaatcacatcacctgacttcaagctatcctataaggctacagtaaccaaaacaacatggtactagtacatagtgagaacatgaagtatttggttttctgttcctgcataattcacttaggataatggctggaacagaaaacccagaaataaagctgcacatctgcagccatctgatctttgacaaaactgacacaaataagcaatgggaaaaggtattccctattcaataaatggtgctgggatagctggctatttatatgcagaaaaatgaaactggacccttaactttcactatatacaaaaatcaactcaagatggattgaatatttatttattttttattttttgagaaggagtctcgctcttgtcacccaggctggagtgcagtggcatgatctcagctcactgcaacctctgcctcctgggttcaagcgattctcctgcctcagtctctcgagtagctgggattacagttacctgccaccacacccaactaatttttgtatttttagtagagactgggtttcaccatgttgcccaggctggtctcgaacacctgacctcaggggatccacctgcctcagcctcctaaagtactgggattgcagttgagggtcaccacacccagccagattgaagatttaaatatatgacctcaaactataagaatcctaaaagaaattttcagaaataccattctggacattggccttgggaaacaatttataacaagtcctcaaaagcaattgcgacaaaaccaaaagttgaaaagtgagacctaattaaactaaagagcttctgcaggggaaaaaaaaaaaaaaaaaaaaaaactatcaacagagtaaacaggcagcctacagaatgggagaaaatatttgcaaactatgcagccaacaaaggtctaatatccagaatctgtaagaaacttaaacaattcaacaagcaaaaaccaaataaccccatgaaaaagtgggcaaagaacaggaacagacacttctcaaaagaagacatactaagtgtccaacaaacatgaaaaaattctcagcatcactaatcatcagagaaatgcaaaacaaaactacagtgagataccatctcacaccagcctgaatggtgattattaaaaagtcaaaaattaggtggattgctgggcggacccgtcacggagaagagaggagagtcgcgggccactgaataagcttccaaaatgatgcccacactagttatcctgttgaaagaggggactgatagctcccaagrcatcccccagcttgtgaataacctcagtrcctgccaggtgattgccaaggctgtaagagccaccctgggtgcctgtggcatggacaagcttattgtggatggcggaggcaaagcaacaatatctaacgatgtggccacaattctgaaacttcttcatgttgtccatcttgcagcaaagacgttagtagacattgccaaatcccaagacactgaggtcggtgatggcaccatctcagtgaccttgctggctgcagagtttctgaagcaggtgaaactgcaggtgaaggatggtttacaccctcagctcaacattcgagctgtctgcacagccacccagttggtagttaacacgatcaaagagattgctgtgactgtgaagaaggcagataaagtggagtagaggaagctgctggagtagtgtgccaggaccactctgagctccaactgatctcacagcagaaagctttctttgctaagatggtggtggatgcagtgatgacgtgtgatgatttgctgcagcttaaaatgattggaatcaagaaggtacaggatggagcccagctggtgttgcatttaagaagactttctcttatgctgggtttaaaatgcaaccctcccaaaaataccaaaatccctagattgcccttttgaatgttgagctygagttgaaagctgagaaagataatgcttagataaaagtccacacggttgaggattatcaggcgattgttgatgccgagtggaacattctctatgacaagttagagaggatctatcattttggagccaaagttgtcttgtctgaactccccactggagatgtggccgcccagtactttgctgacaggaacatgttctgtgctggccaagtacctgaggagamtctgaagaggacaatgatggcctgtggaggctcaatccagaccagtacgaatgctttcttagcagatgtgctgggtcgacgccaggtgtttgaagagaccctgattaaaggtgagaggtacaacttttttactggctgcctcaaagccaagacaggcaccttcatcctccatggtggtagtgagcagtttattgaggagacagagcggtccctgtgtgatgccatcatgatcatcaggagggccatcgggaatgagtcagtggtggctggtggcagggccattgagagggagttctccaagtacctccaggattcctcaaagactattccaggaaaacaacagctgttgattggggcatatgccaaggccttggagattgtctcattccagctgtacaataatgctggctttggggccacagagattctcaacaagctgcaggcatggcattcccaggggcacgtgatatgaggtggacatcaacaacgaggacattgctgacaactttgaggccttcgtgtgggagccagctttggtatggatcaatgccctggcagtggcctcttaggctgtgtgcctgattgtgtctgtggatgaaaccatcaagaaycygattgactgtggatgctcccccagcagctagctggggccgtggtcgtggccgcccccattgagaggcaccccgcctatcacatgactggctggcaggctggctgcagggtgtgcttactctccttggtttggttaatagactttacaaggaaggggtagtcactggcccactctgttctcactggaggctatttaaataaaacttgagactttggggggaaaaagtaaaaaaatagcatatgggtgatgaggctatagagaaaagggaacactttacactgctggtgaaaatgtgaaatagtttagccactgcagaaagcagttcagaggtttctcaaagaacttaaaacagaactgccatttgaccagcaatttcactactgggcatatacccaaaggaaaagaaatcattctagcgaaaagacacacatgctcacatgttcattgcagcactattcacaacagcagacgtagaatcaacctaggtgcccatcaattgtggattggataagggaaatgtggcacatatacaccatggaataccatgcagccataaaaaagaacaaaattgtgtcctttggatcaacatggatgcaactggaggccattatcctaagtgaattaatataggaacagaaaaccaaayactgcatgttctcattcttaagtgggagctaagctttgggtacacatggacataaagatgggaagagtagacactggggactatgaggaggggagagatggaggggcgaggactaaaaactgccattgagtactgtgctgctgctcactacatgagatcattcatatctcaaacctcagtgtcacacaatatatccatgtaacaaaactgcacatgtactccctgaatctaaaatgttaaaattataaaaaagagaaaaccaaaattacattaacatgtttctcttacaatcctgttttaaatataactagaattttctgttactgcatagcttttttcctagtttgaaaatataaaataataatgataataaagaggccaggcacagaggcttatgcctgtaatcctagcgatttgggaggctgaggcaggggatcacctgagcccaggtgtttgagaccagcctaggcaacatagtgaaacgcccatatctataaaaaaaatctgaaaattagctgggtgggatggctcatgcctgtggtcccagcagtatgggaggctgaagcaggaggatcgtttcagcttaggagttcaaggctgtagtgggctgcgttcacacctctgtactccagcctggacaacagagcaagaccctgactcaaaaaaaaaaagacccacaaaaaaagcccccaccaaatctattgcaacatcagtcaaaattttagttctacttattaaatacaattttattcttatagcaagtattttaaaattgttatctgtttttttaaatatgtaaaatatcttcttgtcgaagcgacaggtgctttgaattgttacctttatgtttgttgaaactatgaagaagagattaggaagactttaggtttaaaatggaagacagattacatatattatattcttgtaaaactatgaaaataaaaataaaggagtaaaagtcaaaaaaatagctacctatttaattcagtttcatgatcataatagaagggatagtctgaaaacagagttgcaaataagtttataatttgtaaagatctgataaaaattatcagatgataagaatttacaaccatatcatcactgagaatggaggagaaaaagaaagatttccatattacatttatttagaaacatgtttggtgtgtctattttaaagtaaaattaaaaaaagtacacacacaattttttttttttttttgcattcagtgttaaagtgtttatcagaaagaactacttgtgtctgggctcagtggctcatgctataatcccagcactttgagaggctgaggggggcagatcacctgaggtccgtagttcgagaccagcctggccaacagggtgaaaccccgtctctactaaaaatacaaaaattagccgggcgtggtggctcatgcctgtaatcccagctactcaggaggctgaggcaggggaatcgcttgagcctgggagatcgaggttgcagtgagccgggatcgcaccactacactccagcctgggagatagagtgagactctgtctcaaamaaacaaacaaacaaacaaagaattacttgcactgtgctcacataatttatacagtcagttctgctatatcaggttgtttgaaaaccgtactttattccaatgcaaatgatgtattagggaagaatttcagtgtaatgtgaattgcacgtttgcttatgagtaacttagtctgtgagaaatggtgaatgcagaaaactgcctcacaaatgattatactrcctctcaaataatttccaacaactcttcttcctccactgcgtagtaatccacaagctgctactcttctaactcccggggatccatgccctcccctctgtttaattcccccaatttcctcttattttccatttttcctctctgttctttgcttatctctcttttctccctcacttttcttctctccctctcacacatagaggagggggtgttagaaccaggtgggctggtggtaggatcataggtccacaatctcacgagcaaaggctcactgcagcttcagattcctgggctcaagtgatcctcctgcctaggcctcccaaagtgttgggattatagatgtgagctgctgtgsccagccctatcttttaaaaaatatgtactgaaaaaaaawtttttttttttgagacggagtcttgctctgttgccaagactggaatgcagaggcgcgatctccgctcattgcaggctccgcctccacttgactcagggaacacacagcagtgggagccaaggctgtcagcgatcgaggaccacaggtgaacaactctgcgccgccgtggtatcacctctaggtggatcttctgcctttaggaaggagacaaaagagtgcagaaccctgggtcagatcagctcaggattgacccctccgtgatctctcaggactcagatcccacctctctctcagggagagatcagccgctattgttcacattctgcctctctgtcatctagtttatgattgttcactttccgttacttcatcattagttagacccagaccccagcagagattttaggggttcagagccaaggaaggcaaagtatcagtgggaacacagtgggaaggcccacagcgggggcaagagtcttccagctgtgggcaagggtatccctgcggcaggtccagagcactgagggtggggcttggcacgacgccatttgccaggattcctgtgtcaggggtgaaccagaaacccaggtgtcaaaggaatcccaccttctagtccttgctgtcctcacagagtgtctagggttcactttcagccttcccttctgctcacaatcccctctcccacggtctgtgtggccctgcctccagcctgctttgttggagcccaggcagccttcttcattatgtcctcctaggaattaaacctagagacccctcaacctttggcatgtgatatactttcccatggtcagatggtcagatcatcaagctgctgccccacccaaaattgtgtcttgcccaccctctgtgtttctgtccatcagaccacccatcacataggcaacccctggagagtgaccctggtttaaagccygactttgccaaaccgctgtggatgcattaatttggaaaggtccctgttcacctcagggcccacttgcaaagcagagacagtccccgagactcattcagcctttgcctttctcctgttggccagggacagagagggctcaacttgacccagagctaagcctctcaggtcgtgaatgcccaggcgataaatgaaattcacctcatcttatgtctatggtgagatttggcaggggtcttggggagacttagcaacctcatttctccctgtcctcatacaggacaagccctgcccctaatccagaggccagttggccccatctcatactctgttttgctcacagtatacctgatgccctccctcctgacctgtgattgggattgagctgaagatagtcactgacatgattcaaaggattagcacttggtacaggtaggatggtggagatgtggttggggacatggatggttgaggtgaaatggaacagaagagtgcaggttcttgtccaagctccatacccaggagatgacccttacctccgctgccactcaagtcctcacatgtcctgagcgtctactatatagcagccatgatagattctcaggttacaaaagtaatgtcctcaagtaagcgcatcaatttactgacatacacccaatcataaaacaatgtgataatttttctgtggtcagagtttctgagctacgagtgggggtagttaattctatccaggaagaatggtgacttcttagaggaggtgacagttaaactggacttggatagctgtctggaattcggtcaggtaagaaagaaaattccaggcagagatgagcatgagcaaaaaatttggcagcaatgatgcacggtgattcagagatcaaaaagttcagtgtggatgcctctagacattttcttatctgtgtctgatagattttgatattttgtattatcattttcattcatttcaaaatactttctagttttccttgtactttttaatttgatatatagttatttggaagcatattatttgatatccaaacatttgaggatttttccagatagcttcctgctgttgatttctagtttatttccattgtgcttggacaagatgcttcgcatgattttaaccctttacatatgttgagatttatttatttatttatttattgagatggaatctcactctgtcacccaggctggagtgcaatggcgcaatatcagctcactgcaaactccgcctcctgagttcaagcgattctcctgtctcagcctcccgagtagctgggattacaggcccatgccaccacacccggctaatttttgtatttttagtagagacagggtttcgccatgttggccaggctggtctcgaactcctgacctcaaatgatccacccaacttggcctcccaaagtgctgggattacaggagtgagctatcacgcccagatgagatttattttatgatccaaaaatggcccttcttggtgaatgtccctgtgtatttgaaaagacactccctgtcaacccctttgctctgtcatttagctttgatcagctttttctctcttctgtcacttcakcagaaacaatgcccagaaatgccagagacaacaaaataggaatgtgtcatgggcacacaaarctctttttccctgggtgctgctcttccccgtgacagagaaatccatgcgacacagtggggaggccctccccaaagggtggcagatayatttttttccccttgaattgtaayacacctttccccaggcccactctgcctcccacttctgttcagctcagctgtgggcactgacctccaccggcgcttgatccctgcctgctcctgcccagacaggaagcccttcagcagccgactcggttrccaggatgargctagaggccaggaactcccaggtgtctatggaggtcccacctcctttaaatccctactgttcagacccagcttctaaaactgttcttttgcctcccttcctactcaccaatccccttcactattgtcaatggcactgaagtcccagcctgcttggttggggcagttaagtccttctcagtcaccttccaccagggattaaggtgggacccctttgcctgcagctctgtgggtgggaccccttcctatctcagcatattcactccctgggttcctgctgccatcacaccacccaccacacgagccccttctggaccagtggcccttatctgactcaagccatatcttgccaagcctgttgtgacaccgatcttggcraactcacttttcatgtcagggcccctgcaaaacagacacatatctgagtcatggtattcgtttaagcaatgaaaagggtagaatcatttcttacatcagaaacattgatcctcagtgagtcagatggagtagcctatttttctcattagagggaatcctaactttgaactccacagagagagccccaggaactgtgacttgaaccctagagctctacttaacttttccaaattgctgtacttgaaaatgttgaggtctgcctgggtcaatttagagaagacactatgaggacaaagacagcaatggaagaaagaaatgaattcttcatgtcagagcagtggcggagaaacaggaccaaagagcagaagatgtctggcaatgtgtctggcatataatagttctctcagccaggtgtgttggctccccctgtaatcccagcgctttgggaggccgaggcgggagcatcacctgaggtcgggagttcaagacgagcctgaccaacatggagaaaccccatctctactaaaaatgtaggatgtagttcggcactgtaatgtttagagggtggtgaaaggatttcttataccacatcttgtatgttatctgggagtaaatgctgcagccacaagcgccaccagcaagtcttctcagggtgaacgggaaaaggggatgggacctgctgagctaaatcacggtaaacgcagacagcaaacaaactttccgtcaaagagctggatgaaacctgggccggatggcaaggagacaacaccccaggcaggcrttccagatctttgaccttgcccctcctcgagaggagatgattgcttcatccctcctctcactgcacattgtgctgccagccctgctgtgtagtgtgggggctcaagactaaggcagtgcaccatttctgtggagagagatggatcagggagcgggggcttggatgagacccatgattcacctctcttgagtccttaccagactaagacgtcctcaagggccagagaccagcctgccactcaccattttgccaccagacacagatgagaacaattcccattaaaastaacaggatgaatgcccccaggatgatccatctatctggtagactagaagaagaccagtggatatctgaagcatttactggtgacactaaaaaaaaaaaaaaaaaaagaaraaaaagcacaagccctgtcacataaaaaaaaaaagcataaaaatatgctttccttagcccctgctttccccaggaacacatggtgccccacataatcactggctcatgtgacagccactctaccaggccctgggccatgaagatgaataggggttgtgccttgtccttatggagctcagatttctactgagagaggtagcaaatatccatctgattaccacacagtttcacgattactgtggttagaactgtttggaggatgacacaatgggtggtgcttaattctgtgtggggaaggtggggaaggcttcctaagaagtggcattagagctggtggaagggtaattataatagaggaagagaaggcctggatgtttgcaatgacacagatagacttgggaccatttagcagtgggtcattgtgactggatcattggttaatgggaaggggtttctacactgaggaagaaacagtgggaggtgggatgggaaagggaggatggtgggaaatccttatrgccatcactgactctccagacaggaagcccacggagaagtcaatcaaattttctatcgcacacacacactgacacccacacagggaaggcttttgacctttaaagggagctgccacattctcccacccagctcagttacctgtcggttctggcattgcctcccagtgccctaagaattccctgagccagtgatcgcagtctccctttgagagcttcctgaaatacttttccagccctctgtctttcttccatgtctccttgatcttactggcttcatgattaattactgtccaggtcatgttcattgcgtcaaagaggagggatttctctccattgrtggygaactgccaggatgcaccagtgcaccgttctgcttcaygttgacaaaacatctcgacttgcagagtggaaggatctgcaatccaaacacaaagccatcatcctccactctttgagargtccatcatcctccaataggtcaagtgtttctctgcacatttaggggtctgtattctttctgcccagacttgccctttcctgcccattgggtcccatgtgcctctatggttgggccaatgatcaatacacagatatacctaaagcccctccccatctgtgttcttccctcccctctcttactgcctgcctcygtttscccaccccattccacacttaccactggtctttatctggggtttgatgtcacaaaggagcatcctgaggtctygccccacttctcccagcgtttgggtcaaytctccccaagtgctggtggcatwtaccttcttccccaggaggcccagaggtttgaccatgttgttgtcactgttgtactgaaggaaaagatttttattcaagaagacctgcgcttcacaccagggctgtccaggtctggacaatgattttatagtgaagttgaagcaaagagagtgaccacctgtgagacaaagatgcaggtgaggtccaggacaggggaagaggcccattagaacctgcgcttctgtgacccaagactccctggactgggccaggctagcagaggcggggcagctccatcccagactccctcaaccttctggatccctgttcccatctctccctgactgtctgggatgagatacttgatggtaccagggacccctggggtgcacttagtgttaatggtgttaacaggaggattcatgtcacaagtacttttagcaacatctaccaagttctgaggcacaaaacagacaagccagtgtatgacctcctgagacttaaactctagctgaacacacatgacattcaatagaaaggaaaaagaggcatttatcacaggacacacgctgaattcctgyggggtcccagatgttcaggaaagtgacctggagtagaaggyggggggtagcattgtagaactgccctctgtgagccagtgccttgcctagggcctcaggctgtggtctcccatgaactgggtgtaacatcccagggatcctctycctcacgtcatccttaagagcaggcacccacttgtctgaagcctgcatgaagccccattcgcctaccccctacctttctcyctcctccttgtcctcagccagttcttgtgctcaggacactcaccaaccatgatctccaaggctattagtagcaacagcagaaacaaaagaaggygcacagggctagaagtcagggatattcttcrcatactgtggagagtaacaggcaggaagctgggcgtgtacacattcaccctcactggtatggtgaagaaatgttatccaacagcrtgggtgtgggcactgcccaaattctttaccytggaacaactgaggtcaggcctgtagagacccaattaaagaacaattttgtgamgagagtgttttccaagtattcagaatataatcatttattgaaaaataaaagaagacatttaaaaacaaaattaactttgaataaactctctctcctctcctgtccctgctgcccctgcaaaaaaamccccctctggtgtgagcaggatggttggaggttatgtgagctccttctcctttcctccagtttcctcttcccttctcctccctgcctcttttgcttttccctttcttcctggtaccccctgcccattcctgtattttctcccatcgccattctcccctctcccactgtccctaacccgttcaaactctttcctcttaaatggttgagattttctctcaccaagcacaccccagtattaattaaactagctgcaaacaggcagcaastggtctaccatgacagatgggttttgtgtgtgtgtgtgtgtgtgtaattgtaataaaacatattgagtcactcaataaacacagagtgtctactacatgtatcaggcactatcatagatgctaattaacgaaactgaaatggccaggccctcacagtggctcatgcctataatcccagcactttgggaggatgaggcaggaggatcacttgaggccgggagttcaagaccagcctgggcaacatagtaagactccatctctacaaaaaaaaawttttttttattatactttaagttttgggttacatgtgcagaacgtgtagttttgttacataggtatatacgtgccctggtagtttgctgcacccatcaacccatcacctacattaggtatttctcctaatgttacccctctcctagccccccaccccgtgacaggccctggtgtgtgatgttcccctccctgtgtccatgtgttctcattggtcaactctcacctatgagtgagaacatgtggtatttggttttctgatcttgtgatagcttgctgagaatgttggtttccagctttatccacgtccctgcaaagggcataaactcatccctttttatggctgcatagtgttccatggtgtatacgtgccacattttcttaatctatcattgatggacaagttttgctattgtgaatagtgccacaataaacatacgtgtgcrtgtgtctttatagcagcatgatttataatcctttgggtatatacccagtaatgggatcactgagtcaaatggtatttctcgttctagatccgtaaggaattgccacactgtcttccacaatgtttgaactaatctacactcccaccaacagtgtaaaagygtttctatttttccacaacctctccarcawctgttatttcctgactttttaatgaacgtcattctaactggcgtgagatggtatctcattgtggttttgatttgcatttctctaacgaccagtgatgatgagcattttttcatatgtctgttggctgcataaatatcttctttggagaagggtctgttcatatactttgcccattttttgatggggttgttttttttctagtaaatttgtttaagttctttgtagattctggatattagccccttgtcagatggatagattgcaaaaatcttctcccattctgtaggtggcctgttcactctgatgatagtttcttttgctgtgcagaagctctttagtttaattagatcccatttgccaattttggcttttgttgccagtgcttttggtgttttagaaaggaagtctttgcccatgcctatatcccgaatggtattgcccgggttttcttctaggatttttatggtcctatgtcttatgtttaagtctttgatccatcttgagttgatttttgtataaggtgtaaggaaggggtccagtttcagttttctgcatatggctagccagttttcccaacaccatttattaaacaggggatcttttccccattgcttgtgtgtgtcaggtttgtcaaagatcagatggttgtagctgtgtggtgttatttctgaggcctccattctgttccattggtctatatatttggtaccagcaccatgctattttggttactgtagacttgtagtatagcttgaagtcaggtagcacggtgcctccagctttgctcttcttgcccaggattgtcttggatatgcagcctcctttttggttccatatgaagtttaaagtagttttttccagttctgtgaagaaagtcagtggtagcttaatggggatagcattgaatctataaattactttgggcagtatggccattttcacgatattagtgcttcctatccatgagcatggaatgtttttccatttgtttatgtcctctcttatttccttgagcagtggtttgtagatctccttgaagaggtcctttacatcccttgtaagttgtattcctaggtattttattctctttgtagcaattktgaatggkacttcactcatgatttggctgtctgtttgtctgttattgttgcataggaatgcttgtgatttttgcacattgattttgtatcctgagactttgctgaagttgcttgtcagcttaaggagattttgggctgagatgatggagttttctaaatatacaatcatgtcatctgcaaayagagacaatttgacttcctctyctcttgtttgaatgtactttattgctttctcttgcctgattgccctggccagaagttccaatactatgttgaataggagtggtgagagagggcatccttgtcttgtgctgattttcaaagggaacgcttccagtttttgcccattcagtatgatattggctgtgggtttgtcataaatagctctcattattttcggatatgttccatcaatacctagtttattgagagtttttagcatgaagtggtgttgaattttatcaaagttcttttctgcatctattgagataatcatgtggtttttgtcatcggttctgtttatgtgatggattacgtttattgacttgtgtatgttgaaccagccttgcatcccaggtatgaagccaacttgatcgtggtggataagctttttgatgtaatgctgggttcggtttgccaggatttttgcatcaatgttcattagggatattggcctgaaattttatttttttrttgtgtctctgccaggttttggtatcaggatgatgctggcctcataaaatgagttagggaggattccctctttttctattgtttggaatagtttcagaactcctcttcttgaggagtatctttgtgatgttctctgtatttcctgaatttgaatgttggcctgccttgctaggttggggaagttttcctggataataacctgaagagtgttttccaacttggttctattctcactgtcactttcaggtacaccaatcaaatgtagatttggtcttttcacatagtaccacatttcttggaggctttgttcattcctttttattcttttttctctaatcttgtcttctctctttatttcattaagttgatcttcaatcactgatatcctttcttccgcttgattgatttggctattgatacttgagtattcttcacaaagttctcatgctgttttttagctccatcaggtcatttatgttcctctctacattggttattctaattagcaattcgactaaccttttttcaaggttcttatcttcctagcatttgttagaacatgctcctttagcttggagttgtttgttattattcaccttctgaaggctacttctgttagttcgtgaaactcattttctgtccagttttgttccattgctggcgaggagttgtgatcatttggaggaggagaggcgttcttgtttttggaattttcaggctttgcgcactggttttttcctatctttgtggatttatccacctttggtctttaatgttggtgaccttcagatggggtctttgaggggacgtgctaatcctttctgtttgtttcttttccttctaaccatcaggcccctctgctgccagtctgctggagtttgccggtggtccactcccaaccctgtttacctgggtatcaccagcggaggctgcagagcagctaagattgctgcctgttccttcctctggaagctttgacccagtggggcacctgccagatgccagccagagctctcctgtatgaggtgtctgtcggcccctactgggaggtgtctcccagtcagtatacgtgggtgtcaggcacccacttgaggaggcagtctgacccttagcagagctcgaatgctgtgctgggaggtctgctgccctcttcagagccatcaggcggggacatttaagtctgctataagcccctgattggggctgctgccytgtttaccaacatgccctgaccagagaggagaaatctggcagtctggccatagcagccttgctgagctgcagtgggctccgcccagttccaacttcccagcagttttgtttacactgtgaccttaaaaccatttcctcaagcctcagcaacggcagaggtccttccagatgagttttrtaatagactccagcagtcctactggggccaagacctcaaggaaagccaagtctatcattgggaaaagtcttagggctctaagttttgaattctgaaaatttttcttagaacaaaattttgtgtcattttcaaataaagcacaagttttcctcataaaacttagtatctgtagacccccttcccacctcacttttacagctgtcccatttgatcatcagaccctgctaccttagccagttcaggctgctacaacagaatagacaaggtggctgaaacaccaagcatttatttcttaccttcctggaagatgggaagtccaagatcaaggtgtcagcaggtccggtatctggcgagggccctctcttcctcaccagatggctgtcttcctgttgtatcctcacacagtggagagcagagacagacagcaagctctcctatcacttcttaatcccacatggctccactcacatgagttatgacttcctaaatagcatcaccttgagaattaggatttctgcatatgaatttggaaggcaggcaaacatgcggcctgtaacaccacccatatccgttccacatctaggttccctctgtgtgccgggcagtatgccagttaattcaagtgcatgtcagacccagagggtgacatcctgtgactcagatgctagggcccttatgatgcctggtaaggtaagtgggtctttaccactgtcctttcttaactagatggaacagacttcaaagaaagtaaccatggactatcggcagggctctatctctggggctgggggataaggggttgtctgctcagaggacagtgggtcaagcgtttgaaggagccgaggaatgcacattttttacatgtcccctatgtggttctctgtctgctaaggttaaagaacctcaattttgagggtgcacttccacctcttggtctggagaaggggtctcaaatctgtcctgagtggagcctgttctgtacacatccaggccctgagagtacacagagaggaactcactgctaccgccctgccaatactgctgctgtggggacaccagcgggggtgggccaagaacagagtgtatgtgtgtgtttgtgtgtgtgtgtgtgtgtgtgcatgggtgyttgtgtgtgtgtgcgtgcatatgtgtgatatgaccactgagtagctccttagcagggccaatattttctacaagtctgatgactcacaggaaggagcacaccaggcctatacttgggtcctgacatctgggatgccaacctaacactgaagaaaaagaaagagctgcagacaggctgggaaaaatatacagaaaggggaaaggggcccttccacctttgttgccctctgtggtcctgaatctcagcttggcctgagccaacctgaagatgggaaggaatagccattttccaactgcaaaatgtcagcttcaggcaatggtttcaaaactgaagtaatggttacatatgaagtagatttttgtttgttttgttttttgagaccaggtcttgctctgtcatccaggtggagtgcagtggcatgagcacggctcactgcagccttgaactcccaggctcaatcagtccttccacttcagcctccagaatagctggcactacaggcatgagccaccacacccagctaatttttaaatttttggtgtggagatggggtctcatcacgttgcccaggctgatctcgaactcctgggctcaaacaatcctcccccctcagcctcccaaagtgttgggattacaggagtgagccaccacacccggctgaaatggaattttaattgaagtaagaagcgggtgataaggaaagtgaaaccaataatttcacatagtccctggaagcccgttgctataaagaactttcagcctgaagtccaaagagagacgaaaattttaaaatgaattggactgcagttttcaatccctgaaaatgagtcacagcctttttgtggcagtgtgccctgggcttctaaccgtcctctccctgccccagctgccttgaggtcccggccaatggtttcaacactcaggctaggaatgccaaggccmggcagagcgaggctgtggaagccttggcataagcggaagggaggatctgagggagaatgggacaagagaagtcggaaagaaggagttagggcaggagaacaaggagaaatccctgtcccccaaattggagagargggcgattgggactccagactggaaggaggcacggatccctgagtgcttggtgtggaggcagaggacccgcagagccaccccgtcctccctgccttatccagcgtccccgccgccacacccccagcatctcccccaaccccacttttacttcattatctgcccctggttctctcaccactcgagcccctgctttcctccttcactcccaaacatgcacacgttccctctgcackggtgtttggaacaccagccatcccccaccccctaccttgtgccagcaggagatgtttgtccttctgcygtctctaggatggagaggcctgaggtgactgcttcctcagagtctctgtgcaaactctctgaggagcagaaaccagttcagtctctctgggygtggagaggccggcctagcagaacacccgtccaccatgcaaaccvggtggggccacctgtcaactgtcacgtgtgagtgattctaggacagggtaactcrtccagaattggatccaattcagtactggattcaccatcagtagaaggaccaagaccagactcaagtcccagccacgaaattctagaaaggatttaatgtaattttagcagttgttggagaccagcatgtgatggcatacatatgttttccttgatatgtaggtgggggcccccaccttttttcagggtttaggcttctgcaggtcctggcatagctgtgacagcggccctacctcatttctggtgrgtgctggctccctctattgcttggtttctgtgcaaacactgcattatcgtcctgccctcttgagacctggagctcctgccccctgagctcgtgttcgcactgtgtgtcactgaacctcgctgttttcttcttgcaactccattcccctctgcaactggaagaccagcacttctcctgagtcttccttaaaagacaccctgcccacttccttacaaagcccccaccaaagtgacaccagctacttgtgaatgtagccaactttactgaagatttagaggttatgttataaggctgtgaataattwwaaaaaaaaatcacctatttgctcgacctctttcttatctcttctttggactagaaataaaatatctatgatttgaccacactgtcatctagtactcgaccctggttctaggccaccgtcctcctggccagggtgattgcagtgctgccctacttggttctccgtgcctgtccccacctcccaaatggctacagcgcagccagagtgatcttcagaacctcatcactcacgcccccctctgctccaattctccaaaagtgccctttttctctcagtaaaaccaaagtcactacagatgcctagagagccctgcacagtctggccagctgtccattatgccccctcactcgctcagttccgacctccaccctcggcctccttgctggtcttcagagccctgcagatgtccccgtgccttgggactttgcattgccctcccttcagcatggactgcccttcaggcatctgcccggctcactcccactcctgctcccaggtggcacacccttccacgcctggttctccctgcccctcgcatttggaayccttgtatttctttctttctttctttttttaaaattgtggtatgattcatgtaacgtgatttttcatcttaaccactgttaaatgtaaaggcctctatttcataatgggagacctctgcctgcccaggccatcctggaccttcttcacctgaacttgttcccctaaagcaatgaccactttaaaacataccttagtaarccgcgcacagtggcttacacctgtaatcccagcattttgggaggtcagggaggctggatcacctgaggttgagtttgagaccagcctggccaacatgttgaaaccctgtctctactaaaaataagagaattagcygggtgtggtggccagtgcctgtaatcccatctactcagcttattgagtcaggagaatcacttgaagccaggaggcggaggttgcagtgagccgagatcacgccactgctttgcagcctgggcaacagaatgagactctatccctataaacaaacaatcaaacaaaccttattaacttttaattgtggttgcaacaaattactgcaaatttagtgccttaaaacaacatacattcattcttttaccattctggagctcagaagtctgaatagtctcacggagctatcatcactgtgctgtcagggctgtgttcctttgggaggctctcggggagaacctgtctcctccttgccttttccagctgctcaactgcccacgtccatggctcaggaccccatttcctcatcttcaaaggcagctccaccaggctgagtcctggtttacatgagaacactacccctccatggctggttttcccagggcagctgattagccacctcagctccatccacagctttcaccgccctttccatgtaccccaacacagaggttccagggactggatctgccatcctgaggattggagagggaattcttctgcccaacacacataccatataatttacatatctatccatttaaaatttctatctcttactagaatgccatttctgtgaagacaaaaacctcatacaaggcacagaaaacagctccccaggggtgaaggggctcagatgggccccctggctcagggaacaaggagaggtgtcagggcagcctccctgggtctccagccttcacagccggtgcctcccaggcaggttccagccacagcagcagcaaaagagatgtggtgggcagcatcaggcattggcgagattcctgacacagttcagtcgaaaagaaacttcctaaactgagctcacctcaaggaagctggagataaatgccaccttacccaatgggtacatgaaatacaaatacaaatccttttccaggttgtgcaggttacaactggcccaattctatgcctggtcccctgccctgtcctgctgtgacttgccagggtggggtgctcattggcctccaggctccactcacttttctgaccgcacccagtttccacctccaagtcaccccccagactgcttctccttttrctgttttttctcagcccagcagaaattctaatattcgccaggcttggccctgctcagggcaccggagaaggagcctctgaggaaaatcttggcacaaggagcagctctcccacctggatttccagcaccctctgttttctgggaactcctgaatttctctggccattggcacaggggctctgccacgcagttcccctggcggctggcccctgacatctggcaaagagttaggaatgcaggtgtttctggcaaatatgtagggccyatgagataagaaagtgggggaagcaagatcacgtaggttctctgtgagagaggccgcatgcccagcaggacagaacatccctggctgacaagggccatcttcccctgtccttatctctgcctgggmtccagctccgtcctgcctgacagaggccgtggagcagagcactgggctgctggtcaatgtcctggtctttagatagaccagtctccggatggggtcacagtgggagagcagtgggcctgggaggtgcagggttagtgcagggcagggctgccttgaatctgcaggtgcggggccaccaggctggacctatctgtatgctcagcacaggaggttgcagtattgcctgccctcaacctccttttcctatttctgctgctagagggcactggggactggggtcaggctgggggtcttgccatcccctcctgatctcctccactccctgtccacagctcctgatttccctgcctgggctgcccccaccagaagtctccaggcctaaaatccagtaggaacaggcagcctagcctgtccccaggggtttctttagcacttgcaggagtcaataaggcttcaggtaggaaggcctgatgccttcctcatccacagacgcctaacaggtgtttctggaaatgtatcctgtggcagccaaagaggctggactcctcagtgtgtttccaaacagagccaaacacagagttcatcggttggaggagcccaatcagctgctcattagtgtgcctttgacaagcctttgtacggcggggaggaaaaatgattttcatgaaaaaaamaaacaaacaggagtttattatctatctatctatctatctatctatctatctatctatctatctatctatctatctatctatcgtctcttgtatatacacaggaaacacctggagaaaacaagtaatccttaaagtgctggcttagagctccagcatcttcaacagaaaacaataaacgtctagagaagtggcagatcatgggaaggccaatctatggcatcagagaagcttgtgrtgcctctgctgctgtccctaggcctgacaagagtctgaaattgtctttggtgatcaacctttgtcctttctggtagagaagggaggatrcaatcaaaagtggctcaataataactggaaaataaatggaaaagaaagatgttcatttcatccaggttcttgaattcattgacatacggttgtacatagtattcccttataatcctttttgtttctgtaaagttggtagggatgtttcttctttcattcctggtattagtcatttgagttttatccctccaccatttacctagtcattctaggttaaggtttgacaatttggttgatcttttcaaagaaccaacttttggttttattgagtttgccaatgtttttctattctttatttcatttatttacactccaatttttatttccttccatttgttatttggggcttaggtcgctttgctctttgagtttcttaaagtgaaatatcaagttattaatttgacataatcctttctttgtcctgttctttctcagtatactggcatttacagcagtaagttttcctttaagtgctgctttatctgcttcttataaatcatagtatgctgtgtatttgtttccattcatctcaaagtattttctaattttccttgtgagtttccctttcgttgattggttcttagaatgtttataaaattgtttgtcttaaagatgattctgcctgatattattaatagcaatttcagttgtctttgtttactatggatgtgttttatcttttccatatgtctacttttaaactacttgtatcttgggatctacattgtatctttagatcattttttaaatgcattctgagaatctttgctttttcttttgaatgtttatcactttgacatgtaagggaattactgctaaggtggaacagaatttacgtctgccacctttttcttagttttccatatgcactatgtcattttcttcatcttttccaccactattgctttgttttgtgttaaacagatattttctactgcatcattttacttcctttattgtctctttttcattttttatttaaaaaagttattttgttagtcatttcaggggattccaattaatatcttaatttaccacaacctagatcatattaaaaccaacttaattttaacaggatgcaaaatctctgctccaatattgctctgcttcttcccccatctttgtggtataaaaatgatatatacataaattatatggcatgtgttttgcaaagaataatcacctgccacccccacccactcccgccaatcccagaggatgccggtgtgaatccctggaaccccccactgggttatatggaaaagggagtgaaggctacagatggagttgaggttgctcatcatctgccccggaaacggggtgattttctggatttccctggggttccaatgtaatcacaggatctttatagaggaagaggcagacggaagagggagaaccagatgaggggcacagtgaggacttaatctgatggaactgcctttgaagatggggaaatgggccctgagccatggatgtgggcagttggagaagctggaaaaggggagaaggagacaggttctccccgagagtctcctgaaataacagccctgacaacacagtgatgttagcccattgagatccattccaacttcagatctctagaatggtaagagaacaaatttgtgttattttaagccactaaatttgtaatttcttacaatagcaatcaaaagctaacactgtctgttttaaagtggtcattgctttaggaggaaaaagttcaggttaagaaggttcaggattgcctgagcaggcacagatactgccattttaaatagatgcctgtacatttgaaaacggttgaaatggctcctggctgtggcagggcagcaggctggggccatggcaggccaagtgcaggcccaaatcagactgcaggagcttchcatacactctgggcaggcacctgcctctcagtagctcactgagagatgagggcacccagcaggggtccccaagggaaggcacaaagagggagccagcctgagattaaggggctgtgaaaacaatgcttttccagaagtcctagctggttaccttcacagctgcttgcaaaacagagaaattctacatycactcacagcagccatgtccacagggtgctccagacggccaggaagttaaagtcacgccacctggctgtggagatcaatgaggctgaagtgcaacaggagcagcaggaatccctcctgggagatctccaggatgacattcccccaggtgacagcctaccaggcccgtggaaagccctggctagtaacctcacagctgcagtgtggcaaatcaaacagagctggagttgtctggtagatccttggagcaggtgctgctgccccacatggacaccttcctgyaagtgcatttcggccccatctgaaagagcttaaaggaaagcttgcatggcttttccccggacataacaaatctgtttcttgatgtggaggccaacaccaggccatcacgatggtccaggatagtgctgtggccagggctgactgccaggagcttggtggtaaatttgaagccaagatccaggaaaatgctcagagagtgggccagctgtgaaaggatgtggaggactgacggcatgctcggtgctcttccctgtacactccctctctgaggtccaggctgatgtggacaccaaattgaagaggccaaacccaggaggccccaaggactaatggcagctgcgtgttgatgacggcaggggctggggcaaggcctgaactggagagcctgcaggccaggctggccaactgcagaggaacctctgggtgctgcacatggactcagcctgcagggaggaggaattgcaaaacacccctcagggatatgagggctaccctgacccggcacgtggatgagatgaaggagctgtgctccgaattggacgagaccttccatcagatcagcaaaatggagccagagatggaggtgaaccacagggcgctctgtgagctgtgtgtggtcctgatgaagcctttaattatggaggcaaacaaggtggaggtggagtagcagctcctggagctcagcctcaccctgcagcacctgtggggcgaccacactgacctcatcaagtatgtcaaggaggcagctgccacaagctctactttcacttggaggccgtccgggagtgccacggggacaccacgcaccctgaaggagacccaggggagcctggatggcggcgccagctgcacagctcctaggctgccctgatggaggcctgctggcctccctctctggggaggaggtgatggaggagaggtcaaaggaggcgcacggccagcttcccctgcccgtgagcagatctgcctggccctgaaggagcaggtgctcggttgggactcgctggctacccgggtggcagccctggagcaggccacgagtgggccgtggcttggagcccccatggccggcagagcacttggagctggcgaccacttgggcccagaagaagctgtgtgaagccctggctgggctggctcaggagctccagctcctgagatctgacttcagtggctcgggtggtgctgcaaggctgcccagccacctctctcacctgcctcggggcctccatggtccgcctccgagtgcagcttggactgcaccagctgctcctccttggaaacttccaagagctggtgacagcagtgtcagcctaaatctggggaagctggaaaccgtgcccagcaggaaaaggaagcagaagcagaaaggcccagaagttccccggaagagggacaggaaagaagctgagcctttgccagacacacacatcaaagggccagtgccagatgccttgaacactgagctctggcaggcaggctyccctgtggccttctatgccagtttctcagaaaggacagctgccctgcagacatggaagttcaacactagctacatcgacactgacagcagcaacttccctgaacatggctactaccaagccggagtttrgtgtcycatttgcagtgagcattgaatttggcccagggccaggaaccaggcacctggtgtttggagggctccatcagggaccctgggcgggaagcacagcagccacctttgccatggctgagctgcgaaagggtgagagagtgtggttggagttaacccaggcattggtaacaaacagaaaccagcgaggcactgcatttgggggcttcctgatgttcaagacatgaaccctgggcccagctctgattggacatcatggacttgcccagctctccttggtctagggctctggccaaggatggtctgcagatcatcctgttggtctatctcttccctggacagcttctgcgagagagtgtggtgtacgtggtctctgtctagcgcactgggtttggctatttctcaatgacaagggggactggactacttctctgggtgggacctggttctgagcttggtatgccttctcagacagcacaggctggactccagccctttgccatactgtgtattctacagctgctttggtggcgtgctcctcttgtggatggaagcttctgtgcagcactttaactctttctcctgcttcctattctcttctccctaattgttggctacaaagtcatctttcccagaaggagtctctaagatggaggtgacatttggacagtattggaaagcagtctccaacsactagaggacagtggaataaagccaacctgtttggtctctgtcagccagaaatggagaagaaaacctggttgagtcaacaagagaaagaaaattagtatctttcgtttcagttattccttgtatttatctgtaattttaatttcatatctttctctccttgccatacacagagcaaaggcccaaacatgccaaatgtgaaccaaaatgtatatggccttcaccatttttacttcctccagtatctttgggccatctgaattcttgctagcatgtctaaccaggaggcagctgaggaaggagtgaaggaggactgtaaaaatacctctcaataatgatcaaccttggggtaaagcgatgcccatagatagagagatagataaacagatatagatatatatgtggttaagatggaacattttgtgttacatcaattatatcaaaatttaaaaattaaacaaagaaaataataaataaaaggattccaaagtgggagggtggtggcagcaggtgtggaagggtgtatcacttaggaacaggtgtggaagtgagctgggtagacttctgagggaagaacagtccaggcccaggggagggtgatgcaaaggccctgaggcaggggaacaggccctgagaaccagcaaggatgccagggataggagatgaacgagcaaggacagagtcagggacagctgtgcagggctccctaggcctctgcagtggctttggttttactgagaggaaaagggtgcgtttggagggtggtatggtttggctgtgtccccacttaaatctcatcttcaattgtagctcccaagattctcacatgttgtgggagggacccagtgagagataattgaatcatgggggcagtttccctgatactgttctcatggtagtgaataagtctcatgagatctgatggttttataaggggaaacccctttcacttgattttcattctgtcttgcctgctgccatgtgggatgtgccttttgccttccatgatgattgtgaagcctccccagtcatgtggaactatgagtccattaaacctctttttctttataaattatccagtctcaggtatttctttatcagcagcatgaaaactaactaatacaataaattggtattgggagtggggcagtgctgtaaagatccctgaaaatgtggaaacgactttggaactgggtaacaggcagaggttggaacagtttggagggctcagaagaagacagaacaatgtgggaaagtttgaaactccctcgagacttgtcgaatggctttgatcaaaatgctgataatgatatggacaatgaagtccaggctgaggtggtctctaatggagatgaggaacttgttgggaattggagtaaaggtgattcttgctatgttttagcaaagagactagtggcagtttgcccctgccctagcgatttgtggaactttgaacttgagggagatgatttagggtatctagcagaagaaatttctaagcagcaaagcattcaagaggtgacttgggtgctgttaaaggcattcagtttcaaaaggaaaatgcacataaaagttcaaaaaatctggtgatgggataggaaagaaaaacccattttctggggagaaattcaagctggctgcataaatttgcataagtaacaaggatccaaatgttaatcgccaaaacaatggggaaaatgtctccagggcatgtcagagacatttgtaacagcccctcccatcacaggcccagaggcctaggaggaaaaaatggcctggctcacgaaaccacagaatgatttcctgggccaggcccagggtccccctgctgtgtgcagcctagggacttggtaccctatgtcccagctgctctacccattgctagaaagggccaaggtacggcttgggttgttgcttcagaaggtgcaagccccaagctttgaccgcttccatgtggtgttgagcctacaggtgcacagaagtcaagaattgaggtttgggaacctcttcctagatttcagaggatgaatagaaaggcctggatgtccaggcagaagtttgccacaggagcaacaccctcatgaagaacctctgccagggcagtgtggaagggaaatatggggttggagccctcacacaaagtccccactgggacactgcctagtggagctgtgagaagagggtcactgtccttcagattctggaatggtagatccactgacagcttgcactgtgtgcctggaaaagccagagacactcaatgtcagtccttgaaagcagccaggagaggggctgaaccttgcaaagccacaggggcagagctgccgaagaccatgggagctcacctcttgcatcagcatgtcctggatgtgggacatggagtcaaaggagatcattttggaactttaggatttgactgccccactgggttttggacttgcatggggcctgtagtccccttgtttggccaatttctcccatttgcaacagctgtaattacccaatgtctgtacctccattgtatctaggaagtaactaacttgcttttgactttacaggctcataggcagaagggacttgccttgtctcagatgagactttggactatggaattttgagttaatgctaaaatgagttaagactttgggggactgttgggaaggtaggattggttttgaaatgtgaggacatgagatttgcgagggtccaagggcagaatgatattttggctctgtgtccccgcccactatgatctggatggggtaaggaggtgaaagcattgataagccaaagtgacagcctcttttgtagacatgatcctgcctaaatttctcatgccccacagaagagggcactgaactccccacttctccagagcttcatgcagtccttgaagcactctctggctgtctctgcaagtggctgaacagctcctcctggtctctatggggctgcagaggctccaggtccctatggctcaggggctgtcacrctcaccaggtcccaccaagggtgccccccaccgtgggtggtggaggagaccaggtgtagctgctcttgcccctacccctctcctgacctgccaatcttaataggaggaagcagtagggatgagtggagccatggaggttgttcccacctcctaggaccacttttcctttcctctttcttggtctgtttctggaaatctatcaaaactacctccaatgccagccctgagaccctcccctcccccaccctggggcatcacctcctcttctgmcacagcgggagggtggggtgtgctgtcatcttgcttccctcagcagctgtgtgagctccctgaggacaggggacaccccctctccctaccccaaaacctgtcccaggggctaccccatagcgagggggaggggacaaaacctctgccttccaggatgacctggctcggcaggagmtgaggaggcgtctcctcagatttggggcctggacaagggctgtcactcctgtgtttccctttcggcaccacccaccgtggccccaggcacagctcaacctaaagccatggccaccaccctcagctcctgaagcctcatcatcgtcctcctcttcttcattctacttggcatctgaggagagttccatgcagagggagaggaaactggtacaggcttcctgaaggacagggtaacagggctcaccaagagtcaaaaatatccacatctgaatgaagaatatgtattcatatgcgtttcaaatggcggcaaagactccctggaaagatgagaagaatccaatcaaatttcgtcccgggctgtggccaatgagagtggatgcaggcaggggccggggagcctttcacacatgacttttcatggtttcgatcctgaaacaggtgaaaatatggaggtgaaggagtaaggaagagtggggccgggagccccggggacggtcaccaagtatgctcgccagatctgttgtgggccatgagggtccggaaacgtggaacccgggcaggggcgcgcggggctgctgcagtgacgaggcactggttctagatatttacccaactgtgttgtcataaggatgatattacaggtgattgctgatttcaaccacagatgactttcggggaaagttggctcctgagggtttcagtttccacctagccgcgtgctctccgggttctgcgtgctcctcccagggcgcccgctgtgccccagttctggacctgggtcctacccagtggaaaccaacgagtgggtgccccgccgcccaccgcaagagttctttatatattcaggataccagtcccttaccagatacatcattttcaaatattttctctcattctgcaagttttttttctttctaaatggaatcctttttgaagcacaaaagttttatatttgcatgaaatgaaattaaactaccttttattttgccatctgtgctattggcatacagtacttaagaagcctttgccaaatccagggtcacaaaaatttactgctctattttcttctgagactttcatagtttcatgtcttatgtggacatctgccattcatctagagctagtttttgtgtgtgctgtaaggaaggggcccgcctcattcttctgcatgcagcatccagttgtcccagcaccattcactgtagtgtasaatgcacctgcccaacctcctgtccctccctcctgcactcagcatcagaagtgcgtcctgctgaatggttctcccagggtttccaccaatgaattcccctcatgtgaatcccatataggcatctgcttctcagaggacctggaccgaggagtggattcactggaggaaattatatttcataagatagaacattctgagaatagtaacacttggcatacmccttactacatcaaaagtaagaaattggcctggcacggtggctcatgcctgtaattccagcactttgggaggctgaggcggcagatcacgaggtcagtagatcaagaccatcctggctaacacggtgaaaccccttctctactaaaaatacaaaaaattagccgggtgtggtggcacgtgcctgtagtcctagctactgggaaggctgaggcaggagaattgcttgaatccgggaggcagagattgcactgagctgagatcgtgccactgcactccagcctgggtgacagagtgagactctgtctcaaaaaaaaaaaaaaaaaaggtaagaaattgcatgatttggtcatttgggttccacaattcttatgtcaacatagcttatcaatgtttatttattttttcttatttctgttgttgttgttgttttctttgagacaggctctcactctgcacccagtctggagtgcagtggcaccacctcaactgcctgcaacctcagactcccaggctcaagtgatcctcccaccttagcctcctgaggggctgggactacaggcacatgctactacacttggtcaattttcaaaattttctgaagagacagggtctcaccatgttgccatggcttatctccaactctgaaaataacaagttacttttcacatggttgtatgacattatgtagacttttaaaattctgtataaataatttagacaatactgtattagaaaatgttttctacagccacagcttcctaaaaatagaagtggtattaaaatgtgcatttgtcaaatcttgaagaagtttcaaatgtttagggtgattctgacctctcattttggttgacacaataatccataaaaacaagtaaagtgcccactctgatctggaaggggtaaggaggtgaaagcattgataagccaaagtgacagmctcttttgtagacatgatcctgcctaaatttctcatgcccyacaaaagagggccctgaactccccgcttctccagagcttcatgcagtccttgaagcactctctggctgtctctgcaagtggctgaacagctcctcctggtctctatggggctgcagaggctccaggtccccatggctcaggggctgtcatgctcaccaggtcccaccaagggtgctccccaccgtgggtggtggaggagaccagatgtagctgctcctgcccctacccctctccttaccggccaatcttaacaggaggaatgagtagggatgagtggagccatggaggttggtgctggaaagaacagaaatgaagacctttgtccaattctcccaagttatggagatccttttctgagttctagtagccctggggtagtctgatgattggattcctcccacgtgtcttaaaccctatcatatggcagccactgtgctaggtgctgggtttacaggtggtgactgatgtgtccagtcctccaggaacttagagtccagggacagaaacaaacacccacatggctgctactgctgatgtgatgtccttgtggtggttggggctatcagaggacagaagagggggtgactcattctgcctggggatttgcatggaggcttcttgggaggtggcatttcagactgttcttgtaggaataggaagaatacagcgtggccaggtgggaggagaagatagggcacccagcagagggacaagcatgaagaggaggcctgggggtgcaaatatcatagaactttggggagctctgagaagtctgtagtaatgaaccctcagttactagggtagactctttccacagggaggaggaaatgtcaggagggaagacagggaaggaggggagggcaggaaccaccctggagtcccttctctctccacagcaaatcaaccaggaaatcaattcaccattcatacatgcatgttatcacacacacacagacacacagacatgcacacacagtctctctcacacacactcacaccacacaggtgtttacacattcacacacacacacatacacaaatgcatgcagaaatacagacacagacacgcacatgcacacacaaagacacacataaacacatgggagaaactgggtgtcatctcaagagttgtcgtgttgggcccatcctgccccctcacttgtcacctcgggggctgtctcccagctcatgaaggattcctgaagccatcaagcaggatgtcactgtgtgatctgaaacactcagacacctcctcactctgaccttccttcctggtttccttggctctgggatgaaacagtgtcctgctagttttcactgcatcagaagagaawcctctcccgtggggcagaactgctgggccaccagagcgcaccgctctgctctttgccctcagggcatcttgatctgcatggtgggaggaacttccccaatcctcaaaaatgaactctttatggattcctcattcgacatgatgtcaacgtctcttttgtcttctctgtagcccttgactgtggatcccaagctgtgtgccaargagctcatggtgcaaactcactgtgagcaaaccctctgggtttattgaaatatttgaaagatgagcagtgtcaggctaattttaccatttttagcagacacggtgttttaccatgttgatcaggctggtctcaaactcctgagctcatgatctgcccaccttggcctccgaaagagcattttttcatgtttgtcggccacttgcaggtcttcttttgaaaagtgtctgttcatattctttgcttattttttaactgggtttttttgttcttgcttgttgagttgtttaagttccttgtagattctggatattagagctttgccagatgcatagttttcagctatttctcccattctataggctgtttactgcgttgctagtttcctttgctctgcagaagctctttagtttaatgaagtcccatttggcaattttcagttttggttgcaattgctttgggtgtcttcatcatgaaatcttcgccaggccctatgtccagagtggtatttccaaggttatcttccaggatttttatagtattaggacttacatttaaatctttagtccatgtcgagttattttacttatatggtgaaaggcagggcttcagtttcattcttccacacatggctagccagttatcccagcactatttgttgattttgttgaaggttagacggctgtaggtgtgaaggattctttctgagttctctattgtgttccactgatctaagtgtctatttttgtaccagtaccattctgttttgatcactgtagccttatattatagtttgaagtctggcagtgagatgcccctggctttttttttttttttttttttttgcgtatgattgttttggctatttgggctctgttttaattccaaataacttttagattagatttttctaatgttgtgaaaaatgatgttggttcgatagggatagtgttgcatctataaattgcttttggaagtatggccattttagctatattgtatcttctaacccatgagcataaattatttttccatgtatttgtattgtccctgatttttttcagccacgttttgtagattctgtttccacacaaaatctagcagaatcactcatttattactcacaccatggaggaaaaatgaaataacattaattctctactgggtaatacaagaaaattctaaactcagtaggtttttgsgaaatagaactctttgtggaaatattagtacagagcaataaattactgaggaaatatcattaatrtaattttttcttattaaataaagaattatccttcaggacgcggaaagaaaccttggaggtctgaaatctaacatgattgttttactgactgtatcatttggaagaaagaggtcatcattcaaaaagtacttgatttttcaaacaaaagcagaagaaagaaaatgttgacatatcttktttagtcagccagaactttaattgcaggaattccatcaggtagcaccaataaaaaataacataagatgttaggaataaccgctggtaaaattattgacaaaaggaatcaaggcagtgaatgagctattgggtccatggtgtcatcatgatctgctggaggccactggacatacacagtaggtggtgggcaggtggccagacagaagggcgagtttgatcaagaccctgctcacaggggctttttggtatcatctttaactttcaaaaaggacacaaatgttggtttaagagatgaaggagaacctggatcacttttgcagggcaatctttccctaggcactccacgtctcagagcccactgcactaaaggacccgtttttcccttgagccccaaccctggcacctgcagcttggagcagcctctttcctcctttgtcaaatcacagtgtcagcccaggccctgcacctgaccaggggatggagtggaggggcctgcaagactgaagctggtagtgatgggcctgctccctcactcaaggccctctctaccatctgatgagaaggcctaaaacatggcaaggggtagggggagcccatccaaagagagggctctgtattcctgtgtccttggcattgggtgggcctgcaggcaaatattcctccttccccttcttcctcagcctctcctcacactgcaatcagcacccatagctctgmaggtgactgtccctgttccaccttattcattcctggtccagcccagtggtgcccatggacttaagcagcagctcaggtcccccgtgtctgagtccactctgctcctggcagggccatgagcgggctcaggatctggggtgtgcaggaaggtgatggcaagggagctgcctcaaggtctggactcgaaccccatgggtccatgggactgactttttaaaaatttttttcatgtgcagcctctactcttcgccttccaccttaattcctggaacccaagccactttctgtgggaaggcagccctgcgccccctccttttcaattaggtgtaccaaggctctcccagccccctccttctgggattacactcatagttgtagggaccagccctacagggcctgtgggtttttctcttcgtgtgcggagatgagagatcgtagaaataaagacacaagacaaagagacggaagaaaagacagctgggcccagggaaccatcaagatatggagacctgtagtggctccgaatacctggctgcgccgttatttattgtatacaaggcaagagggcagggtaaggagtgtgagtcgtctccaatgataggtaaagtcacgcgagtcacgtgtccaccagacaaggggcgcttcgctatttggtagctgaggcggagagagagaggacagcttacgtcattgtttcttctatgtatttctcggacttcaatactttcactaattctgctaccgctatctagaaggcggagccaggtgtacagggcggaacatgaaagtggaccaggagcgtgaccctgaagcacagcatcacagggagacgtttaggcctccggatggctgcgggcaggcttgactgatgtcaggccttccacaagaggtggtggagcagagtcttctctaactcccccggggaaagggaaactccttttcccrgtctgctaagtaacaagtgccttcccaggcactggcgctactgctagactgaggagcccactactggccctgtctgggcatgacagagggctcacactcttgtcttctggtcacttctcaccgtgtcccttcagctcctgtctctgcatggcctggtttttcctgggttataattgtggaacagagattattataacattggaaaaaagagtaacactacagactaatgattgataatattcatagataatcatgtctgtattctacgtctaatacaactattcttattttaagtattttctttattatactggaacagcttgtgccttcagtctcttgccttggcacctgggtggcttgccgcccacacatatctctctcttagcctcagagatggaatcccccttcccttgtcatacctcatgtaaagctaccctgatgcacctaacccaattaagaggactgcccatgtctgaattcctgctgcctgcaggccacacacccttcctgaacagaaacctgctctgaatcaggcctgaacttgctaaaccctctcaagctcaacagaccctgagccttggtatggcaccactgcgcctttccctctggcctttgatggtgagaatccatcagaactcagggcagagctgcccaggtcatttccaacaagcaacacaaggtctcattcacctgtctcatgttaggatgagaaggtcccagccatagggagtgggactctgggaattctccatccctgtcctccctcctcacccacctgccctttgctccactcccaattctgcccccatacctgtcactccaaaggactctyctcagcagccaggtaggatgaagcaggggaggatgaggaggaggctgcagggactgagggtggtggccatggctttgggtcagactgtgcctggagcatatgaggagacacatgatgaggaggcagcaaaggatgagggtggtggccgtggccytgggttgggctgtgcctgaggacatggtgggtggtgctgaaatggaagcacaagagtgacaacccttgtccaggccccaaatctgaggagatgcctcctcagctcctgctgacccaggtcatcctggaaggcagaggttttgtcccctctgctatggggcagcccctgggagagttcctggggtaggaagggagagggggtgtcccttggcctcagggagctcacagagctgctgagggaagcaaggtgacagcaaagcccaccctcctgctgtggcggaagaggaggtgatgctccagggtgcgggaggggagggtcacgaggctggccttggaggaggttttgatggatttccagaaacagaccagaggaggaaaggaaaagtgattctcaagagggaacactaaggagaaaggcctgaaaatagtgacacctgcagtttcgaggctggtgagaaatccacagtgtggggaacagaagcaagtgcagtgaggaagaggagtcaggagggagaaggaagaggagggtgggagagcacaggcacgccagcacccccaggaggagcaccccacgaggaggtcattttaacataaacgtgtacactgggatgattgaagctgaactcaagaattagtttcttgagatccccatttctgatctcattggagatccccatttctttttctcctgttacctcctgcacttggctccagggtgctgtccatgcccatcaagaagtcctcaagccatcctgtgcagtctcccattgagatgtaatggaaggacatggtcatatccttgtcattctcccacttttctttcatctttctggctccaggatgaaccgttgtccacattctgttttctgagtcaaagaggaggaagatctgtccatcgaaactgagctgccaagatccactgccgtgtccttcggctttctgctcacaagacatcctggcctgcagggtgaggggttctgcccccatcaaagagagatcagctctggccttgacagatattgagcccccatcctcttccacttgcaatttcctggtcttacttgctctgccacatcctggccttgcctctagacgtcttgcggggtgagatgaccttcctatttgtatttttacatgaaaactataaatgcctctaacctaccactgtatctgctccctgctgtcctgggccatctgaaacttacccttgggtatgtaattctccagctgaatgtcaagcagttgctctgtaagtatgtccaccacctctctcagtactgggttctgtgctttccaggccgttgtgacatttagtttcttccccaggggactgacgggtgtgactgtcttgctgccacagtcatagtgaagaaaagtcttttcatccacctggccttgaaccgcacaccaccgtggtccaggtctgaacttagggatgacggtgatgtcatagcaaagagagtgagggtctgtggagaaaggcaggtgaggggtgggtggggaggaaaagacccctagatacccctcctccacactgtgacaataagaggaagcctctggagggctgggctggcccagcaaggagtgcctcctccagaactgtggtgtccacaagattaaggcgagtgctccccacttccatgagggcaaagaggaggaggaggtccctgcctgctgagaaaccacatgtccccagacatgtcccactgcccctctgtccacatcggtcaacacaggaccttgctagagaggtgccaggagtgctagaggaggaagggcctggatgacagaggatcttcagcagtagcccacgtggactgtgggaggtgggacagggtgtgggagctgcacctgaggatactggtgcatggtgggacggagtgaggatggaacccagttggataaagaagagttaattatcatggtcacaggatttaacacgttggcaaagcccctggtggtggtgctcatctactatgaggatgccttcctgaaaccttggacaaagggatggtccacacagcaagaaatagaaaaatctgaaaatctaaggcaggcagtagacggagggatcacaggctcagagaagtgcccaggctggaggggtctgagtgtgaaaatccagaacaatgtccatctgctgtgctcatgggaagcctggaggactcctgtttacctggcatataaagaaggccccatgagaaggcaccagaatgggatgaagctcagggatgcctattgctgaaggccagggttgggggtaggagatgctcttcctgaaatgggctcccagtagtaatgggatgaaaaatcccgaaataacagattccaggtggaggttgtcaactgtcaggaacaaggagggtgcaatgatggaaatgattagagaagtcacaatgccagctggagacctcagtcatacaaagctatgcccatggctcatagaacaaaggggtccaagatccagaagagatggaaacccaacctgaatagtgctggatttaaataattacaagaaacagagataaaacaaatgatggatgaccaggaggctgaaagtagccagtccttcaagaacaaggctgctttgcctaatttgcagaataaagccacttctcagaccgtgaacccatgactagaagaagacaccagtttccagtgaggaaggaccctttaaccccgcaacaagtgcaatgattctttgtgggcttctccaaacgtatttatggccactagagtttgctatgaagggcaattttgtaaacatgtaaaggtgtgcagggaatatattctccattgtaactactcagctctgctgttgaagcgcaaaggcagccacaggcaatccatgaatgagcgaggctggacctgccttaagtgcccaatgacccaagaccccctaagatcctagaggtgcatgtggttccaatgtctaattggagaatcacaacatagattccatgtgaatgttcagaggcaaggcaacgccactcacagcaaggaaatctcaacattaaaaagtgtctcctgtagagtactgggccttggcagagatggggcctttagccatggaagggccgtgaccatccagcctcagagctgcccattacgggtgggctcctcaccctctaggtcattaggaagagaggtctggcagtgagaagacacaggtggttctcctgggatgggcagaagtagggccacagggaaccgggaagctgcacaagcagttggccccgattcccaggacaccacgtggctgcacccccttaccctcagcttacacctcaggtttcagggaaggtcactgatggcccccgtggaccatagatgccactcagcagcaaaggaggggagagtagaccctgaaccatgggacccccactcccatcacatccacaccacccagaagccacaggcaaggtaggaccaccttctactctccaactgacacctgagacaccacttggagatgacaccataggggatggggtactatttgctggtacactgtaatcccctcatctagggtcagcaacctaggacagggtccaaatctggtcccccctatttgaaggttgccattgcctgctgttgctctgcaaagggacaggactggacactgagacagagaacccaaggcctgcaaagatcacagggcatccttcctccctttctagaaagggtttgctgacccctgtctacacactgactattctctatgacgctggcgccccagtaggaagaacaggcaggtctgggccccaagggcagaagtgggtgcctctactcaccagagttcccagggtcatcctggaggaaatggtgcttcccatcccccctgcacaggttctgtggggagcttggggtgtgtttgctggggtgtgtcctcaggcaagaggcagaaggtgtcacgtggtgtaagaggtcgcgagggccccttcatggatggggagacctctggggtgaccagctgggctgaggtggggagtaagaggatgttacctgggtggtggcagtggatggtgaggggagggtgggaagtgtctgctgagccgctgggtgcaggtgagtgtctacaggaaagtgcagggaaaaattcaagggcacgcagccctgggggtgctggaaggtttgtgtggttgagagcgggtgagaacagagcaggctggtggctggtgggagtgtctgtgattgtgtccctgtgcaaccccacttcacccctgtcctgaccccagctcggattctgggggctctggtttctccttcccgagggcgggtgggactgccgggctgcactagggatccccgctccacgtcgccctctgcagccctctggcccctccactctccgggggttcctttccagcctcctctctgaccagctcctcccctcggaggataagtagcctctgggaacggacccggcgggaaggagacgcggagggaaactgagcgggggcgcagtccggggtgatcgcacgggtccttccagaagcctcccctcctctgaagcccacagtccacagccccccacggttggcctccgccccgcttaggctccatccccgaactcaccggccagcccggtcctgcaccagctggacagcaggagcagaagcgggaggcgtagaaggaacgcggggctggcggccgctgccattggggagttggatcgcaggggacagcagaagcgaagcccagcccgtggatcacctggcggctcgcaggctgtctgaatgcagcccgtctgaatgcagccctaaactccagtaagccctaaactctagcactccttctgccccgcccctcggaggaaacacaccccctttgctgagccgctagccaatcaggtgtctctcagccaagttgctcatccaagtctaccccactttctactgcagcgctcgcgcacttccccctgcttcagccagtcagactttgctggctgcctgcccgggaccagtcctgccaaaggcttctttccatgaccccctcatgtaatcatcaccgcaattttttcattttgtattaatccaatgtggataccgatgcacagaaaggtgaagaaaatgcacagaagtgttcagccgcgacagggtctccctgtcctcgcctgtacctgcgacacccgccttccctctccctgcgttgcagagtgctcccaacccaccgtcctgtgcgcagatccaagcccagtcccatccccgcggcctcatcccaaatcccgagtggacgtggttatagcctgggctaggtttgtttgtttggttggttggtttttctttcttttcttttttttcttcgtgacagagtctcgctctgccgcccaggctggagtgcagcggcgcgatctgggttcgctgcaacctctgcctcgcgaattcaaacgattctcctgcttcagcctcccaagtagctgggaccacaggtgcgcgccaccaagcccggttaagttttgtattttggtggagacggggtttcaccatgttgcccaggctggctttggactcctgggctcaagtgatcagcccgacacggcctctcaaagtgctgagatcacaagggtgagccaccacgcctggcccggggctagattttattacagaagcaccaggtcttcagaggcttcaaagaagatattgtacactaaacaattggttaagatagtaaattttatgttctacttttttaccaaaattaaacagctttaaaaattgtcttaaaaatatgtgtcttgctgggatctgcccaattcggattggcaaaaagactctgctcattaaaatctttgcattttaatgcaaagcattgaaaaccttgtctctaaaatcacaacctgtgaggcaccttgctgatttagaaagcacatcagagagattgaccctgagctccccttagaacagtgccccaccaggtgtggggatggcccaggggactcagcagagcaggttcaaatgaaagctccccatagctactaactgccagcgcttgctttgggcctgttccccctgggcaaggaccagccatccttccaagccgcgcacaaataccccctcccatgtgtgtccctcatcttcccacatgaaggaacaccctcctgctccctgaggcctggatccacagtgatggagcgtatccggatctccctgtgtgacaaatgctcacacatttctttgcttctctactagaagcatgaggtctttgagactatactagatctgtgtacagcttttgagggaaaaaagccctagtggcctactgttgctcaattggaatgtgatcaattgtgtttcccatgggagcaggaggcaagggaggggtctgtgcgtgcgtggagctcactttgcagtacacccatctgtggccaaccattgatgcctggatccatggctgcacccacacctctgctcagtccctggacggtccctgcagccatcctcaaaaggaaaccccaattgtatccttgtcttaattatcatgagggcatctggaagtggtggcagaaaccagagacaggtgagggtcccagtggttcctggcagctgtggagggcttagcttagggtgaggactggacagagcccctgggtcccattctgcccccagccactcaggcaatatcctcttttccccttctctctcagcctcttctcaccctagggctgtacccaaagctctgaatgagactgtccctgccccgccccatccactcctggtccagctcagcagtgaccttggaactccaggagcagctcagtacccctgtctccgagtcagctctgctccaggcagggccagaatctggagtgtgcaggaggccggatggcaggggcattgccccaggactgagccgtattctgagggttcccagagacctgacctcctacttgtatacagtcttttcagtcagcgtctgccttaaaggctgtgacccaggcaccttccctgggaattaactccagcattgtcctctgggtcgacacagtccttggcagcctctccttcctggggttacacccagttcctctgctcttctccagtggatggaatctccttctccttgacacacagcatctggagccaccaatctgctgccccactcaaatgtgaggaccgcacatgcctgagctcctgctgtctgcacaccacgcaccgtgg

SEQ ID NO: 12277 - DNA, 81180 bp, Homo sapiens
ctccttggagcctcatctataaggggaccctgagctcccctccagccctgcctgattctgggcctaagagtcatgtggggtcattgttactgcttggtctgggtgccacccaaggcagggaagggcaacctggaaagaaggtcttgcccagaaagggacagcagagcagggccaccttctagctttacgcctaaggtccagggaagaagggtcttggtcttaacctccctgctgtgtttggcaaagggctgggacagccacaccaccttgccaggtgggccctgggtgaggaggtctttagttacctggctggtgccccgagggtctgtgctacctaagggggcccagagggagggtctttgcatctgaacgctagtcgtgcatccacccgtgcgatctccgacaaggcagcagacccasgtgccacacctttctgtctgttaatgaggtgtcccagtcatcccattgtatgggctcttgaggatcaaacaagacgcgtgtgtggtgacaataatagtaggaataataatagctaacagtcactcagcacttcctacacattcactcatttgacccttgcagggcaaagacacttatgttccccatttgagcaaagagcaaattgaggcacagagacgtgaagtcacttgcccaagaaggtcccagtggaggaagcggcagagctggggtttgaccctacactctggctctggggtccccacacctgacacctgcccacaccacctctctgtgctctctccacataaaagcagtctttccccattagtaactttttcttcttcccaaactatttcctgtttattgtaggaaatttagaaaaagaactaactacctttgaccccagcacccagagagtctctgcataccactgtgagtgtggcccacagtgacatgttattggttatcggcatgtgtctttgcttcccatgggaggactgaacaggtgtggtatggaggcagttcttctttttgggggtggaggggacggggtctcactctgtggcccaggctggagtgtggttgcccaatcttagctcactgcagcctccatctccctggctcaagagatccttctgcctcagcctcccaagtatctgggactacaggtgtgtgccaccatgcctggccaatttaaaacaaatgtttctctgtagaggcaaggtcttgctgtgttgcccaggcttgtctcaaactcttgagctcaagccattctcctgcctcagcctcccaaagtgctgggattacagcgtccactgcgcccagccccaaggcagttcttatttggagtgtgatttttcccccgctctgtgggcagtggggcagttatgtggacttgaaagttgagcactggtaagaaaacttattctggctgcaaagccatgaaggatttgcgtttcagtgtctgccatgtgatagatttcttctcatgcactgtacacccctgcctgagttctgccttcctaatttatcctgagattcccctgagaggagctcagggaggctagaacctctcctgacgtaacatgacacatcaaccccaccaggcctggggagcaaggtagtccccttctttggtctctgtgcaagggggagcgtgtggtgatggtgtggcaaggatgcttgtgtgctccgagtggcctgctggataagcaccctgcctggatgggggcaggagcacctcccagctgctatctcacctggtccttggaccactggctccactccccaccaccacgtgatttatcgctggtggaggtacagagaatcactgcccctaaataatccattgctcattgtggaaacacttggaagacactataatgctcaaaattatgatttaaaaatcatctctaatcctaccctcacaaaaagttgcaaaagtaagtcaggcacggctatgcgcacctgtagtcccagctgcttgggaggctaaggcaggaggatttcttgagcccagcaagttggaggccagcctgaacaacatagtgagccccccttttctaaaaagaagaaaaaaaagttgcaaaagtagtacaaagggctcctgcatacccttccgccagcttcccccaatggtgacatctcacataaggagcacattagcaaagccaggaccatgacagcgacacagcacagcctcgactgcaaacctgagctcagattgtacccgcctgttacacacactcatttctctgtgtgtgcagtgttttatgagattttatcacatgtgtatgttagttatatgtgcttttttttttttttttttttaagacagagccttgctttgtcacccaggctggagcgcagtgacgcgatctcggctcactgcaacctctgcctcccaggttcaagtgattcttctgccttagcctcctgagtaggtgggactacaggcgtctgtcaccatgcccggctaatgttttgtatttttttagtagagacgtggttttaccgtattggccaggctgatctcaaacttctgaccttgtgatccgcccgcctcggcctcccaaagtgctgggataacaggcatgagccactgtgcccaggattttttttttttttttttttttgagaaggagttttgctcgttgcccagcctggagtgcgatcatgcgatcttggctcattgtaacctccgcctcccacgttcaagtgattctcctgcctcagcctccaaagtagctgggattacaggcatgtgccaccacgcccagctaattttttgtatttagtagaaatggggtttcaccatgttagtcaggctggtcacaaactcctgaccttaggcaatccatccgccttggcctcccaaagtgctgggattacaggtgtgacaccatgcccagccagttatacacacttttaaaaataaactttgttttttagagcagttttatcttttaaaaattttttttagtttaatttttttaaaaggcatttaaaaataatattttaaaaggctagtcaagtgaagcagtgggagtggagaaggaacaaagaaatctataactgattgtgatcaattagttgtaaataccactgcactcagaccagcctagggcagattttaaatttatggaaaaattgaggagatacagagagttctcgtataaactctgcgcccagtgtcccctattaacttcttaactggtcttgtgcattcattacaatgaatgaacctgtattgattggtatcaattagaatccattcttgattcacatttccctagtttttacttaactttttttttctttttttgagacggagtcttgctctatcacccaggctggagtgcagaggcgcaatctcagctcactgcaacctccgccccctggtttcaagtgattgtcctgtctcagcctctcaagtagctgggattacaggcgtgcgccaccacacctggctaatttgtatttttcatagagagggggtttcaccatgttggctaggctggtcttgaactcctgacctcaggtgatccacctggcttggcttccaaagtgctaggattacaggcatgagccactgtgcccagccgacttaacattttttttttctgttcaggatcctatccaagacatccattttcggctgagatcaggtgcgttcacggtggtatgaccatagacaagacatccgttttcaaaaacacattttgccacgtgatattcctaccatttttgatcccaactctttttacatgcgcaggtggagaataccttgtcacatcactgactgttctttgtacacctcatgcgaagtggctgtttgcttgttccgtggtgtggacgtcaccctggggacctcagggtggtcgtcgtcagaagtgcagctgtgtctgctaggccgcgcctacccctttctgacagtgatggggggccaggcctggtacccccatccatgtcaggagaggacagccttggaaacacacaggcctctgccagcatccccccgcccccgctgggtgtggccacctgagatggctgatcctgagtgaacatggggatgtgtgtctgaaacagctcagactaggtcacataaggggatatgcctcagcttcctgagcctcggtttccccctggggaaacggggcatgctctgatgtccttcacaggtttgttgggagaagccaaggggggttcacaccgggaagtgacttgccgtgatgcgtcggtaatggtcagtcatgggaagacgcaggttttagttgttaagatggaacgacctttctgaccagctccttatccaccacgcagcccgaagatggcacggtttaaaatagctgctcacatctggggccatttacaaagggtcgtcggcccccatcctgcttcgtggcctttcaaggaaggccatgagcagcaggtcccactgccaggwtgtttccctgcgagcccattgagaaatccccctggaaatcctcctttggcctggcgcaggcaggcgagagaattgcagacaatggggagccggggaacaaagggagcgattgtgcggtggccgaggcaggggtcatggacgccccaggccaggcaggcaggcctgcaccggtcactgggtttctgcccacccgtggagtggccgtgagtgaccatgggtggggggagcgaggccagaccccaggtgtgaggcttcatacgctgtcctcctacctggcagctctgtcctggaagatagaacttccacggttgtcttcaggggctgtgttctttgcaggcggggtccagcatctggtgggtctgaccagcttggtgtggcatagttggtggtctgttcacggggctctgggttgaccaggccctgtccatcctgccttgcccaggtctttgccctggagagcccagtggtttgagcatgggtgtggcctttgccagggtagggtggcactgggcacacctgccattccttctccagtgctgatggtggggtttcaccctcccactcctcctctttgcttcagcgatcgtggaaccagcctcccagctggcctccctgcctccaggatggtctcctccagccctcactctgtctttcctgaaacacagcccctaccctgcacttggctctctggggacccctcagcatcaggttcaggattctgaaaataaagttggaggtgctctgtgatcaggctctgatgcctttgccacattcctctcccatgtcttctggaagaagatgaacagcagttcctttttaattttcttgagatggagtcttgctctatcacccaggctagagtgcagtcgcgcgatcttggctcactgcaacctctgcctcccgggttcaagccattctcctgcttcagcctcccaagtaactgggactataggtgcccgccaccatgcccagctaatttttgtaattttagcagaggtggggtttcaccatgttggccaggctggtcttgaactcctgacgtcaaatgagccacacaccttggcctcccaaagtgctgggattacagacgtgagccaccatgcccggccatgagtggcagttccttaacaccattagccaggcgttttcatacctcccctctttccctggctgtcttctccgcctccagttccccccatccccgcccccttccccccctcccctcactggggacgtccctcatgtctccagcctgtggctgagatgccgccctctgcttgcttttccagctacctcagtgtccaaaagcccctcctgcctcccccactgcactcacggtgactctgggaggtgtgctcttctgtctgggctgggctgtgttaatggcagtctctgccttgagctcttaggacagcactatatcttagctggtctgtcacccactgtgcacgtgggctgtgtccctgggggctgggcctgccgagctccggggccacacctgagccacccagcctctccttcctctgggtgtgccgggggccaggcctgcacaggctgtctgtcccagcagctccagccactttgctgaccgaattcctggaaggtgtctactgtttaggaatgtgagaccaagaggaaggggccagccctgcccatgtgactcactccggggtatgtggggtatgtggggtttgtcatggtggtccgctgctgaggtgattaatgccctaccctggccaagactcccaaagtcttggactgagccagacgggggtgggcagggtggcctggccttgggcgacctctggtagacagcctaacgaccaacaaccgtgtgtgtctcagtttcctcattagtgagatgggatcccccatccccactcctgagtgggatggggaaggaatcaggagaggtgacagcaggcaggagctgacatgtggggacctctcccccgctgccctggactcccccaggcctgcccctgcctcccgctgcctcccccagggagctgaccatagcccccacctcaatcccgaatccagtcctcacctttctggccccacctcttccttctgggtttcttgcctgggctgtctggggctgcgccctggagaaggctccaggaagagttgggagtgaggcagtcagtggggcagctgggaacacatgccctgggatctgggcagaaggaccagggctgggagggcaggatagggggagcccccaaccccaggcccctgccagctcccctgtaggtcccactcactgtgtgagtatctctgagcccacagcagactcggagtcacactgggcctccctgcccccctcccccacttctcttcctccaccggcagagcaggttccacaggtgtgcacagggacactgcgtccaggacggtgcctgttggggcagccccgccacttctctggcttgtttggcaccaaggctggaggcagaacttcagccccaggacagggggtttccctgacgtcatttcatgggggaaaaggcactcaggagcccaggggactgtgtgggtacccaggcgagcacctctggactcagggccacctgggtcagacaggcctccatggtgtgacctgagcacctctcttgggctctgtgcctcagtttcctcacctgcagtaggggcttcatgagcaatggagagagtctgtgggttctcagcccgaagtgttggtaagagagcaccctcctccatgccccagcagggcttgtggatggaggtggggcagggagtgtgtcaacaccagcagggtgacacggaccacatccacctgtcacctagagccttccacggcacggtcacgccttccagcagattattacatcctcactctagggaagcgcttagagaagccagctccggtcttggaagggggctggggcagcagcgcttgtattagaggaaataaaattgtcctgtctcccgattacacgtgatgaactcaccatcacgccaacggcccagcagctgtgagcattcaactaaaggtcaaaagcaaaaatagaagcagtggggagggatgcttttaaatcattgaacatgaccaagaggagggtgcaggctgtggaggctcacacacacagtgacaggggacataggtacaggccatgtgggtgtggagacatgtgcacagtcacacacacacagtgatgggagttgacatacacacactgaataagcaaccacatcactaccatttaagaactactgcatgacggggaacataggtgtgggctgtatgggtgtggagaggtgtacactcacacacacacacaaacacaccgatgggggatacaggacgggctgtatgggtgtggagatgtgtacacacacacacacacacacacacacactgatgggggatataggatgggctgtatgggcgtggagaggtgtacactcacacacacacacaaacacaccgatgggggatacaggatgggctgtatgggtgtagagatatgtacacacacacacacacacactgatgggggatacaggacgggctgtatgggtgtggagatgtgtacacacacacacacacacacacacactgatgggggatacaggacgggctgtatgggtgtggagatgtgtacacacacacacactctgatgggggatataggatgggctgtatgggcgtggagaggtgtacactcacacacacaaacacaccgatggatacaggatgggctgtatgggtgtagagatgtgtacacacacacacacacacacacacactgatgggggatacaggatgggctgtatgggtgtggagatgtgcacacgcacacacacacacactgatgggggatacaggacgggctgtatgggtgtgatgtgtacacacacacacacacactgatgggggatacaggacgggctgtatgggtgtggagatgtgtacacacacacactgatgggggatgcaggacgggctgtatgggtgtggagatgtgtacacacacacacacacacactgatgggggatgcaggacgggctgtatgggcatggatacatgcacacacacatgcactcgcagacacacacttcactccttcccaccccatcctgcaccttcccaagtgcagctcctcagctccccacacaggtcttgttcactgcaggggtgtcccggagcccatttagcagctgaggagactgaggctcagagaggtgaggcggcgtgcccagcaagtgggcggcagacatggagtcaccctgggcctccctgtctgtcccacccaccctgtcctgggcccagggagcccagtgtgactccacgtctgccgcccacttgctggacacgccgtcagccctctctgagcctcggtctcctcagctgctaagtgggctctaggacactcctgcagagctgtgaaaccggaggcgcatagtggcctgcagtcggttctgaaatggtagtgatatggttgcctattcagtgtgtgtttattaagcaccgtgggcagggctgcctgggaagggggagtgaggagtaagatgccgacttggaaccagagaggagacgagcccagggatgttgttttctggggtttggaactggcccagctccatgcagccccgttccgcaacaatgtctgctgtgactccccaggcctccagccagctgtgggactgatcagggaggggagggcaggggtcctgggcatgggcattcgctggtgtccaccgtgcccccaggcagcctgggggcgagggagagctcagcagtgggtgtgggtaggagctgtgctgaaggcatccggggtgacccggagagagtgctgccccgctgtgctgtcttgggcatgttgcttaccctctctgagcctctgctttcctgtagagtgactgatagtccgttccaccctctgaatccccagggtgtcatgggtaggaagattgtaaacctggaaaaaggccatgcgattgtttgctgctatccaggcagccctagtcaggagcccggatcctaccaagtttggtgggaaagggcaaggcttgggggttggggcaggtgtgggggaactctggagccatttgcatcctgcctgcccctagcatccctgtgtggactccctgggcctcacaggttctcagctaagctgctggrccagmgaggcaggtcccactggtgtggttcatgagaagtgcgtggacagcaccatcctgtgctgggaggtgacagacaggtcaggagtctccaggcagagctgagggtggggctcccgggagctgctgctcacagggactcagtccttctcctgggccagcttggtcctgcatgtcagagcaggaaggggtgccttaagctgtgtggcctggggacctttgggaccaccctcgaggggccctggccctggattttagatggggtcagagggtgggcttcgggaggcctgtgtgcaaagcagccatgctctgagttttactgaagggctcttgaaatcctcacccaaggtcacagtttgacttgtggtctgtttatgccttggatgtacccctggccctctttgtgggattgtggctactttttggggatggaggaagatgtggccattagtgtgagccaccctcattagacgggcacagatcggtgaggtttggaggagtggggtggtcacagcagcrggtttcccccgggttttctgtwgcagctcagtttctggaagggagtggatggggtgtcatctcagcccaygtgtgtgatttggcctggtaggtgatttggattcctgatgtctacctctgccccctgtaggcagctgtgaaccacaggcggtctgtgggggttagtccgtgtagcagcgcaccagcttccagcctgggtgtccctgggtgggccccttgccctggaagccagctccctacttgtcttgttttatctctgacagctggtgatggccctggtggctcagggcaggccagtggaagcctggagaggggtgacctcatggcctgctcatccctggcagcctgcaggcccagcacatgcaggtccgctgtgcgcagaggcacaattcatacagggtcctccggcaggtgggacatacagggctgccaccctgttgtccatttaaggggaagaaagttagtggtcacatatgtttgtgggtgatttcctttggtgttggcagcttgcatttttgtggtgctttgagctcttgagagagttttctccctttctcagcaggtctttctggcaacccttcgaggtgtgttaccaacagaagggggtgagggtcgctgagtgattgctgggcgctggtgccagctgagctctggatggtagacagtaggcggctgaggccctggcggcagggggacccaggagccacgctcatgagtcatggggcctctcccaggttcctgagggccttggcactcccctggcgcagtcactaatgcacactaagcatcctaatgccctgcgctggctgagggccaggacgcrgcctcaccccacgaagactcctgtgtacgggaactcaggtggaacagggctggatcctgggggcagggccagccagcaggaaggaagagcaccctgaccatccccgtggaggctgggaccaagccccgttccagatgccatccaaaaggccaccctctggctgcagtctcgaccctccaggaagtctttctgcccctccttgaaggcatttgccctgtgaccttgaccagtcactggcttctcagggtctgtgggtgcaaccctgggggtgacccatgggatggccagcgtcccacagaatggcttctacagcctgtccctgggtggggatctggcccctgacctccttaacctcctagaatcccctgcaggccatccaccagtctcttttgcagatgtggaagcaggttcagkaatgtgcctgggtcatagctgtgagtggtcaggccacctgacccggctggtgcccctcgggcggacacaaggaccaagtaaatcagatggtgctcatgaagctccttcccagcaggctaatgctgtcagcaccactgcctctcctctccgctctccccttatctccctgcattccctaaattcctcgcaggccaccctgcctcccctcctcacaggccgggagttccccacctcccttagctttattgcctccctgcccaaggtctggattgaacttggcagggttccctgtgcctcggcctgtgaggagtgagtggggatggggtgaggggagcatgtgggagggtgaggggagcgtatggggtgtgacaggacctgtttgggggagagtgagctgtggccgggatatagcacggagagtggctcagtgtcttccaatccaggaaggattccagctgagatcagatctaactgcttctgccagacaaaaaaaaatccctggagcaatgttcacttctttgttgagcttccctggtgggaggctgaggtcttgctagtgttgctggtgctgagggcaggtggcgggtcagagagcacagctgggtggcagcttgcagcacatggtcttgttctggaggctgggcaggcacagcagaagcaggacagagcagcactcctgtctcagaatttaactcctgcgcgtccctggcatgtgcrctgagccctcctgtcaattaggacattccatcaagatccaaatgccagttccaaatggcagctcatgaacacggctgtccctgaccacccttcgcatcccaggatgagacgagttgatgagacaaggagaattgcacctasggagggtgtgggaggccccagcgcatgcccctcacttgcatagaggccctggagtgctcggcggcccagaagagtgaggcyatgggctctaaccaggcttctgcagggcaggggcagagggattgggtgggttgtgaggggtgcatctcctggagggctgccgtcccacccaaaggcagcacctctgccctgtgtcatggggactgcagggccaccccagggctgtgcagagcaaggaggttggcgttatttagagccaagctctgcagctgcaggcccctgccctggagggaagtgttggcatctggctgcaccctgtcctttgagccagaacgtccaggcygggtctgcctcactggtgactgcctgccatcagcagggctctggatagccagcacctccatggggagactgaggcccagggtgggggaggagcgccggacctcaaaggcatggcctcagctggttttccttcacgtgggtgacagctgagggttccctgcttccatttaagactaaatgaccttcagtggagctcagaacaaaactcttctaaggggattgggaaaatgggggcctgggagcagcttctgaaactgatgagcacctcgacccatgcaccaggcagagccggctccctgagggttcctgctagagtcctggccacccayggctcaatcccctgcagggagcacctggaggtcctgttcgctctaggcgggaggctgagtgacgctggaccgctgagcagcaggtccygcggggactccgaggcaccgggggaaatgaagcggtgcccaggcagctgcacgcctgagtccctgcctggtctgagcgccccggaaacagcykaggcttcacttgtcccctctcatttttagcaccaggctctgttctctgcctttatgtgtggygtctcctgcggtcaccagggtgccttctgctctgaggctgctgccatcctatcttgtaggaggcgaaggcagggctcagagctaagagaaggcgctgcctcaggtccgtgcctcccaccctgcctgggacttgggcagacattccttccttagccgtttactgagcacctgttgcacaccaggccccgtttccatgctcctgggatacttccatgaagcaagacagacagaagtctcctttgsaagatggataaactggcaaacaaatccatggatgggacagtttcatatcctggtgagtgctaggaagagcagaaaacagatggtggcaggggaggyctcttaaggaggggccaggtcacctggggcttggatgataagcagctgtcgtccctggaaggtttccagcaaaggacagatgtcagagctttcccggagctgaccaggccctgtggctggactctggtgaccgaagggggcagggtaggaggagctattggggttgggattttatctaaagcctggcggaggtgtgatacctgatcatttatacttgtgaggccctctggcttccctgtggagcagggccttggggtgggggtgggagccgggattgcaggctgagacactagcccgcagcgcccgcagtgtcccgtgaggaaggccacatgccacagctttcagtttccttggggaaagtagcggggaggagacggcagtgatggcatgaaaagacccatccctggggagggagggactctcggggagggccacagcctggccattcactaacgctgctggggccagggccactgaagcccaccctggaggtctttctagggaccaccaccctgtgaatttgagycctcaggcttgggagggyatgtggggaatctgrcccttgccgctgccttccagagacttgcgggtgctgggttagggttgggggctctggggrtcacgctctgagatgccccgtggaagggtgcctgctgcaggcagtctccagctcctyggcccacatgcctcactccttgtcccctccagttccttcccctgaggcttcagggcctagctcaatgaggcaggaggctggataggtgtgatgtcccaggccacccatgtgccaagaggtgccagaaagcaggaagaaaagsggcaggtgggatttgttgttctgatcagctcactggagacaggctcttgtcacagggggcattgaactgggcacctrcctgcctgaaatatttacattggcaaaggcccggacaggccacaaattaccctgtgcatgtgattccatttcccagccactttttttctctaaggagttgctggcatcgtaaatcttactgmaaacagtggggaagaaaagaatctgagattctacaaagcacatttaacatccatgactgtgtttgatctttccagtggtggaggggcccgcctgctcccctgcagacgtggctgaacctccccgtcagggtagcccagtgctgctgcctgtgggcctttggtctgcgtctcagccttccagtggggcctacagaacggcacggctgtgcacctctggcacctgcaygcccaaaaggcacttggtcatcacagcagctggagctggggggttatcgtaacttggtagccattattattattattattattattactactactacthttgctgctgtggctrtgcctgttccagtagctctggcaggcaggccttggcgagatggcctggggagggagtttgtgaggcccaggttagagtcctgcatgttggttctggaagggacttcttgtctccyagcccctcccccatgatccctgtctccggctggcccctcactgyrctgcctttgtcttcctcatcctttgtcttcattcctccttcccgtgagggtggggtggtctgctgaagagggagtgtscctggcaggtggggtcactygggcacaggcaggggtggcagggctggccggacagtrggtgggagtgggggaagctccagggctgactttgtgctggctgtgagttggagaagcccctcgtgggatctgggaggcaggggtgggttgccttcccccgcctactgggagggaaggaggcccctttccatttcctgggaccacccaggccagaggcctgtgcccacccagcggggcggctctgcccttctccttttctgctaatgccccaccgtttgtgtgtaggtctggctctttctgcccctcctccaaagctgcacgtgcctgtgagctccacactttctgttctgctcaggggccgggaaggtgaatatctagataaggagaatctggtgccgrgaagaccccctggactgtaggatagctctcttgaggtcctggaatgcattttatgtctcctgcctggcctggaaggttatatccctggccccacaccctcccatgaccctctcctcctgtccccctccctgaaaaagaagcayccgaggcccagccccgagcccctgccrtctgggctctgcctgggcccctctggcccctgccgtgactcctcatccacagagtggtgtccgttcatctgtgtrgaagggtcagggtgtggcaggggccaggcacgcaggtgctgccaagctgtctgaggtcagcacctcccccaccatcctgaccattctgagcctggcaggataaagaggtcacctgtccagggccccagggcctggctcacagtggccccagcattggttgctgtgtggccctgggctttgtgaacttctctgtgcctctttcctcaggggtaaagtggggagatgctagaactttccatattgcagggctgcaatgagggctggatgggatgaggtatgtgaggcactcagaacagatgtgaaagctgcrcgtggatgcccctgcctggcagggggatttggtctcaggagggcacatttcaagccccacttccttcctggagtcytccctgtccccacaggtccgtgtcctgcctacctgtgaaccactcagggtaacgctgggcctgagctcaggctctttcttttttttttgagacagtgtgttgctgtgtcacccaggctggagtgcagtgacactatcatagctcactgcagccttgacctcctgggctcatgctatcctcccgcctcagcttcccaaagttgggattacaacaggggtctttctaacctccagtatccgcagatgttccaaatcagtcctgcctgggtctagatccctccctgcgtcgccttggagcattgcacctgaaatgtggggtgtgtgacatgttggggggaagcagaggtgcaaagaactagcaatgtctcaagtgctgatgaggttgcctggggtggtgtaggatccaggtttgaggctggatgtgcctgggttcagctcttggctctggagtgtcctggctttttggcctgggaccgttgaatcactgtctcttgtctgttcaaagccttcctgggtaggtggcattggtttttgtggctgtgggtttggtcccagccctggggcagccgtaactgcttagatccccaggcagtggtgggtgcctctgtgggkcagggcagcctggcggagctggggcccaggtgtggacatccagggaaccctttggaatactgtctggtggagccgagcacacaccccactggcccagcagcctgtttgttttggggacatcagtgcttcagaaaccagagccctgtgtcatgtggttctgtttcttggttccttgttttcagccttcgtactggagggccacccctgggagttgggaggatttaggtcttccttcacgaagatgggtcgaygtgggccttactgctttattctttggttaaagatggatattgctgtggctaggtctggggacggggcttggcagacagtgaggacacaggccaggagtggggatttgatgtcccctctttgagctgcctctgtctgcagtgacgcctcctggggtccccaggaaccctcagctagcccatggacctggggctgtgccaggcgccagccctcccaggagagagaagttcctcctgcctccagaacccatgttcaaggtgaggtgaggcraggacccygcagaagtctgctggagcgtcccctcatcacggttccctttctgtctgtgacatgctgactctccacattgttgatggcctggtggagaggctgactgaagtcacgttttatctgcccttttctcagagcctgtgtctggctttgggccaaaccactaataataaagcaacttgaagtactcctyacatttgtgggatgtgcagcccagcggccctgccctcctgccccgagcgaggcccagcggcatcctccttgagggtttcaccctgtcgccccctgttagctcctctgcagccccctcggggttggcactgggtccagyggccacgtctttcctgagyggggtcctcaggtcgtcatgcaggcttgcctgtggtagtgggggtgctgtcttctaggtgtgcaagggcttgcctcccaccccccaaggaagctggggaggcgggatatgccctgagctgcctcggacagaggttctgagagaggaaggccaaggaggaaggaggagttaggaggggtcyggggacctggggccccaccactccagccctttagaaatgcscatgaacccatgagactatagtgagccgagatcgtgccattgcactccagcctgggtgacagagtgagactctgtctcaaaaaaaaaaaaaaaaaaaaaaaaaaagggcaggtggcctccagagagtgtctgtggcttccccagggctccccttccctgctgtccatgaatttgttccccaatacggggcctggggctgctaggccagggccattcaaactgggcagttgtaccagcctgagcccctcctgcctctctgcctaaagggaccaggccagtctgggaccagtgccctggagtctctgcatctagacctgcttcagttcctgggtatttaaccatttcctctgggggtgggagtggggggcagtcttgtgtatttggagtcatccgcagctgtcgaaaagagtgctggcatctttgtttggctgtagcaccctgtgtgatccaggtccccagccccaaggtggcaagctggaaagctggagacaggcatgtgcatttcttttttgttttgttttgttttgagacagagtttcgctcttgttgcccaggctggagtgcaatggtgcgatctaggctcaccgcaagctcctcctcccaagttcaagcgattctcctgcctcagcctcccaagtagctgggactgcaggcatgtgctaccatgcccagctaatttttgtatttttagtggaaacggggtttcaccatgttggtcaggctggtcttgaactcctgacctcaagtgatctgcccacttcggcctcccaaagtgctgggattacaggcatgagcccctgtgtccggcctcctgccctatcttaagattagttttatctgccgcaccttggctgtcctggcccaggggtccctccygctggtgagaacacagccttaccaagctctttaggaaactgcaggtgccctgatggggtctcggcaccaccatgcctcccctggttgtcacgcccccaactcatccacccgaaaaacttctgtccctcctgtgacccccctggggcgaccagaagtcccatctgctgtgttcctgtgggtctgttctgtgcggccacatccttatcacagtgtatagaccgtgcctggctggagcgagctttagggtgacttgtgaatgtgtgggtgaacctgctcttcctgtgactgtgcactcatctgtcctcctacatcagcgcagatgagaatcgggagggaccgcttcccatctcacacatgaggaagcaaggctgaggcccagagatgggccgcgttggaggggaatctaggcctggactacttgggaacttgggtggctcttggcttggctttgaaagggcagaggggttcgggccctcttgaggctggagcgctgccttctggttttctgggtgtactggatgttatgctagcatgctcacctcaggaagccagggcacggcaggccgccaccttgagagtggaagccatctrggccccttcccttcagtagagggtgcaggacagtgaaatgtccaaggccctggtcaccctgagagscccctgctgcctgcctcctgcaggccccctcgttgggagggaccacgtgatggggtggttcatgccaaatgctgcccaggtgccatggtggccagtggacgtggggcagagtttgcttacaggccttttcagggtagcaggtgcctggtaggaggtrggcgcctgcccagacactgattccatgaggctgtcctgatgtaaatgggtgcagagttcatggggccaggcagggagaacaggcatttgagacctgggggagccgagggaccttggcaccttgcacacactggaggtcagtgtgaacctgaagccccacctctccggatggaggggaggggaggggaggtgggaggccaggggtgtatccctgaagatcccggctgtgagccagtcagccctggattcaaaatcttaggctaccaggaaccattcttggtgagtacgtaatttacagcactgtccagagcttcggtttccccacctgtaaaacagggcactgatagtgcttaccttggaggtctgagatgatccatgcagtgtgcttggccctgtgcctggcacatggtaaatgccaacaagacattggcagtgatgctgactggcaggagtgagtcgtccaccgagtgggtggtcaggaaagaccagtttccttttcaagtagcattcagtacgattctggagcgtagggctgggagagcacagagccccttgcagcttccttccctagtctcctgtgaccctccataawgttgcctgtttgctgtcagagttgtctccatcagttggcctcatggtcagcggtgcccaggacatttcggcgctgcgttacgacagctcattgtgcctctgggctcggggctggagcagacgggcgcagcagcccygcggctgaaagccacygtcccctgcmttggtggaggctgctggcatgccctcgtgtatcatcctgcctcttctctggggtctccccaccctcctccctggcctggccttctggaaacccatttgtgtttgttgctcttctggagtcttttctgcttgggttggggtgtccactatagactcttccatgaacccaacagccagacaatgagttattaggcaggtggggtgggggccggtgtcctcccgggcttctgtatccacctgcaccagggagagaggaggcarctcttcccggctgcccatgcagcctgcccccgctcccagcctccctcctggctgcatgaatcacagagacacactctgcccctgggttcatgcacctggagcatgtgaccaacctaatttttaggcttccagttattctagaacttgaatttgtmcaggccagtgctactaaggttttagatgatctcttgtagagggttctaggttgtctcccttttatgggagggattgaaggctttcctcctcctccttcccttctccacattgtgccaggcattgcatgccagggggtgccaacccaggcatccctctgcactgggggtcagacctccatggcgtgagagagcctgctcagagctgagccccgcaggggtggtggaggaggaggggattgtgcacacgacgagctgtggaaggtgagaggggcagctggaattaatgcagggggatgggctccagcgagcccaagaacagggccaagtcccatcatccccaagtggccatgctttagtttcagcagctcttggtggaaaaccagttgggggacagtgagctcaccggcccatgactaaaagccaagtgcagccgcctggctgcatgatcagaggycgcgggctgccgggagagggtctgcgtcccctctccttggaaggcggttggttgccccctgtggcagctgccgccacgcagatcccgcaccttctggagcttccatggacgagtgcacgttctccagtgagtgttttctctgcacttgtccccacgccctccccaccygtgtccagtgtccctctaagctgaactcagtctgtccagaaggctcaggttggctgggttcctagcyttctgtaaggaaaatttaatttggacggttgccaaggggccttaaaaggctggatgttgttcctgctgttgtgagatgggcctggacgaaccagcagccagtactgtctcagcctcctgattgccccagccagatacttcctgccactgggactgcatgacaggccctsggggatgcacacaccagccagctggggcctgcccccctggggggctcagagtcaggtggtagagacattacaagatgagatagaataaaaaagaactagaggtgctggcgcccaggacagataaacggtgtcgtgcaactcaatagggaaatcaggaaggctccatggaggaggaggcttcagaaaagtgcggacgtgctcctgctgaccaaaaccctaacatgctgcaaggtgggcacaggcatatggggcatgtcctggggtcagctgggccctgctgctgctggcttctccaccctcttccatcttgtgggtctggggagggtgcaaggaggagagtgcaagaccctggtgcttcttggttatcaggaccagagagcagcaaggacgcagcagtgggtgcgaagaggtctccacctstctgtccccttcactgcrcagaacaaacaacaaaacaagaaacttctgtggagagacagtgctctcttccatggctaatgggagtgaggtccagcctctatggagcgtaatctggtcatttctagacaattgcaaaggcaagtccccttcaaccagcaatcccaccacctgtgtacatgtaggctggaaatttttcctgcaggaaaacgggctgcttatacacttgcagatggtccgtgcccaggctgcttacttgaagcgatgcttgaaatggccaagtttgggaacagcccagggttccattgccaaggacctgtgcccaccccctgccccacataccctggaggccgtgctcagagggcagactctgctagcccatctggctcgtgcccaggaatggcacagtgaatttattccttcctgcctatgccattttgcatgtccccttgcccacagagaggcacaagggatgctggcacatggaggccagcacggcccacgggagtgggtgatttatgtctgccggctggtgagcgccatgccgctgccttctgcccgcctcgtgggaagcatggtgcctgacatctccctgcctgctctctcaccctcccatttcctccctatatcttgcagatgcagagtgaccaccttattatctggtgcttctgccggctccccctttgggggatgtacctgcccgagttattcccagatggcccagttgtgctcgaagctgcctgtgcctgtgggctcaggagcagaaggtggccagggcagggtgaggggggcgtggcttgggccagtttcccaggtctcctgcccacagccctgctgggtcctgacagcatgagcgattgccttgcagaggctgctccctgcaccgcgccatctggcggggctattgttgaccatacaaaggatggaacgcggcagggcaggggcccaggcccgaggagtggacggagaagcaggagggaggatgcctggcctcccagtgcacccagtccctgccatggctgaggcatctgttttattgcttcttgggttggggagtggagggggcaaaggatccccctctacccttccagaatcttcagcttggatgctttaaactctggttctgagctgatttattactctgctaagatgcaaaggccgttttatgtactaggtaattaagtggcattatagacggctcgagagtaagtggctgctgttttaataattaaaataaatgacccctggactgttccccagctcaatactctttccgcagtgtcaagaccctggagagacagagtgagtgtgtgagtgtgcacatacctgtgtgtgtgtgtgcatatgggtgtgtgtgtgcatatgagggtgagtgtgtgaatatgcacttgtgtgtggatgtttctgggagcgtgcctttgtgtgtacatgtgggcatgtgcatacatttgtacacgtgtgtgcatgcatgtgtgtgtgagggtgaggtgtgcaggagggatggaggaggaggtggctcctttgtgaccttctgtttccgtgagaamccttgggacacacctctcacccaggttgggggttccctgtcctggattaacttttgtttcacccagaggccaggccaacctaggcaggtttcggatatcgcctcctgtgtgggccagccctggttcaaacccsagctctggccctatgtggctgtggccaactgcccttcctcagaagcttggtttttgtgcctgtacagtgagggtggccatgtccayctcatgcaccatgtgcctgatgtccagcagcgcgttactgttcctcagtgattgtgtggcattgcgctgtggctctgtggcacttggttagggcttgtggaggtagaagggtgaaactggctggccactgccctcaggggtgccagaggagggaggggcaggagccaaggtgatgggcagagatgaaatggggagcaggacctggggacccccaggtagccagggggtttgcataggcccgggggcagagggtcagcttgctggagggcgtcgctctcttctgcctggttgtgcttttgttttgtggaagggtggccttttcccagaagacgtgggccatgatgacatcatcatgtcctcacctgtggggtaacactgggctggctccctaccgggcatttccgtgaataggtggagctgaaggaagcaggtgttccagtcagtggctctgcactgaggtcctcgcgtggggagcccaggaagagggatgaggaaggaggggataagcacgtcactgcatgccaggcaagggccaggcccccttggtgccattccctactgagtggagtttcgtttaatctcaccaacgccgtagcgcaggggattctttcacagctgggttccaaaacctaaggcsgtctccctgctcccacctggcatccctcctctgcccccttcccacatttacccagcttcatgtgtgctgggcacagtgcctggagcttgtgggttctccaggctggggccytgggtggctgtggtgtgcgcctgggcccctgggggctgtttcctcatctgcagactgagraatggagggtctgcccgctcgcagcacagagcaggtcctgcaaggtctgagccaggagccactgcatggcgcccgcccctggtgcccaacaaaggacagtaatgctgatttatgacctgattttccagtgggggagggactgccctgtaggtgtcccctggagggagaccaagtaccagcagagcgctctgctgccgtggaggatggctgggcaggtgcccaggccccacccctgctgagccacatgccagtccagctggtcacggggctgtccactctctgtgacatgggtttgtaggaatggatgctctgtgcctagagcgaccaggtgccagctggtgtccctaaggcctgtgttcctggacaytgggtctccctgcctgaccttgggtctggtggcatttttcacatctgacctttcagagttttcctcctggccttgggtcccaggargccagggccgctacggccatgtggcttgtcgggagccctggaggcgtgtggcagcaggcacccccccatgcacgtagtgggtggggcttcagcactcagtggcttgtggattctgcygaagggagcagcagagccctctctgcaaatgcakccctgccctgtggagactgagggaggcaggggaactgtcctgtggcccggcccaggcttctagtggacacaggcagctttaccctggcaaggctccctgtgggcctgggggtggaggccttgtgggagccctgttctctgaggaggcccgtccctctccagaccttgcttcccttctgcagagatggcttggctcccatgggccctggtatcgggcagaggtggtctgtggctgttgatgaacaaacctgctcgcttggtgttctgcgactccgcccaggcggccactctctcacctgtttccctgccctcaagacctttctctaggccatagggttggggcagcagggaggaggcgtgcattgagtacaccgggcccagcgagcacagcccactctgcaccctcctccagtggcatttgaatgcccaggtggacagagcctgcgcagycccttccctgtgaggcgggcgtgatgctggcggtctgggggctgctctgagaatagagaagcagtgctggggccgggcctggcrcctggcatacaggtgccctggagtctctgtgtgyrgtactcatggctctcctgcctcccctgaggttccactgatggtgctgtgagcagtcrtccctcccagggatctcgttgagtgtgtggtttktatcattttacagatgggaaaactgaggcccagaagattcatgggctgtcctaggctctcccggcccagaccctcccacctcctggctgccccttcaccctacccagccctggctgcagcrttggtgcccgcaggcatgaggcaggcatgagggctgcgtgtgtgggtgggcagacccccttccttgctaagagggcagsctttggtggaggccactctgggctgaaaggtcctgggtccctttccctggtgtccagggagcatctatccagggggcagctggtgtgagtaggttccyacaaggagrgaaagaacacctggctgtgtgcagggggtgagtggggcctaggtgcaggtttgattttttttttttttaatttcaaaggggatgtgttccctagagaagcttaggaagatggggaaatgtagaagaaaaacccagacccatgcarcccagtcccgtggcctctgctgggaagatttctttcccctgagattgatctgtgtgttctctcccgggcaggggtgtgctggctgcgggcccrcctgctgtgggtttatgtggaatctggctttttcagtccacgctgcatcagatgcatttttcctcttagtctgcagccaccctgtcagtggctacatcacaaccctgcaagcgggttaactagaatttccttaacagctcctcggctgctagacatgggcacgttgctccctgatggaagagacagccagccttcctcactgcagtgtttttggttaacaggcgactgctggctggtgaagttgtgatcggtttggaggctgtggcaggtggctccgagttacctccatggaagtcactttgggaaatgaggcagaatgttgcacaggatggcaaatgtggkgggtgagaagtgtgtctggaatttgctcagccttctctcgtcagtgatgtcatgtttacccttaaaaatctataagagaaggtgtaatagcttcctacggcactaccacgaatggccacattatgatggtcatttgtgatggcagccacagcaaacgatcaygtgggaaaccctaggggtcttaaaacaacagaaatttgttctctcacatttttggaggccagaagtccaaagtcaaggtgtcagcggggccagttccttttggaggctctsgggggggamtcctgtattcggctgctctcgcattgctgtaaagaaatacctaagattgggtaatttataaataaaagaggtttaattggctcacagttttgcaggctgtccaggaagcatggcagcacctgctcagcttctggggtggcctcaggaaatgtacaatcatggcggaaggcgaaggggaggcgggtgcgwcttgcaggcgggagcaggagaaagaggggagtagagtgcggggaggagccacacactttaaacaaccagatcacagaggaactgtatcacaagaacagcaatagggggtggcactaaaccatcagaaaccacccggatgatccggtcacctccctccaggccccacctccagcactggggatacattcaacatgagattgggtgaggacccagattcaaaccacatcaccttccttgcctcttcctgcttctgatgactcctggtgttccttggcttgtggcctcatctctcccatgtctgcctttctttccatccggcctcctctgtttccatttgcccttttctgtctcttacaaggacaccagtcattggattaattgtttttatttttatttaatttttttgagacagagtctcgctctatctccaggctggagtgcagtggcacaatcttggctcactgcaacctccacctcctgggttcaagcaattctcctgcctcagcctcccgagtagctgggattacaggcaactgccaccacgcccagctaatttttgtatttttagtagaggtggggtttcaccatgttggccaggctggtttggaactcttgacctcacgtgcagtcactggatttagggccaccctaatacagtgtggtctcctctggaccttaccttgactacatgtgcaaagaccgtatttccaaataagatcacattctgaggttctgggcggacatgaatttggaaggacactgctcggcttgctacggtaggtggcagggaggtggagtgactcttctgctgttgggcagatgatgaaggccagtggctttcacacggctgagttctctgccatcagtccacactggaaacctcgtggtttcaaggagaccctgagaaactgtggaggtttgtccaggtttttccagaatcgacttaaatagaccactgaagtagacctggttgatatttttttcccctaagattaagctgcacacgcactttcttctgtgatatttcatcctttcagctattttatgttatgtttggaarggtgcggactaaaatagtgattgtttcttttttctttatttttttgaggcagagtcttattctgtggcccaggttggagtgcagtggcacgaccttggatcactgcaacctctgcctcctgggttcaagcaatcctcgtgcctcggcttctcaagtagctgggattacaggcgtgcaccaccacacctggctaatttttgtatttttagtagagatggggtttcaccatgttggccaggctggcctcgaactcctggcctcaagtgatccacccacctcggcctcccaaagtgctgggattacatgtgkgagccatgtgggagccacctgtaccctgggcattcctttctctgagccattgtctccttcyagcctggcttcacctctgctgggcccaggagtgacttggtgaagagccagatgcagcctttgccttggggctggcagatgtttaaagatggacactagatgacccttgtttctatatggggaaatggcacagacagggagatgggtgagctcacctgtccaggatcacagagtgagccaggcagtggccaagggaccagcatccctcagatgctggccttgttaacccagctcttgtctcttcctccagccgagaacagcctgggctgtacctggtagacgatctctkagaccacgtgccctggtgaattagagcctgggccttgggaaagggctttgggctcaaatcccractacagcactttctgctttgtgatcttagatgagtctcttcatctctgcgagcctcagtttcctcacttttcaataggaataattgcatttttctccgaaggttacygtgaggatctgagaaggtaacagaggtaaagtgctcagcataacacctcccacgtggttctataaatggagttgaagatttttcttttcttttgaaatgaattaaaacttacagaaaagtggcaagaatgtacaaaaggtgctgatatagcattcatttcgatttgccaactgttttgacctcattgcttatcattctctctctggactttttttttttttctgaactattttagagacgttagagttaacacacccctttcacacgaaataccttggtacacatttcttaagaaaaaggacttcagcggggcacagtggctcatacctgtaatccgagaactttgggaggctgaggcaggcggattgcttgaacccaggagtttgagatcagtctgggcaacatagtgagacttttacaaaaaagtaaaaataaaaaatactagctgggtgtggtgacatatgtctgtggttccagctctttgagaggctgaggtgggaggattgcctgagcctgggagttcagagttcaaggtttcaggtgagccatgatcacactgctgcactccagcctgggcaacagtgagatactgtcgcaaaaaaagracgagaactttcatatagcatagtgacaaaaaatgatcaatatcagaacatttaacgttgatactattaatacttgtcccaatatgatgctctagagcaagtttcttttttaagagacagggtctcattctgtgactcaggctggagtgcagtggtgtgatcatagttcactgcaacctcaacagggctcaagtgatcctcccgccttagcctcccaagtagctgggactacaggcatgcaccaccatgcccggctaattttaaaaatgttctgtggaggcgggatgccgctatgttgcccagactggtcttgaactcctgggctcaagtgatccttgctccatggcttctcagtgctggtattacaggcgtgagccactgcacccggcctgagtgattattttctaatgcaggatcatatgtggtccattctctctttagctttccttcatttggaactgtgtctcaatctttctttacattgacatttttccaactgcattgacagtacagactggttctttggtagaagatcagccgatcaggctgtctgatgtttccgtgtcattaggttcaggctgtgcattttgggcaagaacagcccacaagggacgtgtgtctgatcaggggcacctgaggtgtgcatcttggggtgtgaacttgatcacgtggtttgggagggtcccccattgtaagctgagcatacaaatctctgtaagtaataactggtttgcgggagactcttggagacatgcagatgtcttggtctccarcaggcagacacgcacttgtctcagcatccacagttagctgtctggtggggacgatgctgattttctaacttctcccgtccttccacctccttccacatttaatacttggccttctcctgggagggccgcttcccctttccctcagtgagctatgtatggatgcctttttatcagcgtggactcaggatttttatttcatccaacagggytgtaatccctggctcttattatcattattgccacttggcctgggagaaaaaagtggctgtgtgccagggaggagaagggatttgaaggcccaggtgtgtgtgctcataggacagctgtggggcagggccagggcacatgttgtcaccccggccatgccactgacttgacctgtagccttggacaagccggcggacaccctagagtcccaaggtcgtcctgctggtaggacaggtggggacaggctgacctttaaggcccacttgtcccatcccatgaggctctgagggcccacgccatcctccctgttgagaccaggagttggcttggggcagttctcagcagctgggctgtcacctctcacctgtgggcgtgattacacagagggaggctccctagctccctgtcccgcccgcctcacttccagcaaggccaccctctgcaggactgaggcctgtttgttctcatcagtaaccaaacattgacctcatcctggcactggctctcccctgaccttcaagtctgttcttgctcatacctttcttaaagaaacacagtcttgtgggcaggcaccagacctgaggcccccatgggcctatgtccatctgtgcccacctgtgctgccagaagggtccttggaagctctcaactcccttgtacagagaggtgctctggggcccagagagggaaagaaacctgctcagagtcacacagcaaggaggtggtaggaccaggagtcatgaactctactccactcactgtgggtgccctgtgccccgtttatgatgatgagcttcgaggtgggacctcaggcatgcccgttggcttttctgagagcccagttaggtgttgatcctgcagaaaggctggagcaacccgagaagaggagcttgagcctgggtggggaccaggtcagacctgggcctgtgggtggtggcttcccattgaccggggtcctcatttgacagcaaggctaacggttcctgctgtcacctgcttggagctggcagcatgcagtgatgtgcgggctgccagcatgcgcttaccccctgcccgcctgccacagctggggctgcagatcacgctgtgccagacacagccctgcaggagcctgcagagggacatgcacactccagtgccaggctttctgctgtgccgggcgggcacactcaggcggaggccttgcctgccacagtgaccaaggctgggtgggggtgtatccctagaaacgaaggatctggttagaagtgcagtgccrtggtggggcttgtgtgctgggatggccacagtcccgggcttggttagaagcacagtgccatgggggagctcgtgtgctgggatggccacagtcctcttcagttactggagctgagggtgtgggctgagggcatggggcaggggactgaagctggggtgggtggctccggagagttcaggcaggaaagcagtgtagacagattcacrgagcaagtggagccgaccacactgggtggcggggagagggtctgcagcagctctgagagcaagacacagtcctgtccctcccgcaacctgcactctcccagagtgcagaatcagtggcttcctgggatgggagaggcaggaccctggaccctctgtcccccaagtttgagcccatctcttgaggtcatggggagaagggaccgtccccagcacagctcaggggagctgttcccgtgggtggaccctgccctcagcctcgggtccttgccctatctccgccgcaggggctcagcccagccctgggcttctgtgcagggctttgcatctgtgcccttgggggctcggcatgcagtcattgaacagcctmcctttacagaggcgctgcygaggctgagggatgccaygtgttcaagagccatgctgggtgcagtggctcacacctgtaatcccagcactttgggaggccgaggcaggcggatcatgaggtcaggagttcgagaccagcctggccagtatggtgaaaccccgtctctactaaaaacacaaaaattagccgggcgtggtggcacgtgcctgtagtcccatttactcgggaggctgaggcagaagaatcgcttgaacccaggaggcggaggttgcagtgagctgagatcgcaccattgcattccagcctgggcracaaagcargactctgtctcaaaaacaaacaaacaaaaaaaaaccacacagggaattagtggcccccgtgtgagatttgaacccggagtttgtgcttgtgaagacttttgaagggcctgtgagaagattgtgacattcctctccccatgtcctgagctgcagggctctggcctgggtgttctggaatctatccagcatcctctcggcggctcagtgagggggcctcatccttcccatttacagatgagaacatgagaggctcagagacggtcagtcactggtgcgaggtcacacagctgtgatgtgagaccagtgtttctgtgattacagaggcccagctgaccccaggcctctcctcccttctatcyggcactgctaggggaagcctagggtccttctcccattgagggccacacccccaggccatcccyrgtggcctggggtaaccaagtccctggccagcaggacaaygagctcctggtctgttagtcctattttgggtcacccagtgatgtcacggtgccaagagccatgcaggaagcaccgggttttccaagccttgcccaaggtgagcaggtgacccttgagccccggaagctcgtggcccccttgcggggagaaccttgggtccaaagggcgatgattccagctgcacttactgggtgaaaggcagcctggcctatgggtcattggcagctgagcacgtgaagtggtgacaggatggggagggcctgggtggaggttggcttggcaacccctcccacacctcagacagcaacagctccgtcagtgccagcaccttcagctggccaggaccctctccagaagggggctttcagggtgcctggccttccctttgagaggtctagagagtctgacctcgtcccaccggactgaggggacactgaggcttgggcagagacactcctgcccaacacactcagccagcacagacctgctgactctgtgcccaggctctctctgaagcactgtggggctcaggtttgcgcctccccstccctgcaagggcctggtcctgccttgctggggtcagtctcatgaaggcccccagagacccttgtggagggcaggtgtgtcagcctccgcagaatgcttgggccgtagggcaggattgcagcacccctagcagtgtggcccaggtcctgcctacctcctccccagtggtgcaggggcagctagagggggctcacagcctgatcaaccttggggctttttggggcgcaggctagccgggcctgggaggagcttcgcctcctccactccttcctgagcctcccacctggacccccaggttccgggttagtgcccacccttgaggctttcagatgagacctccaggttgtctgggaccaaggccatcctccttggcctcctcttagcctcaggtcctcactgccacatgggcccggggcctggaatttacttttcctctgctttcctttcttcttttgggacctggctgctgtcgctggtcccacctgtctgctagaatttggcttgggctgtctcttgagcccttttccctagaggctctgacctagggagggggcttgctggggagtgggaggctgagcctggctggtggactcyggtctcagcctgcrctcacctgcctgctgcrtgcttactcacttgctcactcacctgctcacccatctgcccacccacctgctcacccacctgcacactcacctctcacccacctgcacacccacctctcacccacctgcacactcacctctcacccacctgcacactcaactgctcacccacctgcacactcacctctcacccacctgckcactcacctgcacacccacctgcacactcacctgcccacccacctgcacactcacgtactcacctgcacacccacctgcacactgccttctacacccacttgctcacttacctgctcactcattcacctgctcacctgcacacccacctgctcattcacctgctcatctgcatactcacttgctcackcattcacctgctcacctgcacacctacctgctcactcattcacctgttcacctgcttgcttgttcatgtgaccttccccccactgcctccaatcccgtgtggcctctggcaggatgcgcatactggtggtgtgaacttggtggccaatctctagtgtctgtccagccccagtgctccgtgtacgctgtgaccctcaccccaccccaggactccgttagggctgggagggcatctcctctgccgcatatggaattagcattggtttgtcattatgtcacaagcagctagtggttccagtacttcatggtctacaaaacctcaactttagaatagagaagaggctatgcactgtatgggtgataccacactggctttggatcaccttgcagtgtgcatgcctgcactgggtaatgttggcagtgatgtggtagcctttgctggattggtgatggaggctggtgccagcagcttggtcgagctggacccaggtgagcagtcgtatattggaggagtgtggcctgggcaccccaggcctgttatggtaccgctgtccccatggtcagctggtgctggtatctcggctcagagggcagcgtgcaggcctcagctggcccttcctttccatcaaggtcggacagttagagtgtgagcagtcggggaacagggcagtttttgtgaagtatctgctaagtccaggtcctatgccagggctttcggagctggtcttctcctagtctgcactgcagtctcctaaggttgggtttttatctcatttttaagtgaaaccgaggctcagagtgactaagcaagcaacctaaagtcacacagccatgacttgtagttcttgtgtgggtttcctatggctgctgtcacacatgactacaccctggtggcctaaacaacacacatttattctcttgcagttctggaggtcagaagtgccaaaatcaaggcatcagcagggctgcgttcccttctaggggccagaggggagagcccgcttccctgtctgtccagcttctccccttccccatcttcagtattacagtggccaccccaccgtggtcacatctccctctgagctcagcggggaaaggctctctgtttttaaacattcatgcagttagattgggcccacctggataatccagactaatctcctcctaattttgagttccataaccttgatctcatctgcaaagtcccatttgccaggtcagatagcattcagagatcctgaggattagggtgggggcatctttgaggggttgttattctgctgactacggttcacaagcccaggctgagaactttatccagaacaaggcccttgtgttgtcatttggggaaactgaggcccagtgtgtcatggagggcgctgccagggctgggactcctgacccagtttcttcccccrcactacactgcctcttctgaacagagatcgcagcagccctcacgggcacacagcttgtgttgtttgcattgctcagcaccaattatctcctcttgcaacatgccctgcgcatgaaaggagctggtccttctccacggctggaagaatgtgtcctccccaggacctctgggaggatggcactattaagccaggcttgttgatgatcatttcggtcaacaatcaccctgctgttagttttatgtgaaacgcgggaagcccaatttgctrtcctcaaactgagtctatctcgcttctaaccgggcaggtccactccgctctgcctaatttcggggacagtgtctcgcaggagacccagttgcgttcctgtcctgccctctgagtcctctgagttatctgggcctcctgccctcatttctctggggcctgggaaagggaaggggcttgtccaaggtcacagagcaggttggggcaaagagggggcctgctctggcctctgtgtgctggtgggtggcttcctaccaccaccttccagccagacgcctgtgaacccctcatctccctggggctctcaactgctgctgttgggctactccttctgggagtgggtggcacccaaggaggtcactgctgggggtgtttgtgggatttccatatgcagcccaggaatggggacccggggaggaagtggtacaacatgaggagtttccagcatcttttctagaacagccgcccagactttcttcctttaacttacttcttattaagaaatagataaaaagcaatragcttggagaataatgagacagcgattactccacagcccgcctttatcacactgtcagcaataagcattttagcttcagatctttgccttttaagaaatcaagcttggcaggtggagcrgaggcaccctgtgtgtcatcctcctccctccccgacttttcccagggagagctgaggcccagaatcggagctcagcattctcrtgcagtttttaaaaatttctcctgcctggcaagcctctaacaatgtgaggatgctttgcagattttcagactttgtagaaatggcatcgcactgtgtgtccctcagtgacttgcccccatcctcttcatgtttttgagatgtatttggttcatctttttgttttgtttttgttttgggtttttttgcttttagtttttagaggtggtctttttttagattgcccgggctggactcacactcctgagctccagcacgcctcccgcctcggtctcccgagtacctgggactataggagtgtgcccctctgcctggctcttgtttgttcatttttatctcgctacagtatttcattgttgggttaaacgacaatttgtctggtctcctggggagggcatttgggtggtttacagttttcactagtacagctggtgttggcagacacggtcttgtgcctgtctcgttgggcgcttgtgctgggctttgtcaagggtgtgagcatcttcagctgcaggaaaccgcgccaggctgctctctgatccgctgcgccgatcatcagcatcccctgtgtggcccgttcttacgtgtgcaccgtcacacagcatgaccactttttactctccgccaatccagtggcatctcattgtcggaattgggtttccttgatgacacctgcggttgggcgtctcctcacagacttcttggctatccaggattcgtcttttgtggctctcctcttcctatacctctgccccttcccatgtatttccttattgatgttagggattctgggtatgatcctttatctgggaggggacttacacatggctcctcccagatggcagcttgttgtccaactctgctcacctagccactctctggcagcgttygtaatcctcatatagtcgggtttcacggtcgttcccttcatggtttgttctttttgttccttgattaagaaatccttttctacctgaaagctcaagtttttatttttctttaaaatgttctctttgttttaaaataatagttttatggagatagaattcacaaactaaaagtatgctatatgtgtatgtatgtgtatatatgtgtgtgtgtgtgtatatatgtatatatatgtgtgtgtatatatatatgtgtatatacacacacacatatacccataaatatatatgaaagtatgcaatcctgtggttttctttttttttttctttgggacagagtctcgctctgtcacccaggctggagtgcagtggcgcgatcttggcttactacaacctccgcctcctgagttcaagcaattttcctgcctcagcctcctgagtagctgggactacaggtgcccgccaccatacccagctaatttttgtattttcagtagagacagagtttcaccatgttggccaggctagtctcgaactcctggcgtcaggtgatctgcccgcctcagcctctcaaagtgctgggattacaggcatgagccactgtgcccagccaatccagtggttttcagtatagtcgcagagttgcacacttatcaccactatctaattctggatcattttagtcaccccagaaaggaaccccgtttccattagcagtcaccccctatcccctccttgcctgcaccagcccctggaaactactcatctactttgtctctatgaatctgcctattctggagattttatataaatggaaacgtacagtatacgatctttggtgtctcacttctttcctgtaatataagaaaagccgaagtttttgttatttttattattttatgatttttagagaygggagtttgctatgttgcccaggctgaggtgcagtggctattcacaggcatgatagcacactacggctttgaactcctagcttcaagtgatcctcctatctcagcctcctgagtggctgggcctacaagcatgtaccaccatggctgacctcaggaaaaaaagtgtaaaattaaaaaaaaagaaatcacaatggggtctcgctatgttgctcaggctggtctctaactcctgggctcaagcgatcctcccacattggcctcccaaagtgctgggattacaggcatgagccactgtgcctggtcaaaatagttttttcacatagaactctctgaccttcctggaactgttttctgtatatggtgtgaggctgagatagagttttactgttttctgggtggacagcttgttgctacygcagccccgttcatgaagcgctctgttctttccccgccggcaccgtggccacacaccaggtgtgtgggtcttttctgggctccaccttgcctctccacgtggctatgttatctttcctgtagagtctggtgcacatagagctgtcttctctgaactcccatcgccctaggaatcctaccacctggctggtgaggatttattcttgttttcattgcctcagtgaaacacagtccagatgtgttgctgctgccagatggaaccgcccagagccccctctttctcttgctgcagggccttggattcccaccactgctctcaccgcagatcaagtgccttccctgagccgctctcccagtgctggctgtgatgacccagccaagcctggatttccctgtttcctgagccgcctccacctgctgcacctcccacctctgcatgtggctgagatgtcccacccctcccacgcctccccactgttcttactaactctgcaggaaagcaggctccggggcagagctgtgggggcagggcatcatccyggccccccagctcttcccacagagcctggcactcgatagagatttggttgacatctagtgatgaaagcagcccccacacactttctcctgaaaccagcaaaattctcccctttatgctaccggggggcttggcacctgcgttctagggctcggtaagggttgtttattccccccccccatgcagacttcagtcctgcgcgattagttgcatcataatccctctagctttttttgcctttgcttcagagttcagctccactaattaatagtcaggggcaggagggtaaagggtccctcggagttggaggctgggagttggatgattggaacagtgaccacagagctgcatgttagaatcacccacagggcgtttaaaatgcaaactgatgcccaggtccctcccctagagtgtccagttagtctcaggggaagagatcagattttaaaagctctccaaggagccaggagggcgtacctttcagcctgatgctgggagctgcaggctgaatgtgatgtgaccgctgtgtggtgagatgtctctccccggcgggactagctgatgtctgcacacagtccagatctatcactgattcccaacttcagcagtgaagttggggttggtaggggagtgtgatgggcattaacagtgccgacacctgcaccaccgtctcacacacacaggtcaatttccagatgcgtgcagcccttgaaggcacagggaaggaattcttttccccttgtccccatatttgaagcaattacacagttttcatttggcttgtcaggcttcccaagcagcggatggagaaatgagtttgagttttggtttgagaacactggtggttcccaggcagatccaaagtagggcacattctagatgaactgagccggagcggggctttccattcagctgccccctccacattgcagtgtcattgggaagcctcgtggcttttcctggaattaaatgctgggtgcccagtggcccctgaagctggggagaggcaggcagctgatgtgtgggagaggcaggcagccggtgtgggagtccccagcccagagcagagtggcccacgaggggacagatgacactgagaggacaggcgtgcactcactggggaaggctgaccggccagcaccaggagatttcattctcattagggcagccgttcgttttcctcttctctagctactttttttccctggaggcactgggaagggtgtcctcggcgtgtttgatttctaatccggctgtggragtgtgagatggagagtgtggggctccggtcatggcagctccgtttttgcatgcatccgcgaggtgggactttaggttcccatgatcccatgtctccgggcatggaggtggatctcaggggaagctggtgccagcctgcaggccatgtgtgacctggcgaggctcagaggctgtggggtctttggctcagactgaaaacctcactaacatcaagtcttttcacatctggggctgggcgcttatctggtgcccttggaggcgaggtctcggaggagagatgggtcaaggataatggagttcagagtgacgctccctggagcctgggccctgaaagtcaccttgcgtcacgaagagaatttctgctctgggagaggggagtcaggctgtcttccaagccccatcccctgcctcagtgggttgtctagaagagtcctgggtgtgggaacacacagacacacagacacacacacacacacacacacacacacccttyaaattttagccctgtttttatgagttctgtgactgggtggttatggagcccctcggaacctcggtctctttgttgggggagtaggtgaaagttgctgtgcctccttgccaggcaaagcttagaatgaacagccctgacaaccatggtgatgatgtcttgagaggcccagggtcagtgcgccagaaccccggggttggtgtggaagctgcgagttagatggagagagccttggctgtagacagacccaggttcaaatctcagccctgcaaggttcccgccgggtgaccttggccttgctgcctaacatcgctgagtctcaggcgccttgtcgatgacacagtggtagcagttacaggatgtccctcgtcagcttggtgtgatggggttgtgctccgtgtgtgctggcatatggtgggtactcagcaaactgtgtgtgtgcgaatgggaaagatggttctcttctttatgccccaagtggatgggagaactcttttccacgcccagggcactggaaggcatcgctgagcttgcagccagctgcctcggcctgcaacaccctgcatgcccatttgtgggctgtgggcactgaggcctgcctggctccatgcagccaccgccaaaagctgtcctcacaggaacccgatgccctctctcaggcctcttgccttcatccataaataatgcccgtttcacattcagcctgcccctccgagagctgtgatcccttccaggagctggtgtcagctgggattggcatggccactgatgctaaggggcacagcacaggtgtacctggacctgttgtggctctacctccctgcctttgctcaggctgtgccctcagctcctatgtgcctttcgtcttccccatcctcacaaactctgtcagagtcctgcttgctcttcagtgctcagctcgagtgtcacctccttcaggaaggaggccctgatttctcctggtcagcacaccctgttctctgcccctctctcctgggctgcgcctccttgctccactctttgcgttgcagtagatgtggttattcttgcagctccttcattaggccaagggtccctcacaggaagggatgtgcctttgaccaataatatactgcccctgcccgccgacccccgctggtcctgtgggtggctggctttgtgaccttgggctactctgagcattccttttttcctttgtaagacggsgttctgcayggcagggtcctgtggagattggaggagcagagttagctcttctggcactggggtaggtaagcagcttcctttgccatactgggaaccttcattgttccagaggcttctgcccaaagaaagactgttcagccgctgctttctctccccctatgatggggaactcaccaccccactggtagcctggactgtgatgaaatcgataactccttttgggtctcagattagaggattctctctgctctccaagaatttctgtcctttggtgaccctttggaatgctgggatccagggagtaggcaggcctggagttgcggtatctcccaagtccctcgagaagatggggccgtccccaggctctggtggctcagctcacagggctctttggtgaacccacacaaggagagcgccccaggcctcgctgggggaaacccgaagtgctcatgcctcagaggtgtagggcggccaggaacatgcagctgcaggacccgctgggcctggcatgcgggcagtggccacctcgggatgaagcagcggccaagggttagtgcctgctgggtaggagggggcactgcaggatgtgtggccagtgtggcccttctgttgcctccagcccaggatgggtggtgctgagctggagggtggggaggactgcctgggaagaggaggccggctgctacccggagcctctaggccaccactccctgggtctgtggctgccactttgcctccttgaccctcagtttcytcatctgtaaactgggggggcctggtcacctgcctcatggtgaggaatgttgaggactaatgtgtgtaagccacacgattgctgttcggtagatgaatgtggttatggacgggtttttctggaatctgcatctccgtccgtgtccctggttcttggagctccccgcagttggtggtaccaagagcactggcttaagagcctggagcccggttctccctggccctgccctgcctgttacttggtgcacctttgcaccttgtttctgcactttgtgggaagtacgtgttcgtttaatgaggcccttccacctcatggagccaccagccctgaggctgcagctgactcctcttaatgaagtggaaggagaaggggatttaatcagccaagctgctgcgctgaacggtggtatcagctgtcttgcacagggcccatggagctgctgggcaggagccccgatggaggccygcggcttggagtggccaggtctcctgctaatgacctgccacgagcctgcctggccccagaccttgcagaaattgaccagggctgggaagccatgccgtagggccttgctcagggggaggggctgggaggcagacctggggagggtgcacagcaactggagagtcaggctctgtgtgtcaccatgtgtcaccatgtgtccctgtgtgtcactgcagctccctcgcccccagcctccaccttctatggagagaggataaaccatattttctcctgagtggtcacagacactgttgatgcccagccctgatccctgaggcacttcctgtttctgagcccacggctgtatcgcctgctggcacctgcagctctgcccaggagcccttcctgtccattctcctcttgggcagtgctgggacgttaatactcccagtgaaccattggacaggtggggtgactccgagccctagagctcaccggcagagtggacaccccttccattggcttcttcccttccctgcctcccttctctacccctctmcctgggtttcctggggttgccacccacataacccacgtgaagttgattcctcctctctcagtctgcacccaacctgagatataasatcatagggaggcgtgtgtgagacaggagcatcaggcaccgcmgagtcagatgcaaggagcgtgtgcccagagcccaggatgctctgccccctgtagcctcggcagctccttgtctggggttccccagcttggggtgcggggtgctgtgtcacatgcatggctgagcgctcctgaggagctcattgcagctactccttctggtgggagatggtgggacggagccagggaggcagctaagaacaggtccctccagggatgagttcctattagggctgcagacatttttctggaggctgactgtgtgccaagtgctgagctagggaaggaaggtcacagaggtgatgggacatggcttctggccccccagttcttactgttctggacacagcaaagtctggaggggaggtggaggtgacatcatcttgccagtgtgaaaaccaggccaggagggggaataccacccagcccctgcctcacagcttcccagaaggccagtgagtcctggtcccagtggcaggacccagtgcagggtatctgggatggagcyggcacagcgccaatggggagggcttggcagacctgcaggctctgtgactccccccaccatgctgcacagctttcccccaccccctcctcatgggagcaagggatccatgaagagggcggggtgaggggagcttaggtctggctcctggacacaagaacgttgtagggagacaccctcctccccggttggcagctggatagggaatcccccagaattggtccgatggcccccagaygggttaggggagcaccccaggggaccccttggccaggccagcccagggtcacctccctcattttgccctcaggcagccaagctgggaaatgatgtcccctcccctgtggctccagcactcattactgtaaaccctgggattaacttaattacccgctcatctccaagaggctggggcttgcaggcacccagtgggatcacgagttttgaggctgccaggaaggacagtcctcccggggagccggcccttcccggggtctcctgccctccagcccccgcctgggagtgcccagatcactcttgttcttcctgtctgaagagtgcctgctcctgacccaagggtgactgacgcccggctcactggctcctggcagcctggagagctcttctagggagctgagtgtggggagagggtcagggtggtgggtttaaaatgtccattgcttcattgggtggccatgcatgtaatgtgaaggtgcaagagtttaatccgttcccccccctttttttttaaagacagtctcgctctgtcgcccatctggactgcagtggcgtgatctcggctcactgcaacctctgcctcccgggttcaagcaattctcctgcttcagcctcctgagtagctgagattacaggtgcccaccaccactcccagataatttttatatttttagtagagatgggggtttcaccttgttggccaggctagttttgaactcctgatcttaggtgatccgcccgcctcggcctcccaaagtgctgggattacaggcatgagccaccgcgcccggccattctttttttctgaaagaaggatttcagaactagactacaagtcgattatttgaaaattaacaagaaacgatgtgaataaataaaaacccactggttccctcatctgagcagccgcacagtcaggatttctgtggacttccttcctgaactcacgtcaatgcctggatatttttaaacgtcgcagccattgtgcatgtcattttgtgtccagttctttccactggcattttaagtgtttttccatattgtttaggagagaaactttctaaacatcattttaatgatgacagggtagaaccctcagctgttgttggacaaatagttatttccagttttggccactctgtctgctttcttcataattataattaattctttttttttttttttttgagatggagtctcactctgtcacccaggctggagtgcagttgtgtgatctcggctcactgcaacccccgcctcccaggttcaagtgattctcctgcctcagcctcctgagtagctgggattacaggtgcctgccatcacgcccagctaattttatatttttagtagagatggggtttcaccatgttggtcaggctggtcttgaactcctgacctcaggtgatccacctgcctcggcctcccaaattgctgggattgcaggcatgtgccaccgtgcccagcctagaattaattctttaggatagattccaytggaattactggatggtctaaaatattttttaagagtgttatgttgttattttgaaatttaaaagaaaaacccaatgaagcctggtggtctgcagtgtattttattctgcatagctgcctggggtttggggtaaacctcaacagatgggtctgtcaggggcagccccttggtctggggccgtgggtgtgtggccacctgtctgtgcctacaggtggcccgatgtgggggatggtagcctgtgggttctgaggtgaggtgctggctatgggcagkcagggcattgctggcgacctgtgggatggcctgtctgcatcccttctccggatgccacctgccagcctgatcactgtctttaacccttactgggaagtgggtgtgaaaccccagttgtatctgagggggcrgactgctcagacaggagaagggtcacccagcgaaggtgctgaggctgacggggcagctgtggacttgggttccagcccatccctcctccgattgtgggctcatggagagggaagtgctgggagctcctygctcaccctgtgggaaccagcagggggaggcgggtgggctgaaagtgcacccacctcctgaatggttctgtggcagcgaagggcagagaacaagttagtgcccatcttgggctgttggtcacacacagtggctgggtcctccccctggctcagggccatccccgggagcacagtcccatgggggtgctgtggtgagcaggggccctgtggccgtgctgaggattgcgctgcggagagccttcaggagagtggtgtgactgggaatggcgtcttctttctgagtctctgccagcttctctccaaggctggggctgtcagctctgcccagggtggccagaaacactgggtcctaaagactgacctgtggcgtgggcctgggtagtggggagaggggctggaaggctcacctgctggtggtggggacactttgttccttgtggcctctgcacctggaaaatgaggatggtagctgcttgtcctttgcaaggcatcagatgcagggggtaccacgtgttccacatgggacagtgggtaccccccacccgactccacccagagggagaccccacacgtgggtccatagtcattggtgcgttcttgtcctagctctgtcagagtgagggagccggaagggtctctggagtttacttggtcactgcttcccagctggtgttccagggagccctcctgttagtagggtacaggacatgaaggtttggggagcctaggctgcaccctacctccccatgctcagagggacccagcacaccctgaatgctgaggcctcttcccatcacaccgctttgcttgggtgggcatgggaactgtttgtcggggttgatagagtaatgagtaaactgaggccagggagggagggatcagggctggtgaggtgtgaggctctgaggtcaccctgagggcaggggtggtctgcctggcagggcggggaggctgggcctggatggggagctgcccttctctcctctctagaaggccccacattcctgggaggtgactgggctggaggaggaggggaggctggtttgcgctcttccccagcagtgagtgcggccgggccgggctccagtacctgctcctgcctgtggctgggccagtggctctgctgggccctaggcctggtccagggctgaatagggggctcccaagcatccttttattggtgtgctgggggcagacagatgcttcattggtcctgtggttggcatggtggtcctggcttgtccccagtagcacccaagcccctgtccccccaggcatgttaacagcctgtggagtccatccccagccctgaggtggtgatggggactagatagctggctgtgtgtggtcaaaggggctgatgtctctgcttctgcaatcgagggtgagcggcatgaatctgggaagaccctgcgtcctgttgtcgggtgggccggtgggtggacagctgtcagggtggatggggtctgggctggcatctgggccaggtgatctctgcgagagatgttaataacccatcccttaccaggtggmttcgtggctcacaggggtacttgggacagccttgcttcccccttgcctcctccttccaaacctgctgttgctgggtggtcccccggcctgtgttctgggtcccgttcctgcctctcctcccttcccccagccctctgccctgagggtttgccctgggcatcctggcagctgagctgactcccagcctggggggaggcaggaccaggggtatgggatggctggacgtgggggtggggatgggattttttygtgttttcctgatgtgactggaaagcagggtcagtgtggtgagggtgggtgaatttcaccctgcaccagtggtctgcatagatagggctcccttggcctgaggtcagaaactggggacacatgaccagggtgttccacggggttcccgactgtcatatggggaaggtggctgctcacctgcagcatatgctgtgggcacacatagcttgtgagaagttcctgggtgatcaggcgaagtggactggaaggatcccagatgctgacttggcaagttcaggagtctrtttccccactgtgtagaggagggggctccccggaccccgaccctggggtgggctgtgccctggctgtgtttgtgagagctccrtttgagcctgcagcatcttggaagctgaaggaattgctccagggcaggctggcgaggccacccccacaccccccacctttctacaggtcctgaaggtcctgagaagggctcagaggcccacagcgagggcagcagcgggtcctgcaaggctggcctctgtgtgtcgtgccttggtgtcaggtgccctatggccggaagcctttggccacaggccgtgctgtttccacagggcgggcgagggctcggaggggctggggcgtcacctggctgtggggtgggactcctcagacccaaaccttccatgccgggtctggggccagtcggggttgcgcaatggggacggagtctgctggaggctaatgtcccccttcctcttgtgtccttccagatccctcatccacctacatcaggcaactggagagcaaagtgaggctgctggagggtgacaagctcctcgcacaggtaggccggcttcgggtggcgctgccttgaggaccgcgacccagcacccacccctccagctcacccagggcacccttccccttgggacctaggctgtccccccaactgctcccactgccacctgtcacctcctggaaagtggggtcagggacctaaccctggctcccacacctctgggcttccctctgcccaaccttccatgctgactgcccagtatgcgagctcctcagggctggcccagggcctgagagggtggacaacacccagttgatgaagaaatgggctgcttcactcctctggcagatgggcagatccaggcaggagatggggcagactcacacggaagcctccccgcctctgccgtgctggactcactggccggtacctccctgggctgggttcccctcctccctcctgggcccgacctcacccacagacagatgaggctgctacccctgtgcagagctgggcagcaggggcacggcgtgggaggggttggctgtaggggggaggtggggttgggtgaggggctgtgcctcttgagtgtggctggagcttggaggggacgtgtgactgccaggacaagggctttccctgctgcaggtggggcaggcgtgggggctgccgagaggaggctatgggcagtcacgcttgggtgttgggggccagctggcttggcgacctctcaagccgctcgctcccccaagcctccgagccctcgtgcgcatccctggcttcatcccagtctccctctccctgcttttcccactgcgccgtgagcggtcagcctgggatacccaaggcgtctctctgggaaccaaccgcagggatggctcagctgcctggccctgttgctaggtgaccagccaggcttggtgccgactgcccagctcaggaattccacggcaccctctctgcccactgggcggctgctgggaggctcacggccccagcagggagcacagctcccactgaggtcatcctcacgtctcacccctttgtgggctgtggggaaggttcccagggcctggtgggattagcagagtgcacgttcctcatttggcctcttgtgaactctcctccacaccccgccccccactccccaccaccatacaggcgcaagtgcacagccaagctctgaatggcaaggctggcttttgtaatttcatgccttgctgtcaggtgccctatggtgaagggctttggccacaggccgtgctggcttcccagggctggtgagggcaggaggggctggggtctcacctgtctgtggagtggggctccctagacgccagccttccattgcagacctggcggggccattgtggttgctaaggagggtgtgtggaagctgtaggcagaagtgacaccaggagaaggtcatggcttagggacctttgctttggagaaggtccccatgcagtgtgtaggagaggcagtcctgcctctgggtggtggcaggggctactgctctgcagagcaagggccaggaccatgctctggtggctgaagctcgggcccccgggtcagtgacctcacgcgtctgccctgatctggagtttctttgtctcattgttcctgtggagaagtgggttggaagctccagctctgaatttgggatgctgtttgcagtgttctttctttctttttttttttttgagatggaatttagctcttgttgcccaggctggattacaatggcgtgatctcagctcaccacaaccctctgtctcccgggttcaagcaattctcctgcctcagcctcctgagtagctgggactacaggcatgagccaccacgcctggctagttttgtatttttagtagagacagggtttcaccatgttggtcaggctggtctcgaactcccgacctcaggtgatcctctcacatcaggctcccaaagtgctgggattacaggtgtgagccaccacgcccggccctgcagtgttatttctatgagaaatgtgttccgcggtccaaccagagagcagctcatggtcctgtttccataaggacaggagtgtccctgatcccttggcccctgcaggccacagtgtcccactggaaaaatacaccccagttcctgaccacggacttgcagaaaacctgcgcccaagcgggctgtggaggagcagcccttcttcctgccttccttcctggggtgccccccggtctcacagggggccctccaccataacctgtgtccacctgccctgcacccacctgtgcacaggtggaggtagatgggagcttcagccttgagcctcaaggatggacgggctggctctgcccagggacctcttcctccccaggcctgctcccaccagctccctgggggtagcagcagggctctgttcacatcctcatccgtgggccaggtctgcagggcaccgacatcagatcctgatggctggggagctgctgacccttgcctggacacaggcttgctggctgcaggcagttggactggaatttagggacagaaacccactgttgcctgcttgttgttacatacaaccagggcgcggaattcagagatcatccagtgcagaaagggttcaaagtattttgtttctttagcagaaatttgctttctcaccaaatgatgcccagtcaagccatgctgctggagtggtcgctgaaggagcttgtatctctgtgtggtgtggcaggagggcacccagggcccatccctagctgctttctcagcatggactctgcagcaggcagaggtcttgccctggggctcccagcaagtgttgtcagggccatacccagtaccctgaaaggaggcagccgtatgctgctggggccttggccccggtgccctgtccccatgctgcagtggaggcccctgaacctcataacaaaggctccaggagctggtggcatccccagagcccatggcatcagcagaaccagaggagccacggctgggtgtggtggctcacacctgtaaccccagcactttgggaggctgaggtgggcggatcacttgaggtcaggaatttgagatcagcctgggcaacacagcaaaacctcgtctctactaaaaatacaaaaattagccttgcagggtggcacgtgcctgtaatcccagctacttgggaggctgaggtaggagaattgctcaaacctgggaggcggaggttgcagtgagccgagattgccccactgcactccaacccgggaaatggagtgagactccacctcaaaaaaaaaaaaaaaaaagaagaagaagaagaagaaccagaggagctgggatcatgggtggggttcctgctggccatggaggaaggcactgctgttctgagccatgcaggagagagagagacagagagacggggtgagggaggggcccttggctctcggcagcagtgggtcccaagcctgcctttggattcctggggcagcttcagtggcgccagctttttggggatccttgagccactttctctcccagacctgtgtttgctcatctgagaagtgggcactcattcactcagtgtttaactgaccacctactatgtatgtggccctggggatgcagggctggcaggccagtctcacccttgttcctgcctgaccaccaccttgcccagcccgcaggacccacatgcacagagaggcccctggaggataggggaggtgaagagagctcgtggcagggcactgcctgtgaggaaagtggtggccccattctcagggaggcgccaggaagatggggtttacttagtctccatcctcctggcctcctgtctgcagccctccctgactacccacaggtggcctggtgcttgccctgagctctctcagtccctgggctgcccacctttgctgatagggtgtcatgacccacccttgtggatcctggcccccacccctgtgggactgtcatcttctccaggacagggctgcagggtctgagtggccacattggtgtctccagtgctcagcatggttgaactgggtggatgtgtcttggggagcctgtggctgatccctgtccagtctccacggccaagaggggaggctgttcttgctcagaataaggaaggcccacttaaccaagggagggcttcagcaggtagtgagggtaccatctttggagataatcaagagatggctgggtgactatgtttgggaatcttgaagaaagagttcrcagccttgaatgagatgctgtcctaagcctcatggactctggctcgtgagattctgtgattctggcatttaaatcttgtcagggaaatcaagttgtacagaaacccccacctctgcgcaaagcagggactcttcctgttggtgaaaagcaggagagaggaatgctcttctctggaatagcataaggtgacgtggctttggggtttgggtgggagggtagggagcctccctggattcctactccccgcggtcccacccccccccccacccatggcctctatttaactccaaaataggtttaattaaaaatgtgccagcatgttcacagactcaattactgtattgctgttcgtattttctttctcatgttggctttaaaatttcatcaacacagctgcttcctccacgatgattcatctcaagactccgtgtgcattcttatttttcctgtggattctctgtgcccagccgggctgggctgggggcggctgtaattgacgctggggcctctcgttaactcccctgctgggctgataaatgaagactccattgtgcgccaaaaaagccagctttacaaaagagcagggagctctcctgatattctctctccctagaccagagggccagcttggggagcgaggctggggtctgggctggtgactgaagggcccccagcccaccctcctcctctcccctcttcccccacgctgtgcccacctctcccctggcctgccacgtaccaaagggctgctgaaagagacccagaattcacactaggcacagatggggaaactgaggtctggatgaaggtggatttcctgacatggatgttgtattcgtctggtagggctgccataacagagttgcacagactgggggacttaaaccacagaaatttatttccttacagtcctggaggttggaagtctgagatcaaggcatcagcagggctggctccttctgaggcctctctcctcagcttgtagacaggctcttctccctgtaaactccaatagcccccgccccagcgctcacctgctgtgtggcttcaggtgaaatcctctctctcccagagtctcagtgtcctcacctgggaggtgatgcccagcgcagtgtgatgtggcccctgggaagcaccccaggcggtcccaagggcctgggatctttcgaggtctggctgaccatgtgccctctgctgtcccttgggcctggcccatccccaaggaaccgctgctctttgtcctttgagttctgagcccttcaaggggcggggaagaggggatcgatctgctgctgtctgaatccatggccaacgcttcagttctgtgtccctaggaggatgggctgtcctgagcccgggttcctccggagatgctggcgtcgcrgtggtccacgtgggcatctctgttggtyagcgtttccatgccttggtagcaggctccaagcccttccctgccctgtgtgtttggcatcttgggttggccgccataccgtatcacctctgtcataggcagtgtagtctttgggtctctggaggactttaaaygcttccttagttgaacctcagagtcagtttggcctctcccttgcccagggaggaaaccccctctttccagccttccagccaatgaacagatggtcagtctcgcaatgtgggcagaatggagacaggaaattccacctccgtgccctagcaccagcagtgtaaggagtgtccaccgtgagccagatgctgggggagagtcaccagggctgacaggccaagtgcaggatgccagtgccagagggcctggttcaagtctcactagtgccacctgccagcagagtggcactgaacaggtcgcttaacctctctgcacctcagtttccccctctgcaaaatggggacactaatggtgtctgacacatacattgttcagaggatgaaaaggcaaattgtgggaaggactgggagtcgggcggttggcggtaagggtggcgggttaaccaccgtgatctttcctgtccattgtgggccagccatagcctccgccagcctccgcctgatgccagtttatgtgcaaacaaacagaggcccrgaaagttgaggagctgctctggcttactcagccaagrtaggatttggttttgcaaatccgcacccctcagctgggcgcagtggctcacgcctgtaatcccggcactttgggaggccaaggctggcagrtcacctgagatcagaagttcaagaccagcctggccaacatggtgaaacctcgtctctactaaaaaatacaaaaattagctgggcatggtggccggcacctgtaatcccagctgcttgggaggctgaggcaggagaattgcttgaaacctggaggcagaggttgcagcaagccgagattgcagcactgcactccagcctgggtgacagagtgaaacttcatctcaaaaacaaaataaaacaaaacaaaaaaacaaaagaaacaaaacacacacacacacacacaaaactgcacacctcaaagctcccacaggcctgtccctcacttacctcactggaacaagtaatgggcctgcagagggacctgggaagggagggatggtctgcgtggtggacaagactggtctgcctgttaccctgaatggcacatacacgtgagtttgaaaaatgggatttcgggtgtgaaatgacatggggaccaagggaggagcagtgccagccatgggtaagtgacatcagccacacatggccgcaccttcatctctactgcctgatctgagtgcagattgggaatatgtctctggacccccagctgaagcggcagcccccttgttctttttttattttccttttttttccctatcaacttttgttttaagttcctgggtacatgtgcaggacatgcaggtttgttacatgagtacacgtgtgccgtggtagtttgctgcacagatcagcccatggcctaggtaataagcccagcatgcattagctcttcttcctgatgctctccctcccctcgtccccctaacacgccccagtgtgtgttgttcccccctacaaatgagttctctcaaaattaaagaagaaaaagaaagtaaatccagttggtatgactgtgtagctcttgtgggcgaccttgcaggtcatctttgccttgaggctagaacagggggccagatagggcgtgcatcccccacctggcctctctgagctgctgggatcttggggtgcctctaggccggggcaccccatcccagggcttctcaaaggtttgcttttccctgggagggtagcagggcacttggggtggctccaccctggtgtgagttttggggtgggctatggggggtggtgggtgctcctagggacccagtgcygggcacatggcaggtcttcagtgagtccttgtgaatctggagtttctgaagacgtggagctcctggagtcgccttggcgagccccaaccctggccttcggtgtgggaaaaccactccggctcagctgaggtcctggtggctttgggctaatagatgtccagggaaggcactgggcagagtgatgggcatggttggcatttactgggtgacactgttctccttccttctagctgccccgcccctacggccgcccgagaagctggcttcaggtaragctgcctggtgggaggcgtgtttgcagtggtgtttgtgggggtcgggaggctgctttgtgtgctgtgmgctgctgtgtgctctgtcccctactccccagcaccctcccgttctttcctgggagcacttccttcccaggctgcgctggccctgcctttagagtcttcttgggatctgccctctcctcgagctggcattactggcgaaacttccagttttgcaaaataatagcaagacagtgatgcagcgaccgcccccgagggctctccgtggtgtgagccccttctcacgcaccttgcccaggtgcccggggtcctcccgcctctgcagggcggcagggctggtgctaatccccactttgaagtgagacacctgcagtgcacggagggagaagaggcttgcaagtctgcatgagttagtggagacgaggctggggcccacatgcccacccagctgtggctcccggtgggaagctgcctgggtccttgagggaggtctccagggctgctgagctgggtgggcactgggctgagggttctgcgtgggttgcacagttctgagggtcagcatgagtcaccatgccaggcaccctgggctgcagccagatccctgctggacagggcctgggactggggagctgctgggtgaactcagctcccacctgtgcccagcctcgagacccgtggagccaggccctttaggcactggccactctcctgccagctctcaggtctccacatggtttcatttctgtccccttctccccgtcctgagactgcccgccccagaatacctgccccgcattaccctccgggggtcttccaccccatgcccgagctgacactaaaaagtgtctgtagacactgcgagttgtcctctgggggcatcacccccatttgagaaccagtgaccaactgtgtgccagccctgggcttgggctgggaggtgaaccacacctgtccagccatgcagacagacgataaaccaacaacgtcrttacacagtgccaagtctacctccccttccagagcagcccacaggcatgactgacggacgtgtggacacaaacctcctgcgtgccctcgtgggaacaactctggtgcagttcccgtggggtcaagttgaggcctgtcttctgtggaggcctctgtgctacgctgcacagccctgacccctgccctgtcctgcatcctccctgctttctctgcactctccctctgaggatctccgagacggatgacagctggatctcggtgggctttagtttggggccggacagtggagcccaggctagtctgtggccccagctgcccctggagctgctggggcccctggtgggagaatggtctccccaagtcacgcattcgagcctctgcttccaggtgggtcccccagcccagccagctgagggtgcactgtcttccagcacttcctgggtggaggtgtcagcctgataggccactgaggccctgcgtttattactcggcacccagaccattgattacgcatcactgaccaaccctgggagctcccacagtgcttcgtcttcctggagggaggtcgccaggtcttggggacggggtgttccctgggccctggccttgcccccacttcctcttcctggagggaggtcgccaggtcttggggacggggtggtcactgggccgtggccttgctccctgggtctcacctctcgcctccgtagcccctgggatgatggcttatctgtgggagtgggattggtgggaaatgtgaactggaaggagctctctccagctccctgtcctccaacctggctcccatccyagcctsgggactgcacagtgaccacggggacctggagaccatctyagcacacgctcagggcagaggcattgttagtgcctgcaggagctgcacggggcctgggctcatgtggctttttcctgcccaggttcccattgctctgagggtggatgtaggcccctccctgcagacggcaccttcaagctcttcagctgcggtgaaactggcctcttgtgacagatcccctggagcccccacaggccagaagcaggagggcacctgacccaggagagtctgggctgggggaggcctgtgttggggtcctctccctgagccccacagtgtctcccaagtcagacacagtcattggcatgacctaaatttgggagggggagagggatgtggctgcgttgctgtccactgtggtcctggaccctggccacacctggctgtccggctgagccgagctgtgctgtgccacacggtgccaagggcccatgctcacctgtcagccatcctggagggtgctgaggagggaggagcctcgcaggtccccacccatccctgcaccgagcactgagacaccggtccagagtcgcgccaggtggcccctccacgaggactccttcccagggcattctgtatgaatcagcctggggcttcgagtctggtggtccaagtggtcacttgcgggcaggctgcccaggtggggacacagggcaccccctcttcagtgcctgcctccacccgcacccccagccctcactcccctttagttgctgcctccctgatggggcacggcgtggtgcctggcacacaggaggcgctctgtttgtgcctctcggacacataaccgatgcagcacatttgagggcccaaaagctctctgggagcaggaagcagggtgacagcagctcccctaagcacagcccagaaaggcgcttcctgcctgcagccaccccrcccatcctttccaaacaagcagcctcaggtgggcaggctggggtgggtgggctctgtytccatgtcttatcctctttctgttcagcatcccctctgacaatgctccctaggggtcaccccagggtggccccacataggccccctgcagctttgcaggcaggcattcrctgcaggacggggttcccctctggggagaaggctgggcygcactgcagaggcccagaaagggctggggaacaactggagttcacccagcgagtcctcgctgggccccaagtcgggcagtgttgcagtgaaggccctggatacaggctggaggtgtcctgaactccggtcctcagtggaaaaggaggccctgcaacctcctgggtctcttcctccctagtcyaggacactcrtgctgccctctggaggctctagaagtgagtaatgcggattgggcctggccagggtggaaggggccacgctgagtgtttggcagggctggccccaccctgttaaggattcgggaaatcttgtttgagctctgagctggcagctctgtgtgtaagatcccttctccctgggtcctgagggagccacccgaggaagactgggcaggtgggtgtttctggggagcggcagtggacccccygcctccccctgwggaagggccagcaccttccttagctggrgctcttctctgtgtgcagaacaagcccagcaggtgatttcagctcctgcttyccctcctcggggaaatcctagggaatctcattctgcaaaggcagcgacctgtctcatagcaggatttttaatttggatttaagtgcaataatggttactcatttgatgcgccattagtcacattgccccttaatgagagattgtgygtttttcctgcctggctttgtggcttgctaataaagttctatggacatgcaaatgtttatagaggctcaccgaaggcaagggtgggaattgcgtgcagctaattaaaaacctccctcacgctcacgcacacacatctcctcccagggaaattatctgggggaggggaggggacggcagcacaaacctgcgttttcggtaacagcacgtgggagcccatttggtcgagggccagagaggatgtggaggaagggacgccggagtccaaacagaagctgagcagggcagggcagggccggctgaaggggagggcagctgttccaatcccaggtgtacccttcctggctgtgtggcccagtagtcagactgtgtgtatgtgcacgcacgcattcagagtgtgtgctggcttagaatgccattctccattggagaagattttgtaactctcttactgttgcagagtcctggccaagaaaatcaggtggtttggaattttcgcccttaagtggagctaggggtacatctctcaggagaggtgacccagrgaggcatgggtggctctgatggggtggggggaggggtgtcactcatggttgggggagggtgagtgctgggcctaggggtgggggctgtagcctcttcctctttttggtacctggtgggtggggagggggctttccttgatctgacctccacctgcgggccgtgagtgcctctagttaacctaggcagggtcagccagggttaatgccgtggtcagggcatggcagtcccatttgatggttcagggctgtgcccaaggcccccgtgctgagacccctttgtgatgctcgccagggttatctaaaacccatcacactttgggggccctgcaggaaggttggttcccacttctctgtctctcctttatgtccctccctgaccttggaccacacccaggtcctccctgaggcccaggaagcagctcccagcctccagtgcccggctgccctggctgaccggcgtctggtgggcgtgggctatttaatgaggggagtcagtgccggatccctgctttcctgtcttggctccgtgggagctggtaatagagcatccacttgcctcctcacgcccgcaggacacggctgtttgctggcccttgagccaagctcttgagacctcccagccccagtggggggcctggccagggctctgatggggctgggagaacacaagagctggacctcagtgaggctggggcttgtgagaagtgcggggccaggtccagcttttgagggaggcaagcagggtgtgtgtgggatctttcacagccaggccgaggggctggtgagtggaactgggaccccagacatggctgcagcctgtcctgccttccttgcccctgccccagcccagccccagcctgggcctcccctgcccctgcagtttgtttgggtaactcaacagcctgctgatttatgggacattccgcagggttttatctgcccagccrctttctctcagttcctttgaagtagaaaagggtgtttcggccagaaacacccaaaaccctttagtgatgcagaaagaaaagaaaggccgggccttctgctgggccgggccaggggaggggcactgtgggactgaccagagaagtttatgggacctgtggattcattctggctcctggtcccagccccagccccaaattctgggggtcggtggtgtttgctttgctyttaagcaaagggtctaaggccaagccttcctccctccctcctgtgtgcaggagttagttacraccccacagcttgcacgagttctcagggattcagaggcagcacccaggacctgctttaggagctccctgcccatccgatgggggaggcagcctgggcggagcatccckagagagccccgaacccgtgggaggtgggaggtgggaggcctcgcctgtggatgtggccccatctgctgccgatggctggcccaggccctgtgagtggtgccgtctgtgcagggacccaagggcaggaagttggagcggaggagccagggtgagtcacggggtgggagagacactctctcctcactcgctctcactggctcttcttcattcattcattcattctgtttattcagccatccaacaaatgtttacaaagcccacgytggagagtggatcgctgacatttgagctggggagagtgaagatcgattgatcccggctcgggggayggataagcggtgtggaggggagggtggaggggtcctccggggccgtgcctttgagcagcccctgctgccgtgaggagccatgcccagggcccttgtcctcctcagcctggccctccgtctaacccctctccttctctcccctgcagcaggcaggctccggagagttccgcacgctgcggaaaggcttctcgccctaccactcggagtcccagcttgcgtccctgccgccctcctaccaggactccctgcagaacgtgagtgtgcaccccaaaaaagcccacatgttctggatgaggggctgaggctcaggcgggccagtgacctgcccggaggggcacaaggatctgggtgcctgagttcagccccagccctaggccctgtgtccgtgtcccatccagtgtggcagttagaggcggagccccaggtgggttgacactgctggaggtgcggggcagtctccagaggccacgtgcgcagggctgcccgtgcctagcccctgtccctctgagcagctcattagcctgtgccactccttggccacggtggggagagggtacccggccagccctggagcttggggttcaggtttgtggattctgcactgaaatgaccagcctgatgcctccaggggtatcctctgcccctacctggctgacctggcctggagggaatggggtgggcggcttggagccagctcccgggaagtggaacctagctcaggactgtgccctgtagatagatatgatggcagtggggagccacaggagtccaggcccacttgccctcctaggactgggggccttgccttgtgggacttcacgcctccaggagccttggtgggtgtgtagcggatgcttgggaagcatcggctgttctcgttgcggcacctgcagagccgtgtatggaggtgcttcttgggcagcacgtgcgcttgtagcagctgtgccccttcctgctctctyccctgcaccccttgcccacaaggctgaccccaggcccccggtgcagagcttgctgggcctcagtgctggctgctggctctgcgatttctcttttgctgcccttccaccttctccaggaatgcagctgtagagcctgtgcaggcagcaaagcccgccaatggccgatattccaagcatttatccggagtcccgtggctgaacgaggctctaactgtttcatggtggagggctctgaaaagccaagggatgccctcacggggctggctccttagtcttcatgccccgtgcctctcattcattcagatcgtgggagggagtaatagcagctagcagttactcagtgctatgtcctgaagtcttccgcgtggcctgcaggttgggaagtgctgtgcaagcacagctctcacatgtaccaggcccgccagatgctgtctccctgcaggcctctggagagcacacctcaggcatgggccgagcctcaaggcctgagagtgcggataaaatgctgtcagagttcaggaatgttcaggaaggcttcctggaggaggcagccttgggaaagggtttgttcctcttgcctccttttttcctctagactgctctgtgcatgaaggggtgtcccctactttggagaggaggaagtgaggctcacaggggtggggtggatggccagggccccatggtgagtgcgtcctggtgcctgtgtgtgcctagaggtcaggggccagcgtgggggctgtgcaggggtcgctcctccatgaggccaggaggccgggtgataaactgaggttcaggggccatgatcagggctggtcggcgggcaggcccccaggagtgggatgaactgaggtgcaggggccgtgatcggggctggtcggcgggcaggcccccaggagtgggatgaactgaggtgcaggggccgtgattggggctggtcggcgggcaggcccccaggaatgggatgaactgaggtgcaggggccgtgatcggggctggtcggcgggcaggcccccaggagtgggggttgaggggtcaaggtatctcgtgggaggggccgatgaagcctggagaagtggctgctgtggaggggccagggccagaggcccttgctggggcctggagagcccatgtctggcacttggacccccggggagagtgagggggttatccagagagggccgtctccgggctcagacactgcctggcacacaggcccttccagacccaggcaagtctcctttaaggctacctgtgggtcatgggcacattgagggcatgctggagagtccctgggtaaagcaggtgactctctggggtggacaccccctccctgcccactgctgcccataccctccatccactggctgtcagggcaggtgcccagtggagggtgggaggtggtttatacccatcagcctcctaagggaggacactcagacttgtgccgtcatcacagtagaacattttcatcaccccagaaagacaccctgtacccatcggccgtcactcccgtcccccttcctcccagccaccagcaaccaccgactggttggtgctttctgtttccacggatttgccaattctggatatttcgtataaatggaatcacatgacgtgtggccttttgtgtcaggcttctttcactccaaatcttgttctcagggtccagccacaggtaccctgtattggtcttcattgcttttcatggctgaatactattccattgtgtgggtggaacacatgattccttcatttgttgctgtacatttggatcgtttccatgtttgggctcacatgaatggtgttgctctgagcgtttggcgacaggtattttgtggatgtctattttcagttctctctggtgcacactggtatcctcactttgggcaccagctcaggagtcccacagacttgggtttggcgcccagccccattgtttacaagctgtttggtcttgggcaagccattctcttagcctcactctccttgtctgtaaagtgggcatgtaggccaggctcagtggctcacgcctataatcccatcactttgggaggccaagacaggaggattgcttgagtccaggagttcaagaccagcctgggcaacatgatgaaaccccatctctaccaaaaaaaaaaaaaaaaagctgggcatggtggtgtgcatctgtagttccaactacgctggaagctggggtgggaggattgcttgagcctgggaggtcaaggctgcagtgagctgagatggtgccactgtacttcagcctgggcgacagagtgagatcctctcactcaaaaaaaaaaaaaaaaaaaaaaaaaaaaaaaggcatgtatgaacatgtaaaaagatagtgcctgctgggagcagtgtggcaaggactcagtgggcccatctgccctaagtgggtacctagtcagtgggaggtgtgtgtggcccgagggggctgagttctagtacagttgggggcccctgcaccccgggaatgccctggaggtaacactagggctttgtctagtcctggtgtcactttcaggatcccgggccatgccctcgctggcacccaccactgcccagtgaggcgggcaggagaggggcggcttgcacagcccacccccacgctcctggcttccctcctgcctgtgctgcagaaatcccagccccctagagccgggggctgtaacaggacaggcagcccaggggcctggtgcagatgaggccagaggtgccaggggccggctggcacatggcctgtgttctgcagcggaaggtgcaggaaggtgtaggtgcccaggtctcccagggccgtatgtgtgcgactggcgccccctgctgtctggcgcggggagtgccgccttgcgttgccccagggggaatccccagcgtccctgttgggttccctacactacagagacccaacagcctgggctggagttaggggtctgcacacaccctggggcagaggaccctttctattgtccagacgaggaaaccgaggctcagcgtgggttgagccccacctcaatgacgctttcctagaccccagggctcggggggcctccggaggtagcagctcccaggccccctagcctcaggggtggggcctggtctccatgtggaggcgggagccggtcaacctgcaaggccctgggagcaggtccaggccagggcgggcrgggagggcaccaggggttggctgccaggcctgcagggggttccaggtcctgagggtckcwgaacccagccctgcagtgttaggtggccccatgatgcaggcctgggtgggtgggattccagcccagctccctgagcttgccaggccgttgggaggcgtcatcagggccccatttacagagagggcggcagactcagcttccatggttggcccaaggattgccagaggtgggagcccsgaagatgtcctggaaaccccgcttccagggcccacagggcaccgctgggtgttttctgtctggctctgggcacttgtaagttcctcccaagcctctcccagcatcttgtgacctgctggtttctgttgggcccctgtggtccccactgcagcccgaggcagaagccctgcacctggcttcccagccacatggacccttccaggcaggaagctgggggtgggactgcctgcccctgggtagacaygcagcttctgrcagaggctgggtcccctccccaaggcctgatgtgggagctgggcayctggcagccaattcatcccgcagggctgggaggtggcagctgggaggcaggccccagggagtgctcagggcgaagccggcctcrcccaccggtggctccagggtgggcaggggaagggagtttggagtcaggtgccagggttaagtccagaccttcctggtcttgctgtgatctgggtctcttgccctccctaggctgaacttactttccttgcaaaacagacgctaggtcttatctgtggggtgttgtagaggagcctgagaggtgtgggtgggccctggactgcccctcttgcctctgtgctatcagggaccatttcatctgcagaagacctggtgggygggactggccagactggctgtgggctccttgggtctccatcctcacacctgcctcctctgcctcaccccggtccccttttcctcctgcctgggccctggcccctcagaatgggggccttgtctgagccaccggtcattcctgtgggagccagccagggtgagctgagatgtgtgattgccttccccagggcccggcctgccccgcacctgagctgccctcgcccccctctgctggctacagccctgcaggacagaagcccgaggctgtcgtgcatgccatgaaggtgagggccactacccgctccctcagaagtcctcagaygctgggtgcactgtgagactgtgggacctttgcacctaggggtatccaagtggcaggggtgggaggtttcatctgtgtgtgggtggctgggtgaccatggctgcctggagcactgtgaggttgaactcagaggtggcagtcataagtgtgtcacctgtctgccatccctgagctactgcacctaacaagactgaggcctggggtcggggagggcaggcacccaactaaggccagagagagaggggcaggagtggggctagaactaacctcaggtctgccaggcccagcctctgcaggtgcagactggtgagtccgatgggctccggttcctccaggctgtgcacacctgagcacagtccccactcccatgccccycttcctcctacgtacgtgccccatgacatcccacatgcatgcacggccacgcctactcacaccccctccacgtggcgagtgcccactcatctccagcgggccctgggttgsagtgagtccacctgtctgagggtcttccttgcccagcctgtctacttcctcccgggtggcccagccatgagctgcttccctygtagggcatccagtgtcagcagggtgagatgacaacctgcccctcagttttttccacgcttgtccccaggggcccagcggctcagggtcctcagctttggttcgcagcaggggaggctgaggatcaggggccaggtgacttgcccgaggtctgccggtggcctctgcccctgaccccgagacccgttcccttcaggtcctggaggtacacgagaatctggaccggcagctccaggacagctgtgaggaggacctgagtgagaaggagaaggccatcgttcgcgagatgtgcaacgtgaggcttccaggggtggggggcagaggcttggcactgggagtgcgaccagggccacccagcatggccatacccttccccatgtgggactccatttctcgaatgctcagcgaaggctgggtgaccttggatagctggggggaggcctcagaggtgctaggagccctggcccgttgtcatctcgctgccccctgcccttcccagagggcccctggtgtctgcagatccgccctccccaggagtgccgtgcctggggttctggatagagcttgagccccccacccccccgggactggtttgttcaccccaggtgttccctgggtgctggcccccgggcctctcagcttgctggtgccccctgtggctgctggctgggcagatggtgctcagagcaggaggtccaggtggaaccctccagcccaccaggctggggctgcccaggagagccccgtgcccgacccagctgagcaccatcggcggtctccttgggggtgcttgcaggagccatcrgggaaggagtttcatagggtctgaacccarracttaaagggggggcgagaggctctgaactgtgcagcccctcccccgcatcacctagtggggcctgtggaccccactggacagctgcaaggctgagccacaccccagcagtgacctgctcaggccygatagttagcgcggcatgcaaagacctggtgtgggtgtctctgggcctgcagtggcctccgtgtccctcctggccccatggctctgaggacgtgggtgattctgccgtgatgaggcggcggatgtgcataggcggcaggtggacgcgggtgagtcccaccactcacatctctctcctctccacaggtggtctggagaaagctgggagatgcagccagctccaagccctccatacggcagcacctgtctgggaaccagttcaaggggcctttgtagggccactcttctgtggacgtggactggccctgctgggggtccccagggggagtttcaggccccagacacgggcaggacctccagcccagcccctgtcttcttcctctgtrgtgaactgtacataggacgctgcccgccctggcccagctgccatgggtccgatgcactggcccaagccgccatctcccgcctcatacaccagcaacctgggaagacgagacgctgcgactgttcctgcagcagagcggcccggacgcctcattccccctctgggccctgggctccatgagcaagaggctgcaggctgcttctgagatccagcctgggaactgtccaggctcctctgtcctgcctgggatggaggggccactcatcaaaccctctactccccggctrccacccacactggacagagaccaccactacctgggtcttgacgcaggtggcaccacttcttgcccaaatgccgtggcctggscccaggccccccaagcactgggtccccggcatgtggacaaggccactcaccacatctgtggctggctggaggctgccctgggcccttcctgtgaccctcagccttggaggtcagggtgccctcacacctggggatctgtgctcagccacccgatgcccgctgctccttgcttttggaggtcatccccctcccccccagtctctgcaatgtccccctgccaccctgtccaggctatgcccttcttgggctcctcctgccccatgcctgaggcacgtcccttttcgtggtttacatgacaggccagtaacaggaagggcctggggagagtttctgggctgagccacatgtgattttcctgatgggcagcactgggccacagctggggctctggttggctgtgacctcccccagggcctggctgcatcttgggtccctgtggacagagctgtgtaggctgcagatgagagttctgttctttttgggaaggagcgtgtctggccaggttctgcctttagtttgtggtgtgacctttagcagttcactcagcctgtctgggctcttggtggaaacaggtctctgaggttccttttcggccatgcttatggctccaggtcatccagcgccacagggcaggggtcctcactgagggggcgtgagccaacagccgacggctgagggcgggccgggtggagctgagttctgctgccttgcagtcgctgcgggtggagagttgcctccccactctgagcccgtgtcctcagtagtaaaatgggcagcataaggccctcctcacaggattctggcatcaagtgagatcttcagtgtaaatgaccatgtataaactgtaaagtgcaatagaaaactgtgtgtgtgaggaaagtaaggcctagagggggtgatgtgtggcacatgacaggwdwgatcccacagctgcagcacggggacaggccgcttccccacatccgctcatgccactgtaagcagccctagctcttgggtccaggacctcaccagstcctcgtcagactcctgtgctcttccaggggctgctcagccccacctgaagagcccagagaggctgtcttcctacccagcaggtctcatgcaggcccagggctggggatgcaggcaagaggagggagatggycgccctgtccctctccctagctggcggctctattctgagcagttcttgctgcccgtttgctctcaggggaaaggctcacgccccccatcttagccccargggggtaagtgggtgctggtgatgggatggtgtggcgctcctgccgtgggtgttgccaggaggctctttgggaaggagtgtcgcccrgtcaggtggtgcgctcccggtcactaggggtgtacacgtgaagttgggtgaacacctgctgctcatggtacccagtgattcttgcccgagtgggcagctgagcagaggcccctctgggtcttgcagtccaaagaaccgcagagtagcccaagggctgtgggtccattttgagtggcagccaagtctgggagcccgtgtgcatcatgtttgggtcaggttggcgtggccaccactgaaataagcaataagtacgggctcctggtacctgcggatctcctgcaaacaggcccagagaacagccttgaagccacctttcccctcaaggggactgaccctgtctttaatgctgcagtggcatccagggatcagtggaacattgctttgagaaccctcctgctgttacggaggcagcacaaagctggtgacccctgagccaacacggcactgggatggctttctaggacagaaccctgtcggcgactgtcacatctcaaactaatagctgattttaaaagccagcagcagcgacgccatgtacctgagtacaggtggcagttgcagagccgtgggctgtagaaggtcagatggggcttcccacaggggaaatctgggcrtgctgtagctcagggtgactcccagctccgtcactagcagggcgacccccttccttctggagccttagctctgaaagcccccagtgggggtgccctttcagatgccccctttccatttcaaaggctctgactcttgatcttgaagccggacgcggcactggcactcggcttcagtttccactgtgacagatggaggtctcctttcgccccagcccaggtggccaagcccatcctggcctcagaacatgctgagcacattttgtagggtggcacctttttatccaagttactagctacacatcagtgtttaaagagaaaaaagtgacctttcattttttttttcttgaaacttgaggaaacaagatacatactactgattttttttttttcttaaaactaaatgcatgactgcagagcggtagaggtgtatatttttcatactgtggggcaaagtatttgtgctgctttttggagatggactggaacgtctggtttctgtccccgggcccggcagctacgtctattttctgtagaaggtgccacagtgagacctggagccaccccttcctgccctggcgccgtttagagctgggagcccgtggactcccggcctgtttctaccttctattcaaccactctgacgtggggagacaagaagaaatagaactttttkatagtgtggtaaaaacattgatttgaactattttagtaaaaggagtaacaaacaagattgtgatagtgtctactttgagctagataaataaaggcctctttgtgagcctcctggctgggtgctcagtgcttgtttctgtcgtgggtggcagggtcagcaggcagagacagggccaaggcccctcaagcaccgcagatgggggctcagtcggggccccttccacagacagagccgtggcccctcaaggtggacagtgaggccgctgctcctccagctgcctctgtctcatcacaggccagaagtggaaagggtttcaaatccaagcccccgggttcctgtgtgygttctacgcagcaaggcttcaaagtttcaaactggtttggaactcaaccaggtcctccaaaggaaaccaaggcaggcacaggatgggggcaggctggcttggcaggcagctgtgcggatccacccagagtgccttgggaggcagtggggttggctgtggctgctgtgagctgcagccaggcctctcccgcgtccccagggtctggaaggagggcctctgcacattttataagccacagactgcgaaggcctggagccccaccttccacccataacaaagaaagggatagtttcagaactgcttttatttggataactgactgaaggagtctcatttgtaaccaagatggaattcacagtatgttgttacattcacacttaaaaaatatatctctatgtacaggaatttgcaaagagatgtaaacatacattaatttccaagtacatttctccccttctccctggaggaaaaaaaaaaagccatccaatgaggcaaccccttcaaaataattttaatacaaaggatgcaaacatctataaatgaaaaatgtggttcttctgccccttctgggtgtcatgggagagaatgtcaccgaatgaaaatgacaacagcttggcttcagatggaattggactatttaaaattgagtttccaggaaaaataggcactgatttctagaaggaaattaactccttaccgaagctatttattgagccaatatggctggttaacgtcctcactaktataaagtaacccagtgcaggactctcagacattagctgaaccaagtgtacacagtcagactgcaagggcactgatgaggctactctgaaagctggttgtccccgtcctctaggtgtgaggaccactctgattttatcccaggggcccggtccattcttcccatactgcaactgtcgtgcattatacaaggtaccctgctgcttacccacttcaactactctgcaagtcgattagaaaatcttgttaaaaaaacaaagagggaaaaaaggctcacgttatctcatccaggctgcccgccccagccccccaactggaggcatgccgggtgggggaatgggcgggggcacaggaggctgtcctccaggggggacggcaggaggtgggtagctggctggcggcaggcccaaccctggaggaggatgaggggggactgcgtgggtaggcgggaggcgtgggggtgggggtgggaaattggggttgtaggtgggtgggggtggggggtagccaggagtagggggtgggatggcaggtggggggaaggaggctgggggaggaggcacaggtggcgggggcgggttgggcgggtagacatgggggtggtagggcaggtgtgcaggtgggccgtaggcggggggcagggcaccgtaggagggtccctcggtcttcatcatggactgcaggctctggtagccctctccagacatgtaggagctggtggtggacatcccggtcatgtagctggaggggggtgggggcgggggccggtgtggcagcggcggtggctggtgcacaggggccgggtgggccggagggggaatctggactttggggaggtcagtggcatccacagggcccggcggctcagcctcacctaaggcagcagcgaggggaggcttccggtctgcaggagagagacgcatcagtgcccggcctccgccagcaatggttgctttttcagtgcctcctggcccttcagggccatctttacagaggagcagggagcagctgcccgcctcctctgtggcccaacgcatgggcccatgccccatgtcctgatgccaccagatgtctccccaccatctgtcaagaaggccctccaccctgtctgcgacgacctggggttttccctccctcagccctgaccacaccacctacaggcagtctcggcagcacccgaagcccccttgtgccctggccccagccccctcttcctagtgcaaaacgtgtgggggctcctctgtttttctgccttcagaaactgaccccaggggtcagggccacactgaactcctgtctgcagcagtggcattttgcagaaaacctcagagttagtcaaatgaatgtgatggcacttaaaacaattctgtacaagtctctgacattcccggtgtacccatcgaagcagcaattcaggttctattctactcaagagaggctacatcaaaccccactgtgtgctctcagatagcagcctccttgagaggagtgtgtgcatgtgtgtgcgtgtgcgtgctgcgtgcgtgctgcatgtctgtgcgtgctgcgtgtgtgtgcgtgctgcgtgtgcagcagggacaggcagcactaggtgttgagcacgcccaagatactcgtgctcagaaccagcctcaggcccctcccacagcgcctcccaacccatgagccctcacgcccccttctgccaaagccttatttaacatgttttggcctgtgatcccgggtcaccgtcagaccactggaaaatgacatcgcaacaccccaccacaggtagccaaacacacagaatgagtgtcctttcccaaggcagcccaggagacagaccacaggagcaacatttctggttccagagaacatagagaggacaaagccacgaagatgcttctggttccccaggcacttgggttaggcaaggcacagcacgacatcctggttgggtagacgtggccattggcacacaacccgtttgatcttgccaaagcgagcatgagcaggatttcatcaggtcggtaacaggtgtgccactggtgtgccacatcagcaccccgccagcctaccgggtaggaaggtcatatgtgcctggccttagataactggctttggctccaggtcagggccagatgccctgtggttctaggagctgactaaaaaagaggtgcagaaaagtgctgacacccttcaatgcctcctgtgtgtcactccacagccacctgggcccacaggcctgctcctccaccttgcagaaatcaacttttccaacactcgaccctgtagcctgaatcttcaagtcaccagtgtgcctgcccttgtgctgtgtgactgagctggaacagcaagtgggggtctctcctgggcaccccattccctctctgtacacttgctcctgaccaagtcccacacactgccaccaaactgctccctaaacatcactgctgacctgaatgcctcttcccatggcctagggcctcccaggaagcgtacttccctcccttcctcacggcccagctttactgcgcctcccaggccctgctctcttcagccatggcctcctggcagtgtatctggcacccaggtcccactcaagtcccaggcctactcctggctatctgtaatgggggagggagcagagctctgaggcctccacagcagctactcagtgccctggaggtagcagcacccctgtggctgccccaggctccccagataaaccacccatctcctcagtgaaggcacagccccaggctcggaccaggggaactgcacttggcgaggaggtgctccataaatgcttcatgagcaaccacaggcatttaagtaaggttcatattgaattgggggttttgggatttggccccaaagtggaaaatgacgcctctgttctcccaaagcacaaacactatcatgattgagtaggaacagaaatgtaatctgtggcacatctgttacgggcacacagtgctgtcagccccagtgtgagccacgtgcaccgaccaacagtgagtgtagcaggctggaggagctgctgacagaggcttggaagcctccggagtatcgaccaccttttggagagcaagcacaggtcactctggccttctctagcgcatcaccttctgaaatggtgccacaggtaaagaatgccatctactttacagcttttctcctctattgccagcggtatcagagaggctttccagcttaccatgtactacttgttgagaacttttcactctttcatttactctctgtacaattgcttattcttcagaatgcactaagacgacacactgccaataggaagcaggtgtaggggcggccggagcctagtagccacagtaaccctgcctctatctcagaaggcggggtttggctttctttcctaaaactgattctaatacaatgtgtagtttagcatttctggatgtgagaggtcggaaaatattcagatatacttaacaatttacaacattctcaaaatacctggtcaaaatcagaactttgagacacggtctccctctcacccaggctggagtacggtggtgcaatcatagctcactgcagccttgactgcccagggctcaaatgatcttcccatctcagactcctaagtagttgggactacaggtgtgtgctaccacacctggctaattttttagacagggtctcactttgttgcccaggctgacctcgaactcctggggtcaggtgattctcctgcctccgcctcccaaagtgctgggatcaaaaacacaagccattgtgcccagcccaagaacaattttgcaaagattcctgcctgtggctgacattgtcaatctgggccccagtctcccttttctaagttcccaggacctgctgcgtccaacattcagaggcgatgtgcacagctggccaagctgcttcagcagatgcttacctggaggtgggtgggctggaggcaacggtggatgagtggtctcaattttggggattttaggtggtggtggttctacaaagaaaaagcagattagaaaaccactcatacttcttcacatgaataagcatgtcataaagaaaaatgtactggcagagatttctttgggagaaaaacaacagagatgaccaaggctttaagggaacttgaagaaggtttcagctaaaccattatgcatgaatcctgttaacaaattaaatgccacctccctccaaaagacctgcgagcttcccacaggcagcccattttccatgtctacctaagtttccttgctgaccacttcactcaagtccttccgaccatgtgagaccagcagagcaacgtcttcatgagcatgtatgacctatctggagtcctccctggtacagaggacacaaagaagggtccagagtagcaacatcatgtcactgagtcccctgagggttccacaagagaatctctatcttttcattcttagacatagtttattctctctttcccaaatactgacttccagttggcagcatgtcagaagcagcacattaactggagtcagcagagctctggaggttgacacactgatggcaggaagaatgtgccgctcacaaaagcccagcagtcaggaccccttgaggtggaggaaacagcccacccttccggggtcaggcagcggcacgcagccagaatccacaatgacagcactaggtctccaaggcagcccaagggaagtccaatctcatccgtttaagaaggcagcgtgcacatcacaactgaaaaagaaccctatttttctgtttgcatgctgaggctttttcttcctgaaatgtactttcttctggcttgtacaccactcagatctgagtctcctctgccatcactggcctctttctctggatttcctccatctcaaatacaggctcaatttaagttccagggacttcctctctcttcaccctcttcctcagagtccaaagcccctctctaagtggacaactacaaacctacatttctagcgtccatcttgccaccaaaaccatggcccatccctagacccaccaatcagcacctcacacactaccttttgcctctgtatcctataactgctattactctcacctcagggacccacctcctgcctttttccacagctggtaatagttagctaaagccgtctacatcagggctgtccaacagcaatataactgagagccacatatctacaattttaaactttccaggagccattttattttttgagacagggtctcgctctgtcacccaggctggagtgtagtaatgtaatcatggctcactgcagcttcaaccaaccaggctcaagtgatcttgctgcctgagtctcccaagtagctgggaccataggtgtggcgccaccacgccgagctgatttttaagttttgtgtagtgatggggtcaccctatgtggcccagtctggcctggaactcctgggctcaaagcatgccttggcctcccaaagtgctgggattacaagtgtgccaggaaccactttaacaagaaaaaggagcactccagcctgcattaacagagcaagactctggaaataaaaggaaaaaggataaaaatttatttaacccgatagatcgaaaattttatttcaacatgtaaccaatataaagctttactaatgagatgtcttacgttctcctttcttggaaatctctgtgtattttgcattgtcagtgcttcagaatttgacccagtcacatttcgagtgcttgcagccctctgcagccagtagccttcggcatggcacagtgcagctgagttcctctataaagcttcctccggatctgcccttcctgccccgcagccagcatgctgaggccaccatgtttcccatgagtgccagcaagattctccccattcctaaccacttgccctatttactgctgccaggggactccttctcaaatgaatttagactctgccattcccctgctaaatctccaatggcttcccttgcctctgccaaactcacagtcctccaggtaaactctgtgatctggtcctaacccacattttagatcctatcagaagctattgcctttcaattcatcacattccagaaagactcctctccatttcccctgattctcaattcctttgctcacttgcgtacttccaacttactgctccatcctccccctctgctctcgct

SEQ ID NO: 12278 - DNA, 320803 bp, Homo sapiens
  misc_feature (1)...(320803): n = A,T,C or G, or insertion/deletion polymorphism (see Tables 1-2)
tgttcacgatagctaagatttgaaagcaacctaagtgtccatcaatagatgaatggataaagaaaatgtggtacataaatgcaatggagtactactcagccataaaaaagaatgagatactgtaatttgcaacaacatagatggtattggaaatcattatgtgaagtgaaataagccacacacagaaagacaaattttgcatgttctcatttatttatgggagctaaaaataaaagcagttgaactcaaggagatagagaatacaagagtggctaccagaagctgggaagggtagcaggtggtggggttggggatggttaaggggtacaaaaaatagttcaaaagaacgaataagacctagtgtttgttagcacaacagggtgactacagtcaaaaataatttaattatacatttgaaaataactaaaagtttctaatttgattgtttgcaacaaaacagataaatgcttgatgggatggataccctatttgccctgatgtgcttattacgcactgtatgtctctatcaatatatctcatgtggcccttaaatatatatatatctgctatatacccacacaaattaaaattgaaaaattaaaaaaaagaaaataaaaattgagaaaagaaaaaaaaactctcaaataagtagaactattattttgttttccctccccccaattttttatgtttgtttattatacgatttagaaacctctaattagagaaacctctaatttttaaaacaaacaaacataaagttgattacattagattctaaataacatttttaaaaatgttatttgtccaaaacaataattagttattaattgaactataattatcacacaatatcatttttaagctggttaattaactcttaggatgggtgaagaaagaattaagaaggaacggaagtggcctgagtcatgaagtttagattattctgattattttaattcctcaaagaaactttttctgattgaaatttagcctttaatagatggactttctcatgccaatcatgtatatctcatcataggacaaatactgcattgcggttacctgtttactcatgcatctctggccccatgagctctgtggatttcttggtacaatacgtatttgttgaatggataaatggactgatcagttcgtaaattgagctagactgacaattcaaagaagtcatataaatttggaaaagaaattttagccagttacagaaatgtgactcttacctctatttaatctagattatttaatcaactttatttcatgtttacccaccaacaaaggaaatcacaggaaaaactatgatctttgcatttgctgttatactttattggacacagaaatagcaatattgtttattcctttttaaaatatactctgacagttaaagatactgagaacacatacttaaattactgtgacattatattatcatattataaatatatattcattataatgtattctcaagtcttactcatttttgaggattaatctgaatattacctcaacatgttcagactgatgatggtgatttatacatcatccaacatactaaaaacttagatattctagtgaaaaagaaagaaaattgtttgataaataagactcttacaaattatgcttgtttaaatgcagaaacacattatttaaaagaaaattaatcaaataattgtgtgcacttgaatagttgtatgcatcttaggcaatggtcaatttatttttaaaataattttatttcaacacaaattatttaatctttattaaaaataaaggaaaaaaacctaaatataaactaactagtaattccaccttcttatgtttaaagcaatgattaatttgtcaaccagatgcaacgcattgaaactctatgcttccccaaaacatggaaatatattaataaggactaatatacaatgaagaaattatcaaagtataaattaattcaacttctaaatgtgataataattgttccaagtgcattagtttgatttcatgggatacattttcttttatcatttctctgttggaaccataaaggtagaagtgtcaaggtcaatttttacgtttttcattttgaaagcatccttttaaatctttataaagaaatcagtataaaataaatataaatagcagatgcgtaagtgtagaytgggataaataaatcgtataaaccccaaataaaataatgcagaaagaacataagtgggtttattgaaggagtattagaatataactatttgtatgcagaagtggtctgagaaatcagttgaaaagacagaggcattaaaactagatttaggcaattcagtagaatatcaaacttagttgaaacaaagtagttgaagaaataatatttcataaatgtgttctgacattttctaatgaagaaacgagcaagcataaaagaaagaaaccttactattaatcatgtatttgagttggcttttctttataaattattaaatttccttgagtacttcaaatgctctttttaaggaattattattttttgcatcatttgttttatatttttccataattttttaaattaatattttgttagaattgttttcagtttacaaaaaacatggatcagaaagtacagagttactatatactccccctacacacacacaatttttcttattaacatcttatatagtatatttgttaacatgaatgaaccaatattgataaatgatttttaactaaagtccatagtttacgttagtgttgtgtagttctatgatttttgccaaatggataatgtcatgtatccaccattagagtatcatacagaatatttctctactctaaagatttcctgtgcttcacctactcatctcttcctctcctctacccctgtaaccactgatctttttatggtttgtatagttttgccttttccaaaatgtcatatagttgaaatcacacaggatgtagccttatcagactggcttatttcacttagtgatatacatttaaagttcttccatgaattttcatggctcctttcttttcattgctgaataatcttccatattctggatataccacagtttgtctctccattcacttatgaaggaatatcttggttggttcaatttttgtgaatcacttttaaaatacgagactatacttgcatagccaaatcatgtattgccccaggaattaccacaggatagaactctttgataatctgaagtaatctttcttttgtttttattctacttatctcttttctcttgcatgaaattcaaaggtaaaaaaatttctgttaagtagcatctcactttaagcaaccttaaaatagtgcttcttaaatgatgctccaagtagcatctacattagaatcatcagagttgcttgttaaagttcagattcctgggctctactcttgatgtactgaatcagaatttctggggatggagcccaggtttctatttttttaaacaaagctcctcatgttgcctaccctcactaaactttgaaagcagactacttttgtaatcaagttgtgtttttgataatgtatgatataacatgctttctccacttttggacgtctcaggactggggaaagtaggattcaacttagagtatgtggccaactctttattagaaagaagtactttttacagaaatgtactgagtattagggaaaatattttttgattctatgttgtttctttccaacattctttggaaaaggaatgcaaggatattatcctggaccatttacatttccagcatttcttcatcaggctgaaggtacccagaaaaaattactctagtacctcaaaccattacctagatccacattcttaagaagggcttagagataaatattgtttctttcaaaccaggaaactgttatagttcaatagtggttaatattttgggtaatattttgagtaattttctgcatttcttatattgctatcgtttcattttatttccagcaaaatgtattgcattagaatgtgggagaattcaactgagttgctgattggattttcaaactcatcgcagaaatcacacctttgaaagccaaagctttcatttgtaaaacctaggctttttaagagaataaaagtattcttgaaaatcaaaaggaaaaattctaaaaagcagtacatcagacttgtgtcccaagcaggaaattagaaacacagtggaagatgatgtaagagctaatttttcctccatatgtggaaaacatacatgtacacacacacacacggatggaagatccgagatattagaaataagaaaagagatcaagaaaaatatatttagttgtcctctagaaggctcccatctttgtccttctggattcagagtatagaaaccatgattattttaagaaactctgagaggagaaagagctggtgcattatttcctaaagtgtagccctgggagattgcaagtcttttaaagaaagctatccagtatggtcttcaagataaggaagaagagattaagcaggaaggtccctggacaaaacaaagactttccaaactgagaaaatgggggtcacagaagtgcttagagaaagctggtggaactgaagatgtctggttttcaaacaaggagaatgtagagtgtatggaccaaggtaaccagatgccactgcagtatagcaagtatcaacagctgtggtaggcatgtactgataagaagggaaaaggagaatatgtccagatgaggacaaaaagtgtctatgaagccagacacctgatgcgccaactatatctcatcagtctggaagccttacctctgaaacttctattacttttgctgagcaaaaatatatggtgaatcctaactttgtctaatcatttattcaaaaagagagttgtttgaacatttaactatagaaaatatgaaatctgtatctgttaagttaaagctatatcctctggatgtgaatctgaagattaaaatttatactttctaggtataagaagattatctgaaataaatatatagtgaaaaatttaatgttttctttctgggtttcccatttattctccatcatagactgggttctttatatcagtagaaataggcatacaatatgcatacaaagagaaatgtcctaataaagtaaatggaaggtgcatgaaagagaaattctggaagacaaatcaataatatctagcttggatattagagtcacatggtcagaactgattccagacttccaacttactagtaactttgtgttttctcatccataatttgtgaataatatctacctagcagcactgtatgtatgagattaaataatgagatatatgtaaagcatgtaaactagggtctgacacatagcaaatgctcaattttcttattcttaatcttactgttcttgtcatttattattttacgaattgctatttgtagaacttaatgttttacattctgatctatgattcttatggtcggaataatccacaatagtataaatcttggtctatgttgagaatttcttcatacaaacataattatgtagctcttatacaggccaaacctgcattcatttctattagttatatgctagaggtaatgaatttttattatttatttatgtatgtagacacattctattaccactctttaccaactgccattattttggcttaggagaaaatgatcttgaaaacaggtctatgtagttttaacagctcttttgtgaacttcggatgtaactgaatcattttctagatttatctgttaaataaatggtccatgaaagtatgtatgggtagataattgatggaagcaaataatcctattgaaacatttgctatttatttttgatacagttcttttaaacagactgattagttccctttatgatttcaccctcgaaagcacacacgattttgttctttatcattgttgcatgacattccatttggcagttgggcktatttttagccagactatcaaagtatttttcaactggactgtcactgcacttgaacttggaatcttataacttgaagaactgycctggagaaaggaagaaacttataataaatgggaaattataaatctagaccaacccaaacttgtactggtaattattctaattattcttatttccttaagtgtaatatggttcaattatagttactgataactaacaactcattggaatatgtgttaatttgtatacggaagataaggcagcatgttwtgtgaaagtctttgaaaaactatctgaactcaaattatttttttctgaagatctttataggaaacaagaaatttcttacaaaaatattattttagttccttggtataatgttacagaaaaaaatttggaatattgctgaatgtagggattttagaattatatcttaagtatctagtatttaaaaactaaaaaccgtcttgcaactagagattgctataattaaaatgcaataaaatcaaatgaaataagtcaaatatatttttctatgtaaatatattatccaatatcgaatgggttcttcattactacaattcaatatgattgcattttaaatataaacatctgcattttaaacwcacaatcagtaatttaaattaagtattgtagaatctagaataaaaaacagttttgattacttgtatgttatgatctgtgtctacattttgyaaaacacaactatgaatcaatctcatttgttcttctttactagatgaatggaagaaaaaagtcagtgaatcatatgttatcacaatagaaagattagaagatgacctgcagatcaaggaaaaagaactgacagaactaaggaatatatttgggtaaagttgtaagagtcattatttctttgtataagtgtcttcagtattcaccttawtttttaaagtatctgtatattttttaaacccgtagaacctcagacataagcagtcatgttctaagccttaggatgtcagattatctctctttgaccactcatatagctctcaaaatgcaaacataacatctcacctccttaaaatataaattgtaatctgccatcattaaagtttaaaaataaaaacctaaaggctagcctttgaatgcaagctattgttgatctcagtaatcttctcaggaattagatcattcttgtaaaccatgccggcaatgaaaagcaagatttttcttcccacatagtggtcgcatattggccacattgttctctttgaactatgacggtaagtccaattttaacaaaccctctggtctcttgacattgaaaggctgtcccttaatggaactgagtatcattctgcccctgaacaatcatataacaacatataatattgccttcaggatttcagtagattttgttccatgataacaagagaaaaataatctaagtgtcacaaccttggaagacacaaaatgttcagaaaagaggagcaagacccttatatacacaaaaagccttctggttaaattgaatctgacattgagaaactagatgcccattagagggtcaagaaagttacctgcctgactaaggaaaagttccatataggccaattagccatgttcatttatagctgtgttatgtaatgcactcatggcaaagaactccctctattttacttagaaaacaagtgtaaagcaatgaccaaatgacacatctttaaaayaaaattttagatatagtaaacatataaatatcacataattggcaaatraaatcacccatgtataatatagtttatatgaaattcgtcaatggatgtaacaaggctttcacaagtgttcaacttatggttcaaaaagtagttggttctctttatagtttggcccaggatgatgaactcaacactgacacttgtgatgagataccactgatctgacttttgcaagtagtatcacatgttgagatatggaactacatttgaaattcctgtagaaatatgactggcatgttagtacagtagaattataaatatgtatttgttttgttggaaaagtatgaatatagaaattaatcataaacatctagctcttattgacttaaataaatatgctaaatgaaatatgattacattgaagagattttcctcaacttttaaaggtcaaagcctcagttatttagtattattttttaatttagaaagtattgagcacataggtgaaggctagcttaaactagatgtatccaaacctgaatattaggattaacaatggatttaaaatgtaggttctttctgataccacatcgacaactacaagctgttttgacaactgctataatggacttttcctgtgtttctactaaatgcaacaaatgtgaccttcttttttctgattagcattgggggtgagatgcaggaatctgtgtcagggagcttacagtccagaatttgttgagtgccagctcgtattcaagtgttgttctggatacatcaaatacaagacattatttaatctatagtcatatgtagattgttgtcatttcatgtgtgccgaataatattaactccggtggatgataaactaaggattagagacaaggcagtgggagttgtcaagtcacatggtcagtaaattctggaatgtgatttgtgtcaaggtctgcctgactccatagatagcgctcttcctaccataccctgcttacaaaaacaagatttaggtcctgatttattcattgatttttgsaatcattgtagataaaaagcatagttaagtaaaggtgtgtaggcaagaatgaatgagtaccatagaaagtttaggaaaagtgagaaaaaataatgtcttcaccatattatctgacttgagtaagaaagctatgtgaatcaatgtaagaattttggagtcatacaaacatggttttaaatacagcttcttctatttataagctgtatatccatggatatgttttttaatctccttaatcctcattttcatctataaaatgaggtgaataataatcacctcacaggatattttcaaaatgaggtaaattaaatactaagtacagggcccaacccatagtaagcattgagtagttggaaatttctattatcatgattgattggataaataaggacagtttgaaggatagaagacttatcataaagtgagagtaacaaatagcttattaaaagttagaaagagtgaaagtttttatgaagaggatgatttcaaaattaaaaatgtaaagtattagcacaatttaggaagatgccgaaatctgaaatatagcttttaatgattttgattgaaagggatttgaagaattttgagactagagtattagaaggctaatcaaaatggctatcaaatttactgaggataatggtgagacatttttggagagaaagaccaatagcctgatgctgatgacattaaagaagctacagaatgtgatgataaggaagctgaggagaggattatccagtcyagaatgatgtttctgcaagaactaggggcctcttatgttaatggagatggagactgtagtacttgctaaaattttcgattccatgactccaccctttatcatgtgaatcagaatctctggagatgtcttccaataacctgaatgtttaacaagctccccagataaaactatgcataataaaaatgatacttctaaagtttgaaaactatacttctagaaagatatccaaattgcactgagaactctttgcctgaggtgatattagtgaagggatgaggaatatgggaacagaaagtaagcaactggtgtggtctaaagagagtcaagagaatcaaaaacaagcaagcaaaaacagaataatctgcttttgtctgatttcgtcaaggtagagagcataatctgggagaaaaaagtgaattgcttccagggcagagttctaaggattttcttttctttggaataaaatgatggatgaaagaaagaaaagaatagtgtgctgagaatgtaaattgtcttactcactcattcacaaaattttaaaggtagttgggaagatcaaacctaacactgtatgaaatgacatttaaatgagtatctagagcattataggtgctaaataaatgttagaatctcattactcacccttattcatttgtcttataaagagcattcctgtgataaacaattatgttatgttgcctgacatcagcctttctctaaacatttagatagcaaggagactgtatacaatgcccaaaaaggaacatttaaactagcatgaaacgtaaaggatcactgatgtaaacagtttttcatttgctaaccaatttctttatggcattcccggtagatgctaatttcattcattataagagatttttcaccacataatacaccattgctctatcagctcgaatacacaatcttcctggcatagcttttacccacaacataataaacagcaatatagtgctaaatgtaagacagaaagagctaaatagttatcctgcttatgccaatttatagcagctttggaatgggagcttgatgtgggagagaggggaaatggaaatggaatgttctttcatcttctgctataaagttgcattcactcataactttggacatttgtttaggtaatggattggtgacaggaagaaatgaagaaaaagagaaggcaggaggagaaagaaagacagaaagggcaccttagagtaccattgtctgattatatcctcctctgtgctgcctctaatctttatcaacataacagcacttactacatggtgttgtttttatccatttataggtctatctccccactagtatatgtgttcattaaaggcagctttttttcttatttagccttatttatatttgtacttatttgtaaaacaaactaataacttagggcttaccatatgccagaaatgcttctacgtatctttttgtgcatcagcttatataatcctaatggtgtatatgtaaagtgctttagcacagtgtctggcacatggcaaaccctcaaaaatgttagttaacacttaatcattattgtttatgttaacaaccctctgaagtaagtgttgcaattgccatgttatacctggagaaaatgaggctaatcaaattaaactggcttgaactagattaaacaatttgtatgatttacctaggattgcatccatctttatttgatttcaaaatgtatcatattcataatcttggttatgaatattatacaacctttttgaaaaaactatggaagtgatggctctccacatgtgacttcaaatgttttcaattaaattattttgtttcaatagtttttatcataataaattttaagactatgttttgctaatttcattgtcaagccaaatttgtatctgcttaatctataatatgaaatttaaaaccatgagaatactccagaaaagttataatttttctttttctttttctttttttttttattatactttaagttttagggtacatgtgcacaacatgcaggttagttacatatgtatacatgtgccatgttggtgtgctgcacccattaactcgtcatttaacattaggtatatctcctaatgctatccctccccctccccacaccccacaacaggcccccgtgtgtgatgttccccttcctgtgtccatgtactcaattcccacctgtgagtgaggacatgcggtgtttggttttttgtccttgcaatagtttgctgagaatgatggtttccagcttcaaccatgtccctacaaaggacatgaagtcatcattttttatggctgcatagtattccatggtgtatatgtgccacattttcttaatccagtctatcattgttggacatttgggttggtgcttagttccaagtctttgctattgtgaatagtgctgcaataaacatacatgtgcatgtgactttatagcagcatgttttataatcctttgggtatatacccagtaatgggatggctgagtcaaatggtatttctagttctagatccctgaggaatcatcacactgacttccacaatggttgaactagtttacagtcccaccaatggtgtaaaagtgttcctatttcttcacatcctctccagcacctgttgtttcctgactttttaatgactgccattctaactggtgtgagatggtatctcattgtggttttgatttgcatttctctgatggccagtgatgatgagcattttttcatgtgtcttttggctgcataaatgtcttcttttgagaagtatctgttcatatcctttgcccacttgttgatggggttgtttttttcttgtaaatttgtttgagttcattgtagattctagatattagccctttgtcagatgagtagattgcaaaaattttctcccattctgtaggttgcctgttcactctgatggtagtttgttttgctgtgcagaagctctttagtttaattagatcccatttgtcaattttggcttttgttgccattgcttttggtgttttagacatgaagttcttttcctttttttttttttttcagacggagtctcgctctgtcgcccaggctggagtgcagtggygcgatctaggctcactgcaagctccgcctcctggattcacgccattctcctgcctcagcctcccaagtagctgggactacaggcacccaccaccacacctggctaattttttgtatttttagtagagacggggtttcactgtgttagccaggatggtctcgatctcctgacctcgtgatctgcccaccttggcctcccaaagtgctgggattacaagcatgagccaccgcgcctgacccagaaaagttgtaatttttaaacactatgacatcaacataatccaaaacaacttttttggcattgagtagatacatcttggtcagtaattacagtgcctcactttaaaattgactaggtttaattatgtacaaaaaagtggtcaaaagaatgctctgttccattaaatagtcacaatgtatagaggaaataaaaaaatgttttctgagatacacctttttgtaccttttctctctgaaaagttcatctgaggcctgttgcattccactatactcatccttaaaacaaaatatcttctaaaattattgcactatagccaactatgaaatttggctattataagatgaatagcactggaaacttttcaagctgatcttatttaagaggagtagaccctttctgtcaaactactaagtaggatattgaaggggaaatgtcatcttataattaacatagaatgaaaatattatttggcatgtttggtagtgtgttttgccaattagccacaaaacaaaaaataagaatcgtcaacaacaaaaaaaaccctcaaatccaaaaggaaacaaagaattcataatgccctaagtcagtctatttctctaattcttttcttgtttgtccaggtaaaactagttaagaaccataattttacaggaatatcttgtgaaatcattgagaagcaacttgacctcaatctctctctgcctctctctctctatctctccctattgttctccctctccttctccatctgtagctcgctatctttctatcattttctctcccccttacccttcatctcttcttcttttccatcctgtacctccatgattccttctttcctatccctgttttgaagagcaaaacaatacaaaaacagtaaaaataatatcaatgccttaatagaaataactattatagcagctaatatttataaaagctttacaagctctaacttatttacacttcacaacaatcttataagataacaataattatgccaattttatcatatctgtcactctaactataattgtttattgtatgaatggctgaataaatgaatatacttcacagtattagtttgcagattttatttgcaagatatcaaacaaatatatttctggatatttcttggagatatatattagaaacagatcttattgatatagtctgcttctattgtttggagggcatggggcagggaagaatctgcaatgaataggcaagaagttgcaactagccatttgaaacttaaatgatcaatttgggaaactagacaacccataaaaaatccttaccttctttctacattcttggcttttccctaagttttaaccaatgaattagctttaaaatatatctacctgtctgaataccttggagagcagtgtgttactttttggccaactgttcaaatgttacattttaataagttcccacttgtggtcatgttagatatcttcttgaaaggatgaggtcatgaaaaagaagtttaattggatcacaaaactgcacacttttctaggtmaaaggtaaaggctaggaaaagaattcattatgctacaagaaagaaagtaacctttgggtacagaactatcatttttaatgattaagaacagcatttactattagaaatatattcataatagtggctttattttaattaggaacttcattcatgccccagcatgcactatgaactctttaggatatgttaagttacagtgtggcatggcaggtgatgaaaaatgtaargggaaattaaaaaataaattgagcttagggtattagaatacataagtgrtgctcaattggcagtgaatttgacatacacagttactttagaagaggcaaaagaagagaaaatggaatttctstcctaggaatgattgcttaaatatcttgaatattttaattacatgtttcaaaacagaaacgtttgactagaagttaatgggaagtgagaattaggattcaaatatagcccccaaagtaactctcattttaaaaatgtacattccagttattaaagttgagctaaaaattgtactattaaaaatcacacttgactgccaaatattataggagtctattctctgttgattcattttgttgacattaagagaagctgcatgagttcaaggaggatataattcaagaggagaacaaaagcaacaagcagcggctcagtttaaagcaaggaactctttaggactctatactgagtcacttatagatggtaaagtctagttcaagattcagttagctgaggaacaattgttgaataaagagtcattaattttgctttcaattttatttatgtaaatgataaacattcatctagtgcctttcttttttaaaaataaagcaatggaccctggcatcttgtattttctgtttattccatgttcatttgttttgcaaagctgatcagagtattagatatcaggacgaacacagcagtcaatttcaggattttatctagtatgtgtatttccaggactgatgcattcaaaggatccgggatttagtgagtagtttatatcaaggagactcttgaaaacaacctgaagtgagccttaagagcagaagtgaggcgtatagtaggtgtttagyaggtgttgtgccagacttattgaatggatcatcaaatttagatcacagaataagaaagcaattgagtttaccctctcaaataaagtgattttcatctcaactttaactttttaccctcctttgcatttttcattctttgagtctctccactgttgaaaatgtagtaatattaaaagttygagagatcaagtttaaataagagaatctcatgtgcagttctgtgttctatgtataatttaaacttttcagagcaccatgatgaataaaaattatgtatacatagaaaacagacatctgaaagtaaactcatttcactcacacacaaaatctcacataatatctacggagaaattcaggaaaatccttccaaaaagaaaggtggggggaagtagcatctgataagatattggaaaaaagaatataatcccaatgtattacaacttctgcctgaagcaaagttctcttgtactctgactgggtcagatttcacagataaaggtctaaactctggtagggtactctgatatagtccctggtgagaagtggagtgattctattaatgaaatccttgtctttgtctgaacaaagaccattgccccaggagggcccttgagagccacaggtagcctttcaaaaggaatgtaaagctaaaattctcgacctcttgaggtccacggtgctcccaggacatttttcagtagaaatgagatcatatccttggcttcacaggtcaatttcaagctgcctcctgcctatttaaatctctagcagctttagagagatagcatagtatttggtgagtgagccaaagtttcatatcacttgtaaagtacttacacttgaaaggtactataaattcagaacattatcatcaaggcatccagttaagaacatcaaaagctattggaattttaaaatagaaaaagaaaaagtgctattctccagggtactgctaaaaagagaaaggctctaaatccagggtcattgaagaacctcagtgaaatgctttaattagaaatggcaagccttgtggtttattttcacagccatgggaatgcagtattcccaaactttttttaccctcctacccttcttgctttctgtgttcccctgcagcaaaacacatagacatgcttactaatactgggaaacacacctcaacttgctttggaaagccttttgtggaagtacaataaactccagtgtttataaatgttaataatataagaagggggttcagaatttcatgaagatagttaagaatttaactcacttctatcagcaatttccctcagctcaaaaaatactgcaatcaaaatcatttctgatgaaaatgccactgttttaaatgtctacttataataaaatgagcctacttataaatgatagagctatttatggtatggcagtaacttcacaaaataacatgattcttagaaatgtgtggtctttggcccagcctggcttttaaaccctcaaagccaaatatattatggatgtcttggaagaaagtaaactaggtacttggaacacacttggaaatgcaatcacaggtcacagaggtcttctttgtggttatgacttcaaatagtagaggtattcagcggagctgaactctgcctttcaagctaggtagattggatttttctcttaaagtttgtagggaatcagtgtccataaataaaaagggaatgaaaactgtgactggaaactgagaatgttgatggacartgattcagctctgagctgcttcggcttttcttccctggtctttctattgtccagcaaatgaaacacactataaaaccacaagaaaaaaaaacaaagtattggactgggggaggagagagaggccttgtgatcctaagaaaaactatgtaaccagcagcctaagcaaaacagggaaggatgcacattcttctgagctaatcataatgaacttaatggcaaatactgaaagaagaaaaagctttggagctcttctgtagcaataaacacctgagaaaatgcagtttttcaatatgtatgtccaatattgtatagcaatacctgttatgttttgctgttttcaaagtggaaaaaatcatttcatcagtgtggtaatccttgaaagcctcattcttatagttataccaggattcaaatcctatcatgactctgccttttaagtagtttgttctttttttccaacttgggcaagttatttaacctatttaagcttcaatttcttcaattataaaatgagtaaaataatatatgtgacaatatgcatgactttgtcctgttgtgtccggaattggtgggttcttggtctcactgacttcaagaatgaagccgcggaccctcgcagtgagtgttcagttcttaaagatggtgtgtccggggtttgttccttctgatgtttggacgtgttccgagtttcttccttctggtgggtttgtggtctgctggcttcaggagtgaagccgccgaccttcgcagtgagtgttacagctcttaccrcggcgcatctggagttgtttgttcctcccgtccggagttgttcattcctcccagtgggtttgtgatcttgctggcttcaggagtgaagctgcaggccttcatggtgagtgttacagctyataaaggcmgtgcggacccaaagagtgagaagcagcaagatttattgcaaaaagcgaaagaacaaagctcccacggtatgaaaggggacacaagcaagttgccgatggtggctggggcagcctgcttttattcccttatttggccccacccacatcctgctgattggtccgttttacagagagctgattggtccgttttgacagggtactgattggtgcatttacaatccctgagctagacacagagtgctgattggtgcatttacaatcctctagctagacataaaagttctccaagtccccaccagattagctagatacagagtgctgattggtgcatccacaaaccccaagacagacacagagtgctgattggtgcatttacaatcctccagctagacataaaagttctccaagtccccacccaactcaggagcccagctgactttgcctagtagatcccacgcaggggccgcaggtggagccgcctgccagtcccacgctgcgtgcctgcactcctcagcccttgggtggtggatgggactgggcaccgtggagcagggggtggtgcccgtcggggtggctcaggttgcctgggagcccacgggggtaggggggtggaggggccttgggcatggcgggctgcaggtcctgagccctgccccatggggaggcagctgaggcctggcaagaattcaagtgcagcgcaggtgggctggcagtgctgggggacccggtgcaccctctgcagcttctggcccaggtgctaagcctctcactgcccagggcyggtggcaccagcctgcggcgcagagtgtaggacccactaagcccacgcccacccagaactcacgctggcctgcgagcactgtgcacagccccagttcctgcccactccactccctccacacctccccacaagcagagggagccggctctggcctcggccagtccagagaggggctcccacagtgcagtgtcaggctgaagggctcctcaagtgcagccagagttggcaccgtggcctgaggaggtgccgagagcgagcgagggctgctagcacgttgtcacctctcactgtggtgaggaataagtaagattaagcgcttactacagtatctggcatgtgatatgcaatcaaaaaatgattattgcactgttgttaccattgccaacttcactgtgaatatacaactttctttttgaagtataactcttgggataattttagcatcatttttgttgaggcttagaaaattacacctcaaaatgaaggccttacaagcagccttagaagccaaactttctctctgaccttctcctgtcctcttgtctctggcccctcattttccccagagggtagccatagagactagaatccctctcccctcaaggcaggtcatagaaactagaacttacagagttattcctgtatctttgagtcttcattctgaaggctcttatgtcttgtatctcttgtgccttttaaaactatgatcaaatatattttatgccttttcttctattaatgtcccttttgtcagttgatttcagcaaaccttcagagaggcaaaggggaaggtctttcttggcccctataatttcatgccatatttgacttttcttggccttttatatttgacaacaattttctgatttctgatttcctgatttacataataatcaattttatatatgtattatgtaagtattccctactaacagtgactctcaggttcctagatgatgtctgaccttggttttacttgtctttaaaaagtgccactaaattcgctattgtgacatctagtagctgtcagtgattctggagcaactattggaatcatagtgttatttctggtgacatcattacaatgtaaaactacagaatttcctctcaattttaattcttcatatagagggttcaagattctttctgtaagtgcaaaataatcttagaaaaaatacatttctgaattgatagtaacaggatttgcatttataattttcaaatgaaagacaatatgctaaaagatgaattttgtgatcatctgtaacatgtttttttcagctctgatgaagccttcagtaaagtcaatttaaattaccgcactgaaaatgggctgtctctacttcatttatgttgcatttgtggaggtgagtacttgaaacttagtacttcttaaactggttatatgtgtatatcgtcagtgacttgagctgcttaatagtctgcaaaagaattctattcatactcaattttcccttytgctttgccttttccaaccttgataatctcagtttaggcagtaactatcaggcagaatattccaattgatttagctttaaatataagcttcattgtgttgctaccggaaaccaagtccctcagtttgcttggaaatcaaaaagcacttttcaatattgggcatgccagtcagggattaacttaaattcagaagcacttaaagattccccaaaatatcatcaagcagttgcttcacagtattcaacaagagtatgtggaaaagtgataaatgccaaagataagatctaaaagtgaagattgatcgaagtgaagattaagagtttaatttggcctacactttagtttgttttgtttatcaatgtatctcaagtaatttgaatggtgcctggcctgtaatagccactcagtaaagttattgaattaatgaatgaaccattaatatttattttgttaatccaaactaaattcattgagcttaacttcttaaaatggaacagaaatgtgtaagtgtcaactctaaccatattccttaaccatttctcccaaacaaaccaaacagactctgcttaacagattgttctctcaacttcaaacgtgccttcccaaccttggttatatccttcatatttctttgatctaaataagctctactgttaataatgttcagataaatcctctacaattagattttttaatttaagctttttcactaatagtttattatggtgaattctcttatgtgtttatgtttcaaaaccatctgatgatgagggtactaaataaaaaatctaagacagagtcaaaatacacagcatttgaataaagttttataaatggaaaagaaatatcccctagtaagtaaggttgtcaattaatagaaaactttacaaatggcctgcagaacgcagcttgacatttttatacagctgtatggcatttatcattaggtcaaaaagagtctcaaactcamcccatccccacaatgatttagccttttttcatttttctctttaaggcaagaaatcacatattcgaactcttatgttgaaagggctccgcccatctcgactgacaagaaatggatttacagccttgcatttagcagtttacaaggtaggacactttaattcccataaacactgcattggaactaaggatagtgtgtatctttaggctttttttytttttttttcaaattagtaatcatggaaaattttcagtgaccagaggcgttacattactaaaggacttctttctctttattgagcagatacctgctgcatactagacacatactctttttaatgctttctgtatttaactcatttaattctcacaagaaccccatgagtgaatatgattattatccccaaggttacatggttagccaggggttagccaggatttaagacaaggcagtctagttctgttgccaaagctcctcatcagaacaccatgatgcctctgtgcagagagagatgaggttgtatttaaagacaaaagaagcacactgaagctgtatttctttactgcaaatttttcttaaaaaacctttttgctttagctgtttattttcttatattagcccctggctccaacctaatctcagcacctgatagaataataaatataatagtggattggacaaactgggatacttagtgttggaattgaaccttgagattttcataaatataaatttataaaacatacaaattatattatgcattgatcattttataattataatamtttctactttgtatttattatgagctaaatatcatactaagtttaatgtattttagtcattaaaataactgcatattaggatttactttacagaaaatgcaattaaagactaaagtagatacctggacaatattagaatagtgattaaagtcaagtacagttggctcattactcccagaatcttatttgtatattgcgtattttgttctttctcattttcaagcgagtctgtgacagaattttatttcagttttgtgtgtgcacgtgtgggaggagggacaactttttgcttgtattaggaaccccctgcactatctccctcccccaactgctagagagtttgtcattgggagggaagaggaccttattttcccatgatctagcatcacaaattcctgtaattcatagcgcaaatactctaaagtttcatctcttttcatgcccagtcaatgcctagtcaattcttctaattccttctgggagaaagcctcagttaagtgctaaattgtctttagtacctgttaattatcctgctaaactatgaaacattctgagtttccagtgtagaaaacagcatctgatgttgacttttcttctgaaaggcaggaggtgaaagtagaagagctccaaggaacaggaaggtagtgaatgatagtcatggcactgtatgaaaccatgaattctgaacctcacygtctgggagattttttctgtattagttcatyttgcaaagatttagcatgacattggcacacaaatgggttctgaatcatttagtcctacaatatttagagaatatatttcttcaacctctgtttataataattaaatttccacttttagagttttctttgctctatttttatgtttttttctattttagagaagggtgcataaactataactttttcatagcaagtttaaatgaaaatttagattcttgggaaacaaagcaggcaaaaatattaaaaggccataagaaaatgcatagttattttgcaaatttcttaacaaaagtgaaaaacaaattaaagttactatttcattttaaacacaaaaataatataaagtagttgtgtgtccagaattggtggattcttggtctcactcacttcaagaatgaagccagggaccctcgcggtgagtattacagttcttaaaggcggcatgtccagagtttgttccttctgatgtttggatgtgtttggagtttcttctttctggtgggttcgtggtctcgctggctatggagtgaagctgcagaccctcgcagtgagtgttacagctcttaaggcggcacgtctggagttgttcattcctccccgtgggttcgtggtctcgctggcttcaggagtgaagctgcagaccttcgcggtgagtgttacagctcataaaggcagtgtggacccaaagagtgagcagtagcaagatttattgcaaagagctgaacaacaaagcttccaaagtgtggaggggcacccgartgggttgccactgcttgttcaggcagcctgcttttattctcttatctggcccccacccacatcctgctgactggtccattttacagagagctgattggtccgttttacagagagctgattggtccattttgacarggtgctgattggtgcatttacaatccctgagctagacacaaaagttctccacatccccactagattagctagatacagagtgccaattggtgcatccacaaaccctgagctagacacagggtgctgatggtgtgtttacaaacgttgagctagatacagagtgctgattggcatatttacaatccctcagctagacacaaagtttctccaagtccccactagactcaggagcccagctggcttcacccagtggatcctgcacaggggccgcaggtggagctgcctgccagtcccacgccatgtgcctgcactcctcagcccttgggcagtcaatgggatggggcactgtggagcagggggcagcacgctttgggtaagctcggccatgcaagagcccatggcagggggtcggggggaagctcaggcatggmgggctgcaggtcctgagccctgccgcacggggaggcagctatggcctgctgagaaatggagcacagcgccagtgggccggcactgctgggggacccggagcaccctccgcagctgctggcccgggtgctaatcccctcactgcccrgagccggcaggactggccggccgctcggagtgcgggcccgccaagcccacgcccacgcccacccagaactctagctgggccgcaagccccgccgtgcggccccagttcctgcccgtgcctctccctccacacctccccgcaggccgagggagccagctccagcctcggccatcccaggaaggggctcccacagtgcagcagcgggctgaagggctcctcaagtgcggccagagtgggcgccaaggccgagaaggcaccaagagcgagcgagggctgcaagagctgccagcacgctgtcacctcttagttgttcacactaccaggcattaaacctagtaaccattaaatgcattaaacctacttctaattatcccttgacagaactactccagtaagtatataattcattttgggctccagttcccttcccccatatagtattaataactgtttaattttaatattatttcaaacttacaaagacaattgcaagaatagtacaagaaactgcttatccaggttcattaactgtttgcattttgtcccatttccattattttttttwagaaccatttgacagtaaattgtataaaacatgccctgttgccacttcagtcttcatttcctaagaacaagaaaattcacttacataactccaatgcaattataaaattaaaaagaacattgagatgatattaacattgataagatatgataatctatagttcaaattcaagttttatcaattgtcccaattgtgtcatttatagattatattttcttgtccaggataggattcaatccacaatcatgcattttcagttttcttatttctgtaatctcccttactctgaaagaatttctcacccgatccttgtatttttttatcttaatatttttcatgcataccagttatttatacatatttctttgaatttttttggtattgcaatcgaattttattttgttcataacactcacaaaatgaataatgtaactctcccatccttttgttcactacatcaaatagctctttcaattatacaccctggcatgctgggcctgactcattgttagaggaaaggggtcccgatccaggcctcargagagggttcttggatctcgcgcaagaaagaattcagggcgagtccacagtgcaaagtaaaagcaagtttattatgaaagtaaagtggtgaaaggacagctactccatagacagggtaggatgttcctgaaagtaagaggaggagcacatccaccctaggtacaatgctcatatacatggggagatgtgttctgctgcaagggtttgtgataacatattaattttcttaattgctatattttgcaagaatcgatattattatctttaaagcaaaattaggaatgcctttgttctacagatatcaggatatctggacactcccaagtctgggtctgttcagtaaacattatgaacttgttctttaactgtaaacatctagaggttaaaaatgcctaacttttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaatgcctaactttctgagaatgtaaccccgtaagtctcagcctcattttcctattttcctagccctcactcaaaatggagttgttcactctggttcgaacgcctctgacatcatgactgtatattttctaatcaatagagtaatctctgctttcattaataaaagtgaagcagatatttagctatttaataccacatgaatgattaatcctcatacatctttttgttttagtttgttgagtttttcacagtgtttagttttattgaggtttaatatataccaaatacaattatcaattttaagtctacaattgttagcttttgaaaatgtatgtaatcatgtaaccatcatcacagtcatgttataggacatttctactataccaaaaagttccctcatgccattttgcagtcagtctccttctcacctggtctctggaaacaagtgttttctgtcactatagttttctcttttctagaattttaaataaatttattacatccagtatgttttcttttctatatggtttcttgcacttatcataaggctattgggattcacccatgttgtatattctgtaattaatgcttttcttgtagaattgtattcccttatatggatataccacaatttaccatttacctgctgatggacattttcccagattttgaccattataaacaaagctgttctgaacactcacatacaggtatttgtttgaacatatgtttttatttctcctgggaaatacctaaaagtggaattgctgagtcacataataagtatatgcttaattttatgagaaactaacaaactttttaacaaactagcaattccttcctacattcccatcagcaaggtatgagagctgtagttttttcacatcctttccggcacttggtgtggtcagtctttttttttttttttttttggctattctattggatgaattttagtatttcattataattttaatttgcatttccctgaagactaaagaggttgaataggtttttatgtgcttattaggcatcctttattttttaatgtagtgtctgttaaatctttttgccatttgtaattttgtttattattttcttgaattgtgagggaactttatctattctaatacaattcttttcttgaatatacttttgcaaaaatttctctcagtgtctgacttgccttttcattttcataacagtgtcatttgaagagtaaaaggtttttgcattatttttaaacttatgactgtagtgattaccatacagttatagattctcaacatttcatagtccactccctgcaaatgttgatctacttcacttaaaatataagaaccttccagtagtatagtttcattttatcttcattctttgtgccattgttgccatatacattgcatctatacatgataagaacctaaatatattattagaatttttgtgttaaacatttatatcttttaaagaaattaataagagagaaaatatgcttttyggaagtttgattataataatcctacatatggttttctgtatttaaaactctttgagattcactgagtttttatatctgtaaatttatggtttcatcaaattcagaaattttgaccattagtttttcaaatacatatgttagattgtttgataattttccacatatcactgagtctgctttttttcttccttcttctttctttctgttctccaaattagattatttctacttatttgaattcaagttcacaaaccacttctctgccatctcccatctgataacaatccaccagtgaattattcattttggttgtttacttttccgttctaggatttttatttattaagattaattaagatataatttcaatttctctgctatgatgacacatctgttatttcatttttccatattttccttcaaggttttgaacctattatttgtgactactttaaatgtccaatctgctgttttcaacatctagattagctcagtatttgtttctatttcatgttgactacagrgcacatttttctgtttcttcatatatcaattaattttttattgaaagctagaaattatgtattatgtgttataggaaatctttatcatgtcatcttcctttaaagaatgttgagttttttttatgtttgtttttctttcatttttggcgggtagttacacttctggtggatacatttcaatcaaatcagtcttgatttgattttttgttaggctgaaggtatttcagtttgaacttagcctcttggcttacctcttttttttttttttttttttttttgaggcggagtctcgctctgtcacccaggctggagtgcagtggtgcgatcttggctcactgcaagctccgcctcccggttcaagccattcttctgcctcagcctccggagtagctggggctacaggcgcccgccaccacgcccggctaattttttgtatttttagtagagacggggtttcaccatgttagccaggatggtctcgatctcctgaccttgtgatccgcccacctcgtcctcctaaagtgctgggattacaggcgtgagccaccgtgcccggccgcctctcggcatacctcttattcctagcatgtggctctcacacctgaacatggtgcttactcctaaagtatgattttttggcatgtcacctgaattcccaagtctctcagtaaagtctcttcataccagctgacaggagttccaaaatccccccgtactacatgacctccagtatcaccaccattcaccttttagcaataaatcaggtgatcttttctagatcttccagaatctttctctgtgcttgtgcagcccagctcaacaatacataatggatctccatgcagatttctgcagtgccctctctgtgcagcttcttcttctcggttaccctgctccacaaatacagccccttcataatatcagaactmtcatttacactcttaactcagtgagacttcctattatgctttgtggcagaaaagtatttcaggcagaaaaccatggcaatcatgggatattgtgtgacttgctttatatctttctcttaaaggacacagctgtttgctcatgctcttcagtgcttgagaacagttatgtcatatattttgttccattttgtagattttatttgccagtagagaaagtctatataagttgttctgtcatgcccatatctacttttgcattgcttccaaaatgatcwgaatgaaacaaaaatctatgatatcattgctcactttaacacttactattgtcatccattgcctatataatgacattcaaactcctaaatatgagactcaagatcccttaatttataacttttctggaatcactttccatactcttttcctgtagtctctgcctgttcaaccctaatggttttcaatgtaatgtgcatgaggatcatatagtaacatacgtttaaaatgaatatttccctttctactttactctcatttaaattggtacatctagggtattctaggaatctaaatttttaacaaacaacctaggaattttgatgtaaacaatctaggtctacatattgtggattactgttcaagcgtggcaactcaaattatggtcacatgatcagtagcatccaccccaactaaaagatttcagaaatgctgctctcatttcctttccagccctattcaaccagtactattcaggcgtttctagagaaatttaaccaataggattaatggatctatctatctatctatctatctaatctagagacatatttattataggaactggctcacactattatggagcccaaaagtcccacgatcttccgtctataagctggagaatcaggaaagctgatagtatgatttggtccatgtccaaagacttgagaaccaggggagcctatggtgtaaatcctattctgagtctaaaggcccaagaacgaggatcagtgatgtctgagggcagaatatggatgtctcagctgaaataaaaacaaattcaccttccctctaccttttagttctattcaggccttccaaagattagatgatgcccacccatattggtgagggtgatcttctttttcagtctactaatgaaaatgctggcagggcatagtggctcatgcctgtaatcccatcactttgggaggctgaggcaggtggatcacttgagctccggagtttgaaactaacagggtgaaaccttgtctctactaaaaatacaaaaattagccatatgtggtggtgtgcgcctatagtcccagctacttgggaggctaaggtgggagaatcacttgaagtcaggaggtggagattgcattgagctaagattgtgccactgtactccagctgggcaatagagcaagaccctgtctcaaaaacaaacaaacaaacaaacaaaaaactaatgccttctggaaataccctcacagacacccagaaataatgttttactagctaactaggcatcccttaacccagtcaagttggcacctaaaattaagcatcacaaccagaatgtacatttttaaaaaaatctcagctgatgtatttgtagattaaagtttgaagattgccattttagataactccattttttaggccaaacagttccacatgtctttatttttgtttttataatttcttctgcttaaatattttttaatttcttttcctgatgcaaaattattacttatttaaaaccaagataaactgagttttattgaactcgcagacagaaattattgcactctcttttgggtttcagttattaagtttacattatcttttattgtagcacttataattatttatttatttgcatatttcaaatgttggtctgtgaactttggacactgggactaagtctttttctttgattcctcagtatatgtgacctgtaaaggatccttgagaaatacttgtttggaaattagtgagtgtccaaacattagaacaatacttgacatttgttgatattatgtagcttaagaaagactgtcagcttagaagctagaatacttctgttcatatctcagttatgagacttgctaattatgcatatttaggcaaattgagttttccttatgctcctcaattttctaacctctaaaatgaagcagatagaattatctattttattgtgtagtttagagttttaaggaaacaaatcatatgcagtacttagcaaaatacctagcatatagttaatacttaataaaaattaaccattattgttgttgaactctaactttgacaaacatttattggaaactaacatgtttttcattttgcatagaaaaattaaaagaaatggattggattttctggattattacattctaaagagatgagaaaaggtaatcctaacaatataaaagaaatggcatctatacttagatcaatggactacaaacatcttttatcacgtcctctataaaattagcactcccaaacacatatatgtgttcataaattatatacattaacaaaaaaacccatcagttaatagcttaagacaaaatctactctttggaaaacaaccagtgttaaagtttgtagctatacatttatatttcaaatagcctttttgataatataaaatattttgacaagtttattacaaatatgattagattaggaaattgatttatatgaagctcagattggtagaaaaaagtaccagctttttctttgctgcttcttaccttagtaatatatatgttgtgtattttcttcacaggactcttttaaagatacctgccaatttcgtctattcagttgaagtgtctattcagttaaaatttgatattaaaatttataawcccacttactttggctcacataagctacagcacatccccaataactaaaagctaagaaaaaaaaaagagtgagaggcagctctcagtcctttcccatgtagaattttaagtatatattatactttgggtactatatgtgacatatgactagctgatatatgaactgaagccgccagtgtaaatttacatgttaaacatgaatgaaacttcatttatctttatatataaatgtatataagcagattttctaattctttttgtaccctaatgaattttattacaagattcctgtcacatttatatccctctatagggcayacttctttaggtggtatctaaattgtattcctaaaatgaaacacaagactttggggaaaaaattgagacctctgatatagtttagaagatcttaattgagaaagctaatgaacaaaatcctattagaccatctaatttagccttacatgtaactctcattcaatacacagacaagccacttagtgaaatttctttagtgagaaagaagtagcattttgattcattaacttatttttracatttcgtatgataaaagcagatattgaatggtaatggtcatttatcccatcctatatatttcttgcaagatttaattcctatcattcagaaacaactcattttatatatgtattacaaaagggaaggacatgaatgggggaaaaatcgaattaaacctatgttgcctggcttaccagacctaggtattttttgctacgtaactgtgcccatcagaaaactctgacttttctatcagtggcgattcgtagcctgaatcattgtattaatatcttttatcctgactttttttttcctccttagcacatatatttgattgcaaagttgaaattttcaactatcctgaaactaaagacccaaagtaagtgtttcatagtttctaactgctgtcgatttagaccaaggttcaacagccttggcactactgacaatttggattggataattctttgctgtgggaggctgtcctttgtgttataaaaatgtttagcagcatccctgtcctctgttctctagatgagagcagccacttccctcatgcccagttgtgagtaccaataatatctccagatatcacccctgagaggcaaaaatcactcccagttgagaacaactgatttagaggacagatttcaatattcattaacttaaatggattttttaaatcttaattacctttatatttgaacaaataaagtttcctgattaaagactgcattttccctaaatgggaatttgacaagatagtaataagaaataatttgaagaaaaaaaaaactcaaaaaaaaaagaatcccactttttgcatatttaactaaattctccagttagtgatgacttttaaacactttaatagtagattttcacttaagaaactagagaaaatttttactcataaattacagcaatcattaagatagcttgtttatatgcagatttccctttagtaatgaaatatttcataatctctttctaaatgaacacattctcaataaaaagttaataggatcckagctgaagatggtaatttgcaatttatgcttcaattcttacaccagacagtagtatttcctggaaaaccttccctgatccctcccaagtttgggttaggtattgcttcattgtactctcttagctcctagtacttactatgctgtgtatgctactgtatattattacttagttaaatctttmtatcttcctctatattagcggtcacaatctcacatattttaaggatgacataaataaatgaaagacagacaatgataaatgggaagtaaaactcaagactgaatatttttgagatatgagagagtggcaaagactgtggtaacttagaaaacatatgccccatgtaaagggaatggtcactcttcagcttcagctaatcattgtcatgtaaaaatgtagacccattatttcccaaaatttcagagaatcataaattatgtgaagtttcctaatatttaaatgctggccattaatgcagatttttagtcataaatactcaacaggctaagccatatatatttccattcctcttgtagcctgtttgtaatctctgatagtaattatgagcatcatcaaggcagagaccagatccaagttgcttatcatcttattctgagtgcttagaacaacgcttgatatatatacttaataaattgatgttttataagtgaagaatgaagttatagttctctggtaactggggggaagaaaagtgtttcaaaggaggtaggatgaggttgacagtgggcaaaatggtcctatttgggccattagaataggaaattaggaaattgtcagatacctctttaagggatattttagtaaattttggggagaagaggatataaaaatgggttgaaaataaatacagttagggaaatggaggcaataaacattaatttctcttccaaaaagtataagattgggcaatatttgaggaatggccagatcaggaaggtttctgaaacagcattgtcctatctttttaaactcttgctccttaaataaacataaaagttcagagtttatttaaatgttatttttaaactttaaaatagatattatgttatagctaaaaacaaatttaaaaaattagaatattcattatgccttttcaagtagcatgtatttacttcccccgccccactgcaataggtagagattcttattatcctcttcctgttaaatcatctctatattattaaatgagagatgatttaaggatgttcaaaggccaattggaggcagcctgcaggaataaatacattatggaaaatgagaaaatagaagaaggagggatggcagaggtgaggggaaaaaataggtccaaagcaagggtacagataatctaagagtatgttacttctctttttttctttttttttttccaaaatttcaagcaaagtcaagtatttccaccacactgaaactcttaaaaactgatatcttttgtgaaaataaatccagaattgtttcaacaggagacatataggtatgaacctttgtgagttgagcagttattttcatactgattaatggatactttcactggggatgtctatgatgcacgaggcagctctagtccattaaattttaatgcctagaactaagtrcatttcataytgaagccctgaatagttccttgtcctaaaggaaaacttaataatattcttcaaagcctccaaaattacttttctaaaaaaacctttttctttataaaaacaaataaactttaacaattgctatgctggtgaagaaaaaatatacttagagaaacattttaaaaacttttatttatatgtccctattttatatccagaaacttagttttctttccaatcaaagttcagctccttcttggagtttggtatgacacttcagggaatattagaggtgaataaggtattacagaaaaaaatttagcccaactctgtaaccctgcagataaagaaatggaagtattttatgactaaacatctcttgggacagagtggactaaatcataaggtgaatattctcatagaagtaggccaatcttgggggtgatacatttaatatgaatataagcttacacctgtaagtatcttgagtttataagcatttgcacatacattatttcatttgatctttattacaatcttgtaaggtaagtaaggtaggtattatatttctttttataaaaatgaggaatataaggtcagggctgatacatgaaagacaaattattagcagctgaagggtaattggtggggagggagaaataacatgatgtattaagaaaagcataatattaaaaatcagaagacctgatttcaaatcccagttcagcctcagtttaaagttacattaaagaaacacattttatgctatggaatgccaattgggttctctaaaaagcrttctctgaaaagaatgtaggagtacaagaggtttatttaaaggtgacacctgtgaaaggaaaaggaatgaaacagaattggttatgaggtgccatcagatcccaatacagagctgctaaaatctccgccagcccattgaggagctccagaggaaaaattgcctatgraaggagtgccacacgggctagaaatgtcgaggcccttcttttaccaccaccttactcagtcattgactgggagtaaggtccaccctgagaagagactgaacacagctctaatgctgcagtgggtcctgaaataactgagaaagctgccagtgaactaccatcctgccacactcttcataaagggaggtctcagtggcatatctatttctgccacacatgaggaaatgctcatgattctataatatatgaaaaaaggaaattacctatatgtagaattagatcaatagtgtacataataacaattattatgtgtcaagcattgtactaaatgaattacagcattatctgatgtaatcctcacaacaatgctatgagaatgatacaattgtatcttcattttacagacaaaaactggacagctcaaaaggttaagaaacatgtcgcaaatgtaggaagtgcccatcaatattgaaacacgagtttgctttgctgggatagcttgtgctccatctggttgcacaaacatatgtacataggacaaagaatggaagggaaaaatacacacataaataatagtgattatatggtagtactatgggttattgaattatttattcattttctttgttttttacattttcttctctgaggtattctggttgtctgttgaggcataacaaactatcccaaacttggtcytctaatgcaactattttattattctcatggattcttagttcaaaaattcagacaggatgccgtgtggatggcttgattctgtcccacaatatttagagcctcagctgagaaaatgtgaatgaatgggtttattcatcagctggtagcttggaattctctggaggcttaacacactgactggaataagtgtaaggctggacttagctagaacagttgattggagagccttcatgtgcgatgtaccttctccatgtggcctgcattttcttataccatggctgacacaggttagtcagatttgttacgttatagatcagggctcccagagtgtgtttttcagcaaacagaaaggaagctgtgtggtcttctatgtcctagccttagaaaagaaacactctgctccacgctattgatcacaatccacccaggttcaaggggaagggrcatagatagcaaatatctgtgggttgagtatagatgaatgctcaccatgttttaaaaccaccagaaggtatattttgtccataatcagaagaaagtacatttttatacatcagtttcttttctatactgaaatagagttgaaatttttttgtttaataaataaattttaaaaatggatgtaatatggtagtagaggatttgagctctgtgatatagtggttgcttatcttggctttatccatagcaataatcacagagctaacaataaggcaggatattaagtaagcattgttttagagttttatggctagtacagagttgcagttactaccattacaaaatatttttatccatttacatacattttgggagatctattctacctcaaattctatttctcaaggatatagctggagygcttttttgtctaagcctcattcttccacacatggattttcttctgcttaaaaataataaatatgacacacacaaatacattacaaagagcttatttatctcacacttatagggtgcctctgtgtgtcacattgaataataatgctttaaatttggctagagagtgcataaaggaaacttgtcagtttccacaagactcttttctaaacaagtcttaagagactttcttttaaaaacattgccattagacatttcttatatatggtaaactgcaagcaataaatgagatcaaacttagagtattcaaaatttgcctaatatttgcattttacaggaaaattttttccaggaggtgtgtaccatattgctgactcttaaaattattccattaggacaaaatattccagtagagtaagaggcttatcagttaaatacagcaaaagtatgtcctctcaagtttttccttgagactcgatcaggaaaaccactatggaaagtcagaagtgaagtacagacgttggagtccaacagacctgggtttgcatctaccttcaacacttacaaagtaaggttcagttagcactttaaattctttgagcctgagtgacatcggctataaaatagggttaataattattttctctcataggtaaattgtgaagcttaaatgagaggatatagatagaacatttttcatggaagttggctcatagtaagcaatttatatgcagcaattactgctttatgtttattatctttagcatagctgcataagataaaagttttattttggcagtattcagttaaaaagtatttagatcaattagaggtcaatcttgagaaatccaaccaargtatgaaaggataaattattactcttaacttttgaccttaccatttgcccattctgaaggaatcctaatatactttaaaaaaattccacaaatattgactgaataaggagaaaaaacaaagatacttgaagaaaggataaatgtgtgtttactaaaactgcctaatagataaatgtttcacatgctctgtgatttacataaaatttattttaatttagcctagtacagtgcttgtcataaaatagacattcattaataaatatttgttgaataaaagagtatccatctttctactgatttatacaagttatttatgtattaaatatgtaaacaatttgtcagttttatatgttgtgaatatttctccaactcgtcacttgccttattgtgtttttaacactttaatttgctcaaatctatcatattttctattttaaaatataactttatgcttaaaaagaccttccctactactctgcattgaaatttctgaccatctgcagggaaaatgttttaaggcgatgtttttcctatttatctcaagactaatcatgcctttagccctcaccaagattattggtaaagtgagagttaactcctgtgaactgttttctctggaggaggaattctcagtttctggcagcctatccatggctaaactagtagacgttttctcgcttccagtactggtacagcctttttccatgttttattcctttgtttgttgcagtgcctaactcgtgaagcagagggagtggagttaggaggaagaggtaaagggaaaggagaaagagaagctaagtgattaaatcaaatcaatatttatttggaaggtactataggtattatcagaacaattttaaggtggttacaattactctttttttatataatcaaggaaattagcaaaaaggagtgwcagaactgctccagtgcacatagtcattgtgagagctgaaattctaattagggaggctaattctatgacctgcatcttaaccctgccttatatgcagctcaaatttaacatgtgaaaacgaaacattttacttctgcctcaaaatctgcttcttcctggttcttccctatctctctatcattaatttccctactacttattgcacttggaaaaaaatccaaataccccataccatggcctagaaggccctgcaagattatacatctttgacctcatcttgaaaatttcttttcctttgtttaatcatttactcaacattggccttattgctggtcttcaaacacaacaagcttatatctgtctttcgacttttgcactagctatgtttcatattttaatacttatccttgaaattgtgactttttgccatctaccatttatctcaardtcacctctgcagtgaagctttccctgattaaccagtttaaaatagccatctaatcatttgtctatttttatctcatatcagttggtactttaagctactgtatagcaatttcttatttgtttactttttgtctctccattcacgtaaacatagtaaaatataagctctgtgagagcagcgatttcactatctttactcactgcagtgtcaccactgctcagaaaagagtttgaaacaccagatatgctcaatcaatatttgtttagcatataaagggtatattgaaaagagaaatgcataatcaaaactgggtgtaggaaaatgtatctaattgtatgcaggatggactgcaatgggaaaaagtattagtygaggagactagttaggaagctgcgtaatacagaggatgatgctagaaataagaagaaatgtgagaagtataagtcagttaaaaccagtagaattctgaaactgagctgaagggactctaggtcccttggaataaaaaagtgccattcatataaataaggaatgttagatgacaagtcagcctgggaaaattataaacgataattataagaacaatttcaaattttgcatttgagatgccattgataggcaaaatayatgggactcagacttagcagagaagtcaggaccaaagatgcatttatcagattgtatartaattaccaaagtggcatttaggaatgggaaagcagcttagggctacatttccaaatcatacacttttagaagacagtcagaaacaaagaataggcaacaaaaaggaatcaaggaatgtatagttttaggaaagcaaaggagataagaattttgagaagaaagagatgatctaatcatagagagaatgactacaaggacactggatttgatagtttacctttagaaattgaagaagtgatttcgggagactggtgaggtccttaatgcctcaggtggaagaaacagtcatggtgacttcacctggtaatacgatgaaaagagatgtgggaaataaatctgccttagtgaggagtagtgtgagaaaagcaaaattcaatgtagaataagtatggtgaactcatttgagatttatgtggaacttgggtatacctacctaaagattgctaaagaaatgagactgcaactgtcaacagattcaatatcttttttcagaaggctggaaaatgaagggaataatagagataaaatcagcttagcttcagtgggaaaaaaaaaacaaaactttttttttaaaacggagaaaacataagtttatagttcaagcatatagagccaatgaaagaagaaaggttgaagaykcaatatttatttcactttcttgggagagcaggtagaaaaacgggaagatttggagactataacattaattttactatttgtagctctttaccaaagttttttcattttttagaatttcttgtaggcctttatgcaggtgtgacagcattaagaaatcaaactttgccttttaatggtaaaattttcttaacaaacagtatttgatrttatatgtatgtaagtcataaatgcactggcctatcttatgacttgactttattgctacttggtgtgttgatagaccaaatattatagaagttgtggtttaaattcctactttgaggcttaaacatggaaatctttgtataacaaagattaaatacaaaacaaaattacatattgaatttcaaaataaaaattcaatgactgttaattgctattaatattataaatattatttcatgtatctccaaaggcagaaatacaatacaaataatattataaaaaagtaagaattactttaattgttgcacaaatttttcaaatttggaggctcaaataatygttctaacatattcactggtaaaacgagtcaagttaagaaagatattatgaattaattgtgcctagatttaatgatattatttattaggtaagaagaaattactgaactatcatgaaacagcctactgggctgcatgtactttgttcagtacttggttcatactctcttcttaaatggcatatttcatcctcatctctaaaagaaaaaaaataaacctttaaactgttactgtaaattcctgacctcactgggagttaattctagttgctggaaaagcatattcattggagtaacctacctgtaaaactgagtttgtggttgcaagagtctcaccataggtaatgtcctttctgtctttcttgttcaagcggtagaggattgattagaactgarcacctctgtcatttggtcctactttccaccatctgagaactattctctggtatctaatgtgctcttatgctagaaatcacacttaagtttcctttgagcacctgaactggctgataggcagaaaatcaatacatcctgttgcacagcttttgaacctgttattagcagaaaagtaacactaaagatatgtttccttacaggataatgcagaattgatcacttctctgcttcacagtggagctgatatacagcaggttggatacggtggcctcactgccctccatattgctacaatagctggccacctagaggtaagtcatgcctttggcacctgtgaaaacaaaggttatttaccttttcggttgttgttcttaactgttttgaaatactgtctttgagactttacaagttggtttattttttagctactgaacacattggggtaaaatttagctgtataaatgagctttggatagtcaattcagtcaattttctaacagtgtatttaatcatcarttaacataaaggtagctagatatacagaggctttatagcagctcagtttccacaacttgctattttaaccttggggaagttactgaatctcatgacctccctcttttcttcacttataaaataggaatattagtaagcctattataatgattaagttagataatttatataaatcactttgtagtttgcttaatgcagagtaaggacaaaatgaaaaatcattcactcattcatctacttatgtattacttgaatgaatatttattcatcacctattatgcaccggatactgttttagatgctgggatgacagtagcaagaaagtcaggcaaaattttcattttatagagtttagctgtaaagaataaaatagacaataaagacaagaaaatattacataattttaattagtagtgagtaccataaaaataataaagtgaggtaaaatgaaaacaacgagagagaagggggcactatttaaaataagctgtacagtaaatatctctgaaaggaggtcatataggaaaagagatttaaatatattgagaatgtcagccatgtaaaaggagagaaaagaatttcaagcttaaggaatggcacttgcaaggaccctgaggcctaaaaaggctgggtgtgtttgagggacatgattgagccagagttgttagagtggagtgagcggaggaagaatgatgaagacaaggtctggtgatgaatggttccaagccaaatcacacagtgttttaaaggtcataggaaggactctggatcttgtcttaaatttaaagtattaattttatatatcctattatgggaaggacttccatttgcatgatttggctaacttcacaaatcctcatcgaatagtttttattgccgctgccatttgatagatataaaactaaggctcttatatagtaattgccttgacaaattacaaagctattgaggaaaagagccatgtttggaatcctgatcattttactcaaaatcccatgattgtcacactctatcaattgtggaaacaccaatagctcaacaatgtaaaagatgagaagtctgacatccttattattaaatagttatgtttcccccttttagtcatgttgcaattcaattataccttcttcactaatacacacacatatacgcacacaaactgtgaacaaatagagctgcatataaaattatacttgaagcctgtaaaacagaggtgatccatctcycttaacagtgtcacttcaaagggctcttacattcaatacaaattaaaatatctcgttgagagcaaaatagtttccttcatgttgacatttccactcctttccatatcaccttatttcctggaaaataaatccttttagtgagattcattgtaaatataggtgagtttgtgttacttatgaggaaaggggaaattccattagattcacctaaatataaatgttttccaaaaaagaaagaaagaaactgaggccagtgataaagtaaatgagtggtaaacattaagggatctgggtgaaataatttatgagttagacactaacttctagtaaaacatgatcaacctcttaatgccaggaaaattacagactatgtcttcaaaacaaaatcctttttttcctaatgttgttttgatgatagcattacaatggcttctaaagcaaagtggttaagagcttagtttcttcatctcctattcaaatagctctgttttctttctttctaaatcataatatggaagaaggtattatattgattttaccagacttagggcaaacttcaccaaagtattccaaatagatctctactcttgccttgcaattcttcatgggttttctaattttcctcattagctgatatttgatgacttttatagtcaatagctaacactgcaaaaagcaagtatagatacattagcctttattctcttcttatatgggggactaattaaattattgatcaaataataaagaaaagggtatccaaaactatctaaaataattatattcaaaatkaatrtttttgttggagtatttctttgaaaactattaccattgacttttgaccaatgtgggagttaggagcactgatcccctgtacagttgaaaatctatatatacattttgactaccctaaaacttaattatttatagcctactgctgattggaagccttattgataatataaacagtccattatcatgtatttttaatgttacatgtattatatactatattcttaaagtaagctagtgaaaagaaaatgttataaagaaaatcataaggattagaaaatatatttactatttattaagtggaagtggataatcataaaggtcttcatcascattgccttcacattgaataggcaaaggaggaggaggaagaggaggggtaggttttgctgtctcaggggaggcagagatgaaagaaaatccatgtatatgtgaacttacatagttcaaacctgtgttgttcaagggtcaactataattgtagtaaatagtcactgtcaatatatctttacccatacgtgtgaattcatttaacattttttcagcccctactttgtctataaatggttagaatatagaaatataggaatgatacaacaaaataagacatagatttttcccctaaatattctgtaatgcaactgggcacacaaaataaatatgcagaaaaaatatataagcaattcaaatgtaaaacagcaatatagttataagtaaggagtaggatggatgagagtaggtttgataattgggaatacaggtgttcctcaacttatgatggggttatatctgagtaaatctatcatgagtggcaaatatcataatggaaagtgcatttaacacacctagcctactgaacatcatagcttagcctagctgacattaaatgtgctcagaactcttacactattctacagctgggcaaaatcatctaacagaatacctcttttgtaagaaaatgctgaatatcttatgtaatttattgaatactgtactaaaaatgaaaaagcagaatggtcgtatgggtactcaaagtatagtttccactcatatgtatcactttcacaccattgtaaagtcaaaaaattgtaagctgaaccatcgtaagttagggattatctattattagaaacataataatgtagagaaaatgtcagagaacacaaaatrgaagagttaagagttcagtgaggatagagattgtattagtccattttcacactgcttataaagacatacccgagactgggcaatttacaaaagaacgagatttaactggacttacagttccacatggctggagaaggctcacagtcatggcagaaggcaaggagaagcaagtcacgtcttacatggatggcagcaggcaaagaaagaataaatgagacgaaaaagcagaaacccctgatcaaaccaccagatttcctgagacttattcactgccacgagaacagtatgggggaaaccacccctatgattcaattatctcccactttgtccctcccacaacacatggggattatgggagtacaattcaagatgatatttgggtgggaacacagagccaaagcatatcagagattaatgtggactcaaagagttagggaaggagttatgagaggggatttaaaattgaactagtctaaagaatgatgagaactagacagcaaaaataagagggatctggcccaaaaataggaaggaaagaatgagataagcacagtaagggacagtgagtaaaatgataacatgaaacaaattgtgaagagtccctctaggtaaaattaggtgttaagaatagacgagactaaagaaacttggagagtagaagtctaaggcgtttaatttaatgcaagaagcaattactgtggtttacaatgtataacacaatttctgtggtttacaatatataacacacaagagtagatggcatggcagattaagagattagtagaacacagaatttctcactctttaaagaaaattagaagaaccaatgtgatttttcccccataggaaacagggactaattgagaaaatatttcagcaagagaataattggagatttgataagtaacatgtttaaaaggattactttactttgactgcatgatttagcatgaattctagtgcgattacatgatgattaaacaaagaaagataaaagcttgggtaaaggattcaatttggaggaaaaatcaattagctccacacatgttgattttctgatgacatccaaattttcaagtggaaatgttcattaatcatttagaaacatacaaacggcatttaatggacacatttgggtttaacgtaaatttttagaaattatatatagagaggtaatatttaaaaccataataacagcttaaagttgtatattgggcataatggatggtcataggaccgagcctaagagaatctccccggagacttaaggaattattaaataaggaattattgaaggaaacaaagaattgctcagtgatatggaaaggactaagattattttaatattgcaattaggagagtttcaagagttaaaggatcccaggtatcaaaaaagttagtgcagaaaagtagagcacattgggataaaacacacatcgagtatttccttactatgctaaaaatttaggtgcttattccactcctattttttattatcatggttagcagaaatagcaacggatcagtgggtgttctgtttcattactagtcactatcttttattgcccacctttctctgtgaaacaatagctgatgctaagtctgacaggactctttgtctccacatatcaaattcagaccttccattagtgtctcaagtgtgtttgtcctcccataattgtgaattctattaaacaatcttacaataaaatttacattgactaggcagctgtcttcttcaataatagaagagaacatgtgctgcagattcctagacatgctgactacaatttgggactcagatttaaatttactgtgctttgaagagtaggcaaatattagttgtcccaggtctcaatacttctctttgactgatacatccatctatcaatacatttgcatatgcttctttgtacaaggcctaagatcctgtcagcaatcaataaacatgcattaaatcctctttttccctttaggtttggggaatgtgagtcatacgctttcccaggcatggaaaaggaaaaatattagctaacatttggtggtactttatcattcacatacatttgtcatttggttgttttgtgagataactactgtcagactcagtttattagtgaggaaactgaggactggagaagctgaatgacatctacatgggcattcagatgataaataaataagctggatgggactccaacctggggatctaccttcacatctgtagtcttatacataaaagagcgattrctccccagagactcttctgtttattgctataacacagcttatacccacaagacacaaaaaaagtatttggaaagtgaaaaaagaaacggaatatgttactatataaagcccaagcattactacatatacgattaaagcaacattaaatgactcaaaactaatttcataatgcattcactatatgggcataacctatggaagtataatgtaggtatatgagcacacaacacacacacacctcaagtgtaaaacactttatacttaaataactccttaaaaagttgttactctggtgttacgtgctgtagtttctgcagttgccataagtcaaatcagttttctgcagccgttgacaactgtttgagcagtgaacagaaaggcatgcagcaaacatgtaaaccaatgtgtaatgtatagaggttgtggagtggttttcttattacagaaaagtgtactttcatatacaccttgtgaaggtgagcgtattattcatagttgaagttattctatcctaccatatcccattttcaaattgtaaacacttattcaatcactgcttcagaaatgcttcccagttattttggaacttatttctgatttcaaggtaatgcactcagtattgtttcagttcattctttactaaatcatccaaatgtttcagtagagaattttgtttaccaagaagcctcrgaccctgtgtaagttattttttaataatcgctttagtttcctctccaaaggcacaaatgacagaatgcttagaattataaaatatggtttctctctctctttctcttatttttaattttttagagagagggtagtcatgagttttttacctaaacagtagcaagtctgccccaatcttgtgaataggcaatagtcccttgtgaactccatttggaatcagaacaaataatgaaacaaaataatagttaatgctttgaatagataactttgtactgaacatattaattgacttgatcctcagttgagagctctctcactcactgtgctgtactgcttctctcctgatccaaacagtaacctctcagctcacctgaccagaatttaagctttggacatgatacacagaagcttagaatatgtcaggaaaacatgccatatctgcagatctgaaccccctcaaagacttagcacattaagatattctggtgcctttttgtatggtccccattcttttgggctgtataatttttctctaaaatttctgcattacattttaatagctttgttgagataaaattcatataccatataattcatccatttaaaatgtacacttcaatggtttttagtatagttgcagagttgtgtaatcatcaccaaaatctaattttagaatatttttgtcacccaaaaaggaaacttaatacccattaagtagtcagtcccacccagccctcactgccaagacaaccatgaatctactttccatccctacagattggctattcsagacattttatataattggaattatgtaatgtggtctttttgtgactggcttcttttattttgtgtaaagttttcaaggttcattcattttcagtaaggttgatttctatcaaaattatgttataattacatatgactttatttagcaaaacagaaaaagatacagattcaactgatagtgtaaatgcaatttctttctactacctgtctattttcattataaatcaatgctggaaggaaatcttcaactaaaacttcaagtccccaaactacacttctagtcacaaaaatgtgcctaaattatcagactaggaacacccccatgagagaaagtggctaaatggggtatcttcctgaatgggcaggccacctcttacctgggtattggacaaggcccctactccagacgattaatcctccttcccaccacaggctcactctttgcattcttargcagttatgactctgtaaaaatgcaraagtttctaatgcttcagttgcggttagctttttgtagttaaaattttagtaatcagttcataggctaaagctttgctaatcaaagtctgatttattgattagcaatatagtataaccagtgaacttctttgaaaatagaatctcaagactacctcagacctgcctataattagcattttaagatttccagatgattcatatgcatattcaaatttaagaaccctcccctaaagagtattagaagaaattagatttaaaagagatatctgaggaagataaatagaaacaatgaatgaatgaatgaatgaatagaaagatgtagctttcatttgttttgctttacaatttgcttttggttggtactgatttaagtgctttagtaactattaaagtggcattcagggctcattctagagcccaggatcataatcactcattgtgcacaatatatgcctagtacttcacacattgtgggtgctctaaatgtatgttatctctcttttcctttctaagatataaaatttcatagtagtagtattaaaataagaagaaagttataatgcaatggaactacaacacaataattataacgtaataaataacccaattgaaaaatgggctgagaaagaggcagagcaaaatagctgaaatgaactccccagcaatcgtccccttaacgccccacaggataaccgagttgaacaactgcccaggcaagaaagcaccttcataataaccaaaaatcaggtgaatgatcacagtgcctggttttaacatcaagaaaagaggcactgaaggctgggtgcggtggctcacgcctgtaatcccaccactttgggaggccgagatgggctgttcacgaggtcaggagatcaagaccatcctggctaacayggtgaaaccccgtctctactaaaaatacaaaaaattagctgggcgtggtggcaggtgcctgtagtcccagctactcaggaggctgaggcaggagaatggtgcgaacctgggaggcggagcttgcagtgagcagagatcgtgccactgcactccagtctaggtgacagagcgaaactccatctcaaaaaaaaaataaaataaaataaaaaaggaaagaagcactgaagagggtgggaaagacagtcctgcattacctaaactcttccccacctccccactagtggcacagcatggcacagagagagaatccatgtgtctgggagagagagagagcaaagtgattgtcagactttgcattggaactcaatgatggcctatcatagtgaaaaacaatacagggcagaattctgccagcccccatggagggagcatttagaccagcctcagccagaaggtaaccctccactgcagcagtaggaacctgacttccagctagctctaccattggttgactacagtgctggggtcctgaaaaaatttgaaagacaggcctcagggactacagtacttgggcaagtactgatgctcttctgggcttgcaaccagtggacttggggtgcacgtgacccagtgagacaccagcggtggtgaccaagggagtacttgcatcacccatctcccaactctgtgcagtgcaacttggggagagacttcttttgcttgggaacgggagaaggaagagtatagaggactttgtcttgcaacttgggtaaccagctcagctacagtaaactaaagcaactagcagactccggaagccctctcctgattccaggccctggctactgaacagcatttctagacccaccctgggacagaagggaacccagtgcgctgaagggaaggacccaggcctggaaggattcaccacttgctgattaaagagccctcaggccttgaataaacatgagtggtagccaagaaatagtcaccacaggctttgggcaagacccagtactatgctgacttcaggtgtgacccagcgcagtctcagctataggaaagtaatttatcctcccttggcctcaattttctagttttagaaagtggattatactatcacccacaataatagatgtgtgtgtgtgtgtgtgtgtgtgtgtgtgtgtgtaatgtcaatatatgtcaaatgcttagacactacctagcacataaactttaggaaagttagctctcatttttatttgttctgttttgtttctgattttactgttatatagttgtaaagaaaaaatgtggtatcctaggtagggtaaaacattaatgtacaatttaacttagggaaatttaatgtccccattatattgagtcttctgtttcagagcaaattctttccatttattcaagtttctttttcgatctttcagcagaatattcttctcataaatttgttaaaatttattcccaggtattttatcttttcattgcaatgtgaatgacattttctagtttgttatagtgtgtgtatcctataaacacactatataaaacatattaaaaatcaagaaacattggttcttgatatttaagtttaaatcattaaacttactgatttgttttatcatcatatggtttagatgagtcttttggaacttcctggtttacaattaaattccaatatatggtgataattttgcttcccttctgataattaaacatcttgtttctctttttcctaattgcagtggttgatattttcagaacaattatcatttttcaattgaattatcattgtactcctggaatgaaacacaattggtcatggtacattattcccttagcttgctgctaaacttgttttgctaatattcataagtgaggttggcctatggttttcttttttgtattatggcattagtttccaaggctgccaataacaaatatcacagactgagtgaaatgtatctcactgtacattacagtagagttagattagaacacagagaccaagatgccagacatgtgcacacacagagatatgaccatgtcatatctgctactgctaccatggcccatctgctacttatcacttgttcatgtacaactatacatttctgtacaacagaaatatattttctcacagttcagggcaatagaagttcattatcaaggtgttggcgaatttgatttcctctgaggcctctctccttggtttgcagwtgcattcgctgtatgttaacatgctcatatctctgtgtgtgcacatgcctggcagcttggtctctgtgttctaatctactctttttatgaggtcacttgtcatattaattaatgcctaccctaatgaccttattttaacttaattacttcttcaaaggctctatttgtaaatagtcacatcctgaggtattatggggttagggcttcaacacgtgaatttcaggggacacaattccccatagcaattatccttgtcagattttgaaataaatgtcatgttgaatctgtaaaaataatttggaagcttttctctgtctctttctgtctctctctttctctgaatctgttatgtagcctgatgttgtttttatttcacacaatgcatcaatattaccttgtctctgataagtctcccaaaatttcacaggcagagaaacaagtcctgtttctgtaggagaccaccaatatgcacatctcagactaccataatttggatatggaaaacatcgcaagggccaaatatgccagccgatgcacatcattataaattattgtttcaatatcaatctagggaatgtcactaatgattgataggtattataatcaccattcattgtcattaactttataggtttccatacttggtttttgtagtcatgtgcagttccacaatgccaaaacttgatataccttcattttaaacagttaagtttctaaaagtaaacctttcttttacwcatagtcttaaatatctaagactcaatttaagaacactgcatattctgtggcattygaaaatggtttcctcgggagttgaaaccataaactctataccccattactgagtgtgccctatgttacagaatactcyttattaaaggtgaaaaagcaatctactactctgcaggcttttggtctggagataaacacaagatcatagatcatgtattattatcagttattttaaggtctcagagcaattctttaaacatgtatcaattgtaaggagtaatataaaaggacgctagcttgtcaatttctttttgtcactcaggtctttggcatagactctgttagctttattaaacattaagtattgctttcaggktgaggtagaagagcataagcaagaaaagctttataggctaataaaaatgtaaatgagatgttcatcagcttgctgccctggaaaatgatggaagaaacattacctgaaaaattagattcaacrattattgctaaccaaatcaacctgatatgagaaatccctttgtaaccatttgtgttaatttgcatccttatgtcaatctttctatgcactgaatttgcttccaacatcctaggtcctctrtacatatatatgtagataatgtatatacacatttttatatatacatagaaatatatacacatatttgtataattcatgttattaattaacatgtattagctaaacagaaatatttctgttacatatttgcagcagttggtaagaaacgcctatatattttaattcgtctgcacttagccttctttttgcacaccatactccttacaaggaatttgaagactgagttgtaaatcagaatttctatagcttgttaaagtcacatcctcagagtttggaaacctctgagctcactatgtctcaggaagaygggaaattcttcttctwcttcttcttccccttaattaggaatacattgtaataataatattttctatgtgacctttgaatacagtagtaaaataacaagtgggggctacttacttttctcagggatgattcatcctgggatggtgtttagacagtggcctttgagtattggatattctataaacatcgtgtgagttgttcttcttgatgactccctttagtggatctccgaagaccctttagaagcttgctgagggtgggatggaggaagaggctaaagcccccataactgactctcagcaactgtcctctctcacagaatctctcttttgcggtgacccttaaaggcacttggcccatctgctacttatcacttgttcatgtacaactatacattaggccaatatattaggttggtacaaaaataaatgtggtttttgccattatttttaatctaaaaaacctgcaattacttttgcacaaacctaatagttattgtaaaggatggaacttttaagcaaggcacacaaaaccttctaaagtcactctgagaagcaattcagagtagccccttgctgcatctttcatttwgcagccattttactcttttctctgccctaaagcagatctcaggttactaactaacccatttatgccagaggttgcacatttttttgtgtgaaaaatcagaccttggcgatgaccttgagmagtaggatataaataactcccacaagcttagcgttccaataatggaacactaggcataaatgggctaactccttcagctctgggctgagtttctcacaattactgcagatctccacatctgggcaggtcctgacaatagttaaagattttttttctcataatttgtcctgaaaggacatatattgagctattcaggagacttgagaaaagttccaagttaaataggataaagggcaatggatacacattttttgttcagaaatataaagattattcttagttagaggtgaatatgttccttcactgttctctgaattcattctgtcattctgctcctggacttcctacaatagtaccttgacttataaggcccgtgtccagatcttttacagtccacttcattcaaaatgctcctgaaaaattcaagggactcactaacacatggctttggtaaaggcattctcctgaacaaaaacctttctgacctcaaaatacacctagcaagggatttagtggtgataatctagctctcctaccttttcagccctggatctttatgctctttatcttgcaaaacatgctctaaattaaattaactgctacccatttgtatgccccgtgtttctacaacactatagtctctttatggttcaccttttctacccatccccaaagcccagatgaaatgccactttcatgaaactgttggatccatctatcctgaagtttttctatgctctgaacaaccacaatgttttttttgtacctttctaataacatgtaacaccacctgtttcatgagcatagttttattygattattttattatactcttttttgagcacaggaactgcacactagaaatcatcatatttctcacaggttccaatattgtgatttttgcatacagtagatttttaataagtttctgtcaaatgactaaactaataattattcaagtgttttaggaattawacagaatgaggaaaattatttctactctccataaaagcagaagagattataatgatacgtttcatgaagaaagtagcttacaaaattacaagcaattttcatgaataacttcaaacaaattagtcttaatacctataaaaagtatcacagccttaaaaaaatgatgacaattaagtgatgtcagcagtatggcagaataggtgtttccattgcttgtcatctcacagaaatatcaacttgaagaactatccacacataaaaataccttcacaagagctaagaaattcagatgagagattatggcatctgaatggagcagagaaatcagcaaagacacattgaagaggacaagaatagttttacattatgcatgtcaccctttcctaaagcctaygcagttcagtacaaatagagatagcctccatgtaaaggaaaagaataaagtgagtccctaacttcattgcaggccccagcaccatgcctaccccagtggattccagaaccaggccagtcctcatgtccccagacctctctctggcccccatggacccagcatccaggcccatgtcrctgccaaactagcccctgtagcctgtggcctcaggcytcaggctcattctaatatcagaccagccctcacagctccaggcctgctctgggccaccccagtgccaggaaggcccccataagtcaggctgcaggccagccctagtagtcccaggctactagggactagagttcatgtaagccctcctacatgaactcaggtacgaggctcattcatatggacccaatgtccaggccctccccagtagacccaggctccaggctygcccctacaaaaaaagacatcagattgacccctgtggacttaggcactaggcccatgaacccactgacytaggcagcaggccagcctgcytgaggactcccgtggcaagcccactgcaaaccccaatggataacctggtcagaatctctggacaagctgtctggtgaagggctttccttgccagtctgtaaagactggaagaagtgtctacttcaaatgcacagataccaatacaaggccacaaggatcacaaataattagggaaacatgatgctacccaggaaacaaagcaccaggaactgaccctaaggaaatgaagatttctgaactgcctggcaaataattaaaaataatcaccttaaagaggctcaatgtgctccaagagaacacagatatcagaagttcaacaaagaggtagaaaccataaaaagaaatcaatcagaaactcagaagctaaagagcacaatgattgaactaaaaaatttcacagagaacttcaacacaaacttgatcaagcagaagagagaatcagcaagaaaaaaaagaaactaaggaaaaaaacaggtcatttgaaattactcagataaacaaaaaggagaaaaagaatgacaaacgtggaaaagcctacagcacttttggtacatcaacaagtaaaccagtgtatgcattattgaggtccaagaagaaacagagaaagagaaaggggaagaaagcttattgaaagatatcatgacagaaaacttttcaagtttggaaagggaaatgaatatccttatccatgaagcccaaagaaccccaaagatacagagatattcactgagacacatcataattaaattctcagaaatcaaagacagagaaagaattttgaaagcaccatgagaaaagtgactcatcacatatataagggtataagaatatttattcaacaaaggtggcaggaacacacaataggaacaggacattctcttcaataaatgatactgagacaaatcaactcaaaattgactaaagacttaaatgttaagggctgaaactttaaaactactagaagaaaacatagagaaaagcctttttgaaattggtttgggcaatgatttcttggctatgacctcaaaaacacaagaaacaaagcaaaaagagattaayaggattgcatcaaactaaaaagcattggcatagcaaaagaaacaatcaacagaataaagagacaacttatgaaatgggaggaaatatttgcaaaccatacatctgataaggggttaatactcgaaatatataaggaattcaactcagcaactcagtaaaaggacaacaaatattccaatctaaaaatgtgcaaaaaacctgaaaagacatttctcaaaaataggaaatacaaatcgccaagaagtatatgaaaaaaatgcttaatatcgttaattatcagggaaatgcaaattaaaactacaatgagatattaccccataccattataaaatggctactatcaaaaaggcaaaaaatagcaagtattgacaagaatatgcagaaaagtgaaacggtacagcagttatggaaaagagtataaagattcctcaaaaaattcaaaatatgactaccatgtgatccaacaacctcatttctgggtatatattcaaaagaattaaaatcagcatrttgaagatatatctgcattcccattttttaaaaatggtgtctcattctattgctctctcattcgtattgcaacattattcacaatagccaagatgtgaaatcaaccaatcaacctaagtgtccatctatttatgaatggataaagaaaatgtgggtatagaatastatacatatcatatatgtgaatattatttatcttaaaatgaagaaaattctctcatttgcagcaacatgaatgaacygggaggacattatgccaagtgaaataagctaggcacagaaagacaaatgcttcatgatctcacttacatgtaaaatcttaaagccttaaaattacagaagcagagagtagaatggtggttgccgggggctggatgtgaagaaacagggatgcgttggtcaaaggatacgaagttttagttatgaagaatgaataaattctggagatctaatgtacaatgtagtgtttataattattaatattatgttgtatactttaaatttgctaagagagtaaatcttaaatgttcttaccacaaaaatttaactatgtgaggtgatggatatgatcattaggttggttgtggtaatcacttcacaatgtatatataaatcagtcaaagcatcatgttgcacaaaataaatacatactttttatttgtcagttatacctcaataaaggtggaaaaataaatttttaaacactgaatataggtaaagctaaaagttatatgtggggatatggggaaagagtgtatgttgtggcttggagcaacaagtaaaaggattacatcttcatcttccacatagtgtggttaaacagaaaaaaataaatattaaaaaaatcaattatttttacattgtgtatrtaaatatccaaagaagcagctaaattagtcaaagtgcttatctttgggaaataataatggaaggagaagtaaaccagagaactttgtttttcaaagttgaccttgtagaaccatttttgacttaaaaaatggatatatgctgttttgatttttaaaaattaattaaaaaatgatgatcacattttgtctttaaaaatttttgtttaaaacgtatccatttcttctccccatttaatatatcttttgaccatttaaagtataaaaaaagaatttggacttaatctaatgaagaagtttgaccctaacaaaagagagtaatggggtttaaatttatgccactctacaaaaaagaagtcgaactcacccataggtagtgaattacagtcctgtgctatatcacacagccttgccattgatagcatggaaatacttcgaaatactgctgtcaaaatttgcaaactgtcaagataaataagttcattcagattatttatatctgctgtttctccccctaacctcatacttagaaaattatatrtgtctagtccttctccaacttgattttatgtcttttagcctaatacattggcaaaccaaatgcatgactctgacaccgataatactaagaagggctgaaatgaattgttagaatgagagacagtcactttgtttagaagggagtgctccatgagcagtgtgataacatagctccttgaaaatctagtcaatcaccattttatagtaaaagcctatgaatttttgtagcttggtgtcttattgtctctattcaytagttgcttctaacttttctgggcatccccagaaaagtggaaacctcctgtgaatgaggcaaatttagtaacctccaattaatcaagcacactaagcacataccacatctgcaggaataaactaggtatgggattaaagagatgtatagaattaattctttgcttaatgtattttgccattctatatttctttttttttttcaagagagcaagtctaagtcctccctggagaattgttgaaataatgcctaatttaggtaactaagcattttaagcctttctacacttttataatatttgtaattgaaaaaaacccagcaccaatatataaataattaatttacyttygaaatactgctgtcagaattatgatgcaaactctgcatcacatttttgcataccttttaacccaggaaattcacttctagaaatttattttacgaaaataataagagattgaattgcatgggtgttcatgcaaaataaaaaagtaaaatgctctaaatgcccagcattaaatattgattaaatcaaaacagtgcatggatatggtgggacactatgctatcattaaacatgacattgtacaagattatacattgacatgaaaagacacatataaagactttgtgaaacatgtataatgttatttaagctttgttgtgacactcaagttttttctttctttttagttgttcttattactagaatgaatgcattttcttaaatattcacctttacagaagtgactacacaattaatggctacacacctctccccacttatttctgcccaaagacaactactgttgacattttggtggatattctcctaggttgtttcatgtatgtctttttcaaatgtaggatcacactaaatgcttctgaagcatacttttcttatttaaaaaatacagcagacagcttctaagtgtgcaccatgttcttttgtaaacatatgtattttaaatatatgcacacacataaagagagagaaagaggctgtttaaggagtaattgttaagtggatatgcatgcaacgaccaccagtttaagaagtaatttctagttccccggagaatcttcatgagaacttctgatttcatatctgtctccttcttctagagtaatccctctctctctatggtaactattcctttgctttcctagatattaagtatatgtaaatgtatgtgtaactctgtgaatatgtatctctgtataaaatcattaattawatatttttaattttttctgttcttgaactttatgtaaatgaaatcaaaggcatatttttgtgactttattatttattgtgacttctttgtgagtgatcacttatgacattttaacaatttttttatgcatgtggctgttacatagccacataatatatgtttacataggtcttatgtacaagggaaggttctaagcacattatacagattatcttgttttatgtcgggaataggtatcattattcgtttcattttacagattgggaaactgagttccagaaaggttaaataacttaatgtaggtcacacagctagtaagtggtgtagrttatattctatcctaagttgactgacttcatagtctgtgatcttaaccatagttccaacctgctttctgttacagatgagtatgctacagatgccttctgcttatttagggttaatgctttcatatattaagaatcccccaagactcaatttcataaagatattttaaattattatcttaargtttgatggtttgccttcagtatttaagtgctttacctacctaatattgattccagtctatggtacaaagcatgggtttaacttaattttttgacatgttcaattgtctcaacaccttttattaaaaagcttatattttccttattaataatatacaatactaattctgtcatatatcaagtgtccatttaattgcaaatctgtttctagatctctgttctgttcatttatctayttatctagtcatgcaacatcctatataaagttgttcagaatagtctcttaataattttaattttctaccaatagtggcatattcttttttattcctgatactgattattttggtctctctttttgtcggtcttatcagaaatcagaagtttagcaattttgtgtctttgcaaagaaccaacttctggctttgttgaatttctctagtattatatgtttgtcttttttttaatcaatttctgcttttatctttcttaacttcatataatttcactactgtttttctaatttcttaagatggatgcatagcttagcttattaatayttagccttttttttctaacagcattttaggctacacatttgtaagttctgtttttggcacatttaagttgtaatatattttgttactgttcagtttaaaacatttttmcttctactagaaattctttttggacccataaattatttagaagtaggtttccaactttacaaacttagtgtttttaaattaccttgatattgatttttaagttagttgtactgtaagcaaagaacttygtcattagttttccagtatttgaaatgcattgagtgctgctgtaagggccaatatttagtcaattttgtgaatgttccctttattcttgaagtgaatatgcattctgcagttgtttgctacacagcttataggtacaaatttgatcaaggtcttaattgtgtccttcatgtctttcatatctttattgtttcttgttggctttatcaattttgtgttaaaaatttttcaccatgattgtagatcttgctgtttattgttgtagttctataaggttttgcctaatatattttgatgytatgtgttattgatataaaatttaacatggtttatagtttcccagggtgaattaatgaatacattacaatagattgaacttctctatctctagcaatggtttactttacccatgaagtccaatttttcccttatcaatttaataatatgtgactttattgcttagaatttattggacatatctttttctatactgttattttaagacttcataactgttttactttaaaggcattttgtaaatggcatataattgaattttattctaccctagacagatattcttttgcctgaaagattaattcacttttattagatattattacttacatatttggagttgaatctaccaacgtattttgtatttccatttgctccatcttgtcttacgtcaaatattaagtgcctgtatatgtgatgatctgtttctagactctatattaacctactgttctatttgtttgttgtatgtgagtaccactgtgttttccttgctgaagctttacaatgagttttgacatccaagcatatgaatgtaataatcttcttctttaagattttctttgttactttttcgctttttacattttattatatattaaaatcagattggtaattctgtgatttttgatagaactattttttaaatttaaattaaaattttcatttgtttcttgttgctaatgaataaaaatataatttttgtacactggccttgtttctagtgattttgtttaattcacattttaatgatttatatttaccatgggaatgattcgattgcaaatagattcttctgtccttagttttctatttctttttctttccttatttcattggcactctagaacaatgtcaaacagaaatggtgacaaagaatagacctgttttattcctgattttagggataaaattatatttcagcattagctatagagtttctataattttgtgattattttctaagtatgtatagacatttttatcacattaagaattttttccttctattgtttgctaagaatttagtccacaattactattaacattaaawtkttatcaaatattttctcatctattgagatcattatgtaattttcttctattatttcattaatatgctaatttacattggttttgaatgccaaattaattttggattcctaacataagttgcactttttctgacatgtcatttttatactcgttgaattcagattgttgatgtttttattttttaatttacaaataaaaattatatatatttatggtgtacaacatgatgttttgatagattcttgatattttctttagaatttttgcaactgtatttgaaagacattgtcctataatttattttctcataatgttagaaaaccctggcctcatagaacaaattagaaagttctattctttggaaaagtttgtgaagatttatgttatttcctccataaatatttaataacattatctagtaaatttatctaggatatgkgttttctttctggaaatgtgttcaaattatgaatttgatattttcagaagatatggatagtggtttgtgggaatctgttgatactgacactggctcagggtgcattttgcacacctctttctaactctctcctcagtgatgtcatgcaagtagcttaaaattagccattgtggaaatatttacaacacaaaaatcaaaaaaagtgtggcttattttttgagagctgaaggaaaacttaaatgttttcacttcttcctatgttcattttttaaagttgtgatttccaaggcatttgattatttcacccaaatctccaaatttattggcataaatttgatcataagtgcttcattatatttaatgatctgcaataatgatctttttcattactaatattatgtatttgttccttctcaatatttttcctcaggtatctggtcagaaatttttcaatttgtaattattgtttgtttgaaaaccttttgtgcttttgttatcttctctattttttttactcaatttcattgttttcttctttttaactgtttcttttagttttctggggaaaatataacttggaattttttctaacttcttaagatgaattattagattatttattttcatcctttttttattgtttaatatttacatttaagactatagtttttcatttaaatacagggttagtggtatacctgaatttttatatatttacacactcattcacttcaaatattttcagatttccattattatttgtctcatgggtcatttattttttcattgctaaattttcaaacattttgacagttactaatttttttttactttgatttgcagtataattgcattatgctcagaaattatagtttgtattattgcaatgtttcaaaatttggtgaggcttgctttatgaccaagcatatggtggattttggcaaatgttctctgcatacatgaaaaatatgtccattcttcagttcctgctttagttcccacttaggtaatttttgtcaatcacattttaaaaattgtctgtatacttactgttttacgcatttgttctatcagttaataaaagagttgctttaaactctcccactataatcatggatatctattttttacttctatttctcaatattcaaattatatattttaagcctatagtaataaaatgcctgttgatttagaattgctatattttcttgattaaatggctccttttaaattataaaatgtcccttttcatctttagtaattctcttcacctgaatttctactttatcttttagcaatatcactatgccagctttcttttgaatagtgtttgcatgacatttttcttttgatccttttatgttcaaactttttgcatctttatatttaattgtgtctcttgtaagaaatattcgtattttaaaatttgagactaataatattccrtctgtttatttaatatttaatttattggatatatttgaattcaagtatattgttttattacttgattttgttgctccacctattgtttttgttcattttctgtcttcttttaagttaagtatttttactggtctctgagtggtcaccttagagattatactgtgcattctttactcattataaatttgggccgggcgccatggctcattcctgtaatcccagcagtttgggagtccaaggcgggcggatcacaaggtcagaagatcgagaccatcctggctaacacgttgaaaccccggcactactaaaaatacaaaaaattagccgggcgaggyggcgggcgcctgtagtcccagctactctggaggctgaggcaggagaatggtgtgaacctgggaggtggagcttgcagtgagcggagatcgcgccactgtgctccagcctgggtgacagagcaagactccgtcaaaaaaaaaaaaaaaatctgatataacattgttcattaaagtataattaaatttgctacttcccaaacagtgaaagagctttaggatactttaaagtatacctctcactttcttttattctatttttgtcatatattacctttttgtgtatttatttaaaatgctatgtcataattattatttttaatatagactatttatttagctttaaacatatatttaccctttccatagctatttattccattctgtgtgtctgttattctctctggagtcatgttgttcctgcttgaagaatttcctttaacatgttcttgaatatttcctttaatgcacatatactgggggtgtattttctggttttgcttgttagaaaaaaaaatgacttattcactatcaattttgaaggatatttttagtggttactgaattccggttggacaggagtttggtcttgcttggttttgttttcatactttaaagacacaattccattatttgtgtcaagcaaccaatcatcaattttactgttgcttatttgatagtattgtgtcttttaaaaaatcttgctattttaaatttttttccgttggtgttatcagttttaccatgatattcccagtgatgattttctttttatttggaatccttcagatttgtagtattaattgaatatgtggcttcatgtatttcttcatttgagaaaatccctcaggcatttcttcatttcttcatttgagaaaatatctcaggcattatctcttaaaatattgctttatgtgccattctctctttcctttcctcttgggacttgatttttttttaattttagaaattttttacactaatataataccttccctgtgttttctttttctctttgtctctgtacttcaacatagatcaacaccatacagtagaagtttctgtgatggtggaaattctgcgctgctcatttggttactgtagtcacatgttgaatacttcaaatgtagctagtgtgttatgggctgaacactggtattccccctgatattcgtatgttgaaacacgaatcccccttgggatcatatttggtggtgggacttttgggagaccgtaagatcatagtagtggagccctcatgatggaattaagaagaggtaagagagagcttgcttcttctctctcttggccatgtgaggaaaccaggatgagggctctcaccagaacctatccatgcttggcatcttgtccagtgtgtgtgtgcgtgtgtgtgtgtgtgtgtgtgtgtgtgtgtgkataaatataatattttctttatccattcacctgtcaatggacatttcagttgtttccatatcttgactactgtgaataatgtgcaatgagcatgggggatacagatatctcttcaaatactgatttcatttattttcatttgggttttctcatagcatgtcagggtagtcgtatttcttataaggtgcctctggtctataattttttgtatttcaacaaataaataaaagctacatggccttttatgacctagccttgaaagtcacatagcatcacttttattgtactctatggttaaaacaatcataaacccatccagtttcagagggaggagaaactgactcaacttctcaattggagagtttcaaagaagttgtcactattttttttagcctccaaagtctgttatttgactataatttatttactttaatcccatatgcaaaatacattctcctcttcagtttccctcccaaaatctcattccattaccacactatgctcagatttcaggatctcatcaaataagtcaggtctaagtgtgaatgaggatccacagtttacttcctccactatggttgatctcattctgaatactaactaaagatatcatttatttgcctctcatatactcagcatacaatagtagagtaggcatagatatacttattcaaaaagtaaaaattagaggcacacaacatgtaacctgatactgagtttgagtatcttcttctcaaagactcaaacactgcaacatagtcaggtagtgtaaatagtaatgaatgattgcagtaaagttgtaagagctcttggttacttatatgaatatataggtaagcattttaaaataaagaattgtcatttgtgtatgtccgatttaagtataaatgtttgcacaactgcaaattgataattgaaatttttatcatgatataaaaattacactgatcttttggtcactcaaatttgagagttaaatcatccaaattttgagctatcataaatctgcaatagactttgtcccaggtatctggttaaatcatcttctgctgtaggtttttctccttttcaatcctcaaatcataataactttatacttaataagtttggacgatgaaaactgaggcctctttcacacatactatatataatatacttccctgccttatgcgggagttgcatcacggaataatattgtgaggataagagacatgtagacatctcatggctaataaattttcaacaaatattttagttgttttaattttaattctgaaggaatcagaaagtgtccattttggtttataaaaaagcatcaatgtatcttctaaaagtgccataaataagataccagttggcagatttattgttgatctatgtttaatttaaacttgtttttggaatataggaaacacggtgaaaggaaactgacagctttgaaaagatatatcatctgaaactctatactacatcactcattttaaattaagacttgatattcttcctgaattatattagaggtggaaagagacagagtgaggttttgttcttcagagtgggaaaaacagaaattaaaaacctcctgaatcattgatttcatgaaatatgtcaaattatttgccactgtaaatgtagcagcctctaccctgaagcgtgctgattggtgacaaatatatgtgtttaactgcttatggttactggcttttgcatctttgtgacagaacattgaagtttattttttgtttagagaatttaccagtatacatgagtgtaatcctgtttatcttgctattttaaatacgttgttagtgtaagcgtaacattttgcaaacatatatcaaataagtagattagaatcttgaaagactttttttgatacagtaaatttccatgccaacagtatatcattggctgaactattgtgaaataaatgtagcacagatgaagccacctatctttgaaaacaacctgtattgagcgttttcagtatgccaggtattttctaagcactttacattgattatctctttatattatcataactgcaaagataggtggtattattatcttcattataaacatgaggaaactaagtcaccctattgaatgtgagaatattcaaggtgaaggaaacagcataaataaattcacagaggcaagaagcatcatggtrtatgtagaaaaatactagcagttttatgtggctggaccttgaagtttaacataacagggtttggagaggatgctgaagagacaggcagtggctcttttatgaagatatttgtatgttatcttctagagcaataagccaatatttgctacattgtattagctaaattattagtttatatttacatatcaacaaatacatactgttaaagatgtactaaatggcatattcattaaaatttcattcatttttgttcatattcaagaagttttcaaaactttctagctaattttataacttagaatcctatatatttgcgtctaccttgaattcactcttttggctttagaattatcttctttctttatcacttttgtggcaggattaaatggcatttgtcataattttcaagaagcagaaatctaagcaacacactggacatttagggacatagtaagaatgagaaaatacttctgaaaagacttttacttggccagagatgcattagatcaagtttatggaccacacgatttgtttttctgtgagaaaaaatgactttaaacagacacctacatatgtgctcacatagtcatatattttacagtctatttaagtcattgtatcagaatctcgctttctaagggttttctttcaacataaacataatttttagggttttatttaaatataactaagatatatgttattrctgacactgatgggaaactccctgaatggaattacagaattatcattttgatgttagaagatcgaagcaaataaatgatttactagaggacaaagtgaaaggcagaagagagcctagagagcaatataaaatgcaaagatcttaagcctaaagctttggagctcagagtttagtaaagaccattctcccactaaaatgttgaaataggattgagcagaattattcacaattcctgtcccagtttgtagcttgtacatctatttcattgtatttcgtgcatagacaccagttatgaggcagtacactgactggttaaaagtgtaggtatgctctggaggcaaacaaatttaaatttaaatgccagttttgttgtttgctatctggctagccttgggtggggatgaggtgcttactttatcaaactctacatttctttctctctaacrtaatcataataacaggattgacttgttatgttgttttgggggaaatgtaactaaagagcctagaaccatgactgatactgatctacgaggttctatctccttaattaagcataaatatgtcaataaagtgtgaatgtgcatttctatggagagatatgcaagatttatcttaaggatatgactatgtataaaatacatacacatatttctctcttatatgtgttagttaaaaagggtaaggctgggtgtggtggttcatgcctgtaatcccagcactttgggaggctgagacggcgggatcacctgaggtcaggagtttgagatcatcctggccaacatggtgaaaccctgtctctactaaaaatacaaaacttagccaggcgtggtggtgcacgccaatagtcccagctactagggaggctgaggcaggagaattgctggaacccaggaggcagaggttgcagtgagcygagatcgagccactgcaccctagcctaggcaacagagcaagactccatctcaaaaaaaatgatggggagggggttgatataggaaattaagaatgacccagacaatcctagaaaaggtaaaaacagaaaaaagatcaatagctatcacatcaaatagttacatggagagtaggaataactgaagaatttcaactttatagattagtcacaagtcccctaaaaaagacttgattgcagagaattgatccattgtgtcctgggagatatggcttctcagtgaccctaatgtaacagagcagctaaccaaaatctatgttcttttcttcctcctggacattcaggaagactgaattttcctgtcccactcacagtttgaggtggccttgcaactgaatactcaatgaaggaggggtgcactatttccaggtgtggccttcaataaccatacttgcttttccatgctatttctcctgtggttgactagaataaaactatctgtcagaggaaccttggaaacattttagtaaagacagcagtgacttctaartgactatgtggaggagagccaacatgccaacctatttaccaagtgcctattggtaaatgtgcaagaaatgaacttccatagcataccttgtttcactgcactttgctgtattgtgctttacagatgttgcatttttataaattgaaggttagtggcagctctgcatcagtccagtctgtcggcatcatatttctaaaagcctgtactcatttcatgtccctgtgtcacattttgataattcccacaatatttcaaactttgtcartattatatctgtgatggtgatgtgttgcaattgttttggggagccataaacagtgcccagacaaaacggtgaacttaatacaaattttatgtattcagactaatccactgacaggccattttcccatctctctttctctccttgggcctacctattccctgagacacaataatattgmaatcatgttaattaataactctacaatggcttctaagtgttcaagtgaaaggaaaaatcacatgtctctcactttaaatcaaaagctagaataattaaggtcagtgagaaagatatgtcaaaagctgagataggccaaaaggtaggcctcttatgccaaacagccaagttgtgaatgcaaaggaaaaattcttgaggaaaattgaaagtgttattccagtgcacatatgaatgataagaaagccaaacagccttattgctgatacggaggaagttttagcaatatggatagaaagtcgaactagtcacaacattactttaagccaaagtttaatacacagcaaggccctaactcttttcaattctatgaaggatgagagagatgaggaaatgcataagaaaagtttgaagttagctgaggttggttcatgaaatttaaggaaagaagctatttccataacaaaagtgcaaggtgaagcaacaagtgctgatgtaaacactgaagcaaattatattgaagacctggttaagataagtgatgaaggtggctacactaaaaacaatttttaatgtagatgaaacagtcttatattggaataagatgccatccaggactttcaggctagaaaggagcagtcaatgcctggattcaaagcttcagaggacaggctgattctcttgtcagcaactaatgcagcaggtgactttacctagaagtgaatgctcatttactattctgaaaatcttaagtcacttaagaastgtgctaaatccactttgcccatgctctatgaatggaacaacaatgcctggatgacagcccatctgtttacagcatggtatactgaattattattattattattwttattttgatatggagtttcactcttctgcccaagctggagtgaagtggcatgatcttggctcactgcaacctccacccccaggttcaagtgattctcctgccacctgccaccatgcccagatattttttttctatttttagtagagacagggtttcgctatgttggccaggctggtctctaactcctgacctcatgtgatctgcccgccttggtctcccaaagtgctgggattacaggcatgagccactgtgctcagccggtatactgaatattttaagcccactgttgagacccactactcagggaaaaaaaattcaattcaaaatattactgctcattggcaacatatctggtcacctaagagctctgatggagatgtacaagaaggagatgaatgttgctttcctgcctgcaaaaacaatatccattctgtagcccatggaccaaggaataatttcaactttcaagtttcattatttaagaaatacattttgtaagattatagctgccatagatagtgattcctctgatggatctgggccaaggaaattgaaaatcttctggaatgggttcaccattctagatgccagtaagatcatttgccattcatgggaggaggtcaaaatacctacagtaacaggagtttggcagaagttgattccagccctcaaggatgactttgagggatttaagacttcagtggargaagtaactacagatgcagtggaaagagaaaaactaaaattacaaatgaagcctgaagrtatgattgaattgccagactctcatgacaaaacttgattggatgaggaattcttcttatggatgaacaaagaaagtggtttcctaagataaaatctactcctggtgaagatactgtgaacaatgctgaattgacaagagattcaaaacatttcttcaacttagttgataaaatagtggaagtgcttgagagaattgacccaaattttgaaagaagttctactgtgagtaaaatgctattgaacatcgtttgctacagagaaatctttcatgaaagaaagagtcaatcaatgtggcaaaccttaacattgtcttattttaagaagtttccaaagccattccaatcttcagcaacacccacatcagcagccatcaacatcaaggcaggatcttataggcaaaatgactacaactcactgaatactaggatgatggttagcatttttaaattttttagcaataaagtgatgatgattattattactatctttagacacagggtcttgcactgtcacccaggctggagtgcagtggcacaatcatggctcaccgtaatcttgaactaccaggctcacatgaacctcctcactcagcttccagagtagctaggactatgggtttgtgccaccatgcctgtctaatttttawtttttttttatagaaatggggtctcactatgttkcccgggcttgtctcaaacttcctgccttaactgatcctcctgctccaatctcccaaaatgctgggatcacatgcatgagccactgaacccagctgacaataaaatattttaaatcaaggtattacattgtgttttgagaaataatactgttcatacttaatrtaatacagaataatgtaagcataactattttgtgcactgggaaactaaaaaatgtgtgtgacttattttattgcaaaattaattttattgctgtgttctggaaccaagcctgaaatatcttttaggtatgcctacgctggatttgagacatgtatttgtgagttcattagttacagtagctagtattaccctattttagttattaattataataatatggtaatgagatataatggaatttaaaataagctaaagtaggatatcagatatctattcttgttggactttgagtaagaaaaagaggcatagggagaggagttacaagtaggaaagggatgtagagaaggtggggaccatattcatgtattgtgttttggtcaawttgacaattttgatgttgattatcaggcaggctgcaagtagtgaggggttctctaagagccaggttgaagtgaccgcactgtagaagcctacttcaggactcatttgaagctgactcacacagacattaggatcaggaggtttttggaacatgctttcaggatcaatacccatgaagaaaaataaggaaccagtactgagctgggaagaatttgggttgtgatgcagcctcaatgaaagcccagtcaatcccatgaagagctcagaaactagaaaacccttgaagcttttccaagctgtaaggagggagctgtgctcttatacttgcaaagcaactagtcgttggtctctttctgccmagtggaaggggcacatgactttgagcaaggcagccgtcttcagccaaggcaaatccccagagtgaggctgacagctaagggctgtgctgtctgctcttggcccaacagtattcccagaagcttggggaataccttcttcagctattacaaagccatctcagttgatcaagacctagattcagttggttaatttttaaaatttgcaaaagaaagaactcattaaaaatacatattatagttcaatattttgttttaatttaatatataaaatacacatttattgtcatacttttaatatggaaccaaagcttattctttcttcttactatttttaaaattttagtttcagggggcacatgtgcaggttacatgaatatattgcataatgcttgggtttgggctactgaatccatcacccaaaaagtgaacgtaggtagttgttcagccattgttcacctcccttattcctcacttttggaaacctcagtgtctatttccatctttatatctgtgtgtcaattgtttagatccctcttataagtgagtacatggagtatttgattttttgtttctgagttaattctaagtgttaattcacttaacacttaattcacttaagatatggcctccagctccatccatgttgctgcagaggacataatctaaactggccatgtaatattccatggtacatatgtaccacattttctttatccaatccatcattgataggcacctagattgattccatgactttgctattgtgaattgtgctatgataaacatatgagtgcaggtgtctcttttgttagaacaatttattttcttttgagtagatacccagtaatgggattgctggatcaaatggtagttctattttcaatttttgcaaaatctccaaactgctttccacaggggctgaactaatttacattcccaccaacagtctataagtgtttccttttctctgcgtccatgccaacatgtgttagtttttgactttttaataatagccattctgactggtgtcagatggcatctcatggtggctttaatttgcatttctctgatgattagtaatgttaggcattttttyatgtttcttggccacttgtatgtcttcttttaagaagtgtctcttcatgtgctttgcctactttttaatggggttattttcttgttggtggtgatttaagttaagatattaatcttttgttggatgcataattttttaacatttttccacattctgtaggttgtctgtttactctgttgatagtttcttttgctgtgtagaagctctttagtttgattaagtcccacttgttaatttttgtttttgttccatttgcctttgaggtcttaatcataaattatttgcctaggtcaattccmgaagagtttttaaccaggtcttctcrtagggcttttatagtttaaggtcttacacttgtctttaacccatcttgaattaagttttgtatgcagtgagaggtaaacgtccagttttattcttctgaatatggctagccagtttttccagcaccatttattgattaggatgtcctttctccattgtttatttttggaaatgaaaacacaatacttgctaccacaaaagcacatgtaagtacaaagcccacaaaccctataaagcaactatacaattgagactgtagagcaactagctgcaacactatgacaggaacaaagtcttacatatcaatattaactttgaacataaaggcctaattgcttctctyaaaagacatagagttgcaaattggataaaaatcgagacccaactttatgctatattcaagagacccatcttgcatgtgatgggtttactttgaccccttaggctcaaagtaacaggatggagaaagatctgtcaagcaaatgaaaaatgaaaaaagagcaagggttgctattcttgtatcatataaaacaaattttaaaccaacaacagtaataagggacaaataagggcattatataatgatgaagggttcaaatcaacaataagttttaaccatcctaaatatatattcacctaacattggagggagcatgcttatttgtaaaacaattactactagacctaagaaaagagatagacaaccattcagtaacagtggaggacggccaggcgtggtggcttaagcctgtaatcccagcactttgggaggccgaggtcaggagatcaagaccatcctggccaacatggtgaaacccagtctctactaaaaattcaaaaattagctggccttggtagcrcatgcctgtaatcccagctactcggaaggttgaggccggagaatcacttgaacctgggaggcagaggttgcagtgagccgagattgtgccactgcactccagcctgaggacagagcaagactccatgtaaaaatatatatataatagtaataatagtggaggacttcaacatccagcctggagacagagcaagactccatctaaaaatatatatatataatagtaataatagtggaggacttcaacatcccagtaattgcattagacagctcatcaaggcagaaaaccaacaaagaaattctggacttcagtagcacactttaccaaatgaacctaatagacatctacagaataagccgcctatcaaccgcagaatatacattctcctctgcacagggaacatcctctaagattgaccataggcttagtcataaagcaagtcttaataaatttcaaaaaactgaaactataccaagcatcttctcagaccacagaggaacaaaattagaaatcaataccaaggaaaactctkaaaactacacaaatacatgaaaactaaaaaacttactcctgaatgacttttgaataaataatgaattaaggcagaaatcaaaaaattatttgaaacaatgaaaagactcacaccatatcaaaacctctgggcttcagtaaaagcactgttatgaggaaactttatactggtaaatgcctacatcaagaagatagaaggatctcaaattaacagcttaatrtcacaactggaggagctagaaaaacaagaacttaacctaaagatagaagaagaaaagaaacaactaaaatcagagcagaactaaattatattgagaccaaaacaatatacaaataatcaatgaaatgaaaaattggcttttgaaaggataaacaagattgataggccactagccagattaacaaagaaaaaaagagagaagrctcaaataagtgaaatcagaagtgacaaaaataacaacaactgattccacagaaatacaaaagattctaagggaccactataaatatctctgtgtacacaaactagaaaaccttgaggaaatggataaattctcagaaacacaccacctcctaagactgaaccaggaagaaattgaaacctcaaaccaaacaataaaaaattatgaaactgaatcagtgatagaaaaactaccaaccataaaaagcactggaccagacagattcacagctgaattcttccaggtgtaaaaagaagagataggccgggcgcggtggctcacgcctgtaatcccagcactttgggaggccgaggtgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactctgtctcaaaaaaaaaaaaaaagaagagataatatcaatcttactgaaactattccaaaaaaatcaaggaggagtaattcctccctaactcattttagaaaactagtatcaccttggataccaaaatctggcaagtacacaacaaaaaagtaaaaccacaggcaaatattcctaattaacatatatataaaagtcttcaacaatatactagaaaactggatccagcagcacatcaaaaggataaatcaccacaacaaaatggactttattcctgggatgcaaggatggttcaacatatggaaaccaataaatatgatccaccacctaaacagaattgacaaccaagaacaaattatcatctcaatagacacagaaaaggcacttgataaaatcaaacatcccttcatgataaaaatcctcaacaaatgaggcattgaagaaacttacttcaaaatagtaagagccatctatgacaaactattacccaacatcatactgaaagggcaaaagttggaaacattttccccaagaactagtacaaaacaagaatgtctattctcaccactcctattcaacataatactggaagttgtagacagagcarttaggcaagagaaagaaataaaaggcatctaaatgggaaaagaggaagtcaaattatctctgttcactgaccatatgatttcatatctagaaaaccctaaagattcctccaaaagactcctagacctgataaatggcttcagtaaagtttcaggatacaaaactaacatacaaaaatcagtagcacttcttaatactaataatgttygagctgagaatcaaatcaagaatgcaatcccacttacaagagccacacacaaaataaatacataaataaaacacctaggagtacatctaaccaagaaggtgaaagatatctacaaggakaactacaaaacactgatgaaataagttatagatgacacaaacaaatggaaaaatattccatgctcatggattggagaaatcaattactaacatgtccatactgctccaagcaatctgcagattcagtgcaattcctttcaaattaccaatgtcatttttcacagaagtagaaaaaaattctaaaactcacatggaaccaaaaaataccctgaatagccagagaagcctaagcaaaaaagaacaaagccagaggcatcacatgacccaactccaaactatactacaagcctacagtaactaaaatagtttggtactggtacaaagataggcatatagatkaacagaacacaatagaaaacctagaaataaagaataaaaccatacacttacaattaagcttttttctttaaatgcaagttgtcaggtgggtattcctctttgttgattaaacaacacttgtaatggattattgttttaatgttttttaatgaactaagaacttaaagatacatgcaaaggtatctgaatttagaatcttggtaaatttttttataactatgtcttctatcttttagatacttcttgttcacttaacttcagtgaaagaccacctcgttctatacagaggatggccaagtgctataacctctactacctcactgtactttcctctcagtacttacagacaaaacagagctaaccttaagaaagccctaagtcagttggtccccagttaaacattatttctcttaaagatatatgtttcaaattgtaaatcagcttgttgttgaatagattcattttttgtttttattgtttttgcagttaacctccggctgcaaggatcattacttttgaactatgtattgaactatgtatggtacatggcaaatttggagatatttgatatttgaaaacataacttttaatcattattcttctttcagaaatgtgagcaattaggagttagagtgagttatactaatacgttttcagttgtcataatcatataaattaattcagaacttgtaggcttctagctgtcaagaaaaaaaatctgtcatatacagtgaagatttttaaaaattattatctctaattagttccctccttattgaaaaaagtcattattccaattataagtccccttggttctaatgaactagggctaggattccatatgtaacatcttgtatttttctatgaaaatagcttaaaatatattaacacagaagaatatgaaacatgaaatatgacaaaaatagattcaagcctttcttctcaggatacattcccagggcacatttcatgaaggtatcaagaacagtaaattgtttttagtgtgcttaggaaatgtctgttatctggtccgaatctgaagtctctttgttcttggtgacattttatcatgtaaatgggagtgagtcttgccacaggtctgcaaatgaaattttagcctgtttgagtctctcctctgaatactgaaattttgtgcagaaaaatcctttgctttttatataaaggtatttgataaaagattattataatgtatatttttgttggtgtgtattgtgaaataatttacaaactttataacattctggcctaatcattagtactttaaatattaactatgaatatttgtattatgcctcattaacattataaagttaacagcctttaagtttgataacctgtgtgatttccatttcatgtaagttgtatttagattctatgagttctctgctcccttgctcttttagaagatgaacagcttttctgggaatgttggttactatacttcttgggttgaaaatcacttatgtttattcattcattttttaaaaaattataaagcatatggacatggaaagaaagtcggggggagatacaaatacagagaaattgtggaacctcttttctggagattattaaaagtaggataaatcactatcagtctcatttgttaaaagcagtcacctgccaaagagggcagtgcctggaggtcctcctagcttcttggtaatcctctactctgatacatgttcaacagtctttgacattggctggtttgggtccagggcaatgcttttgttcaggatacagggtttatcacagaatatgtttatgaaattgcagcagagctgagtgttaagggcaaacaaaacataagaaaaagataaacagggtatcttctactgagattatttatgactgatcttgcctttgcaggctgactggaagatgacaatgagatcttgtatatttttaatcaaaataaacacaargccgagaggaatttaaattatttaatgaggagagattaaaacaggaggctgacttctgattattctggactattttctaattggcaaaactgtccaagttaagccttatcaatgatccttttggccacctctgtcttgatcatcaccttgctgggatggttaggaaaagaagaaatcctgacatctcttcttttcactagctaccaattaaaaattccgcataggagaaaggggaaatcttaaaacgggagttgagggttgctgtttatttcctacaatactgctactgtctcttctattattgcccctgttatctttgccccaatttttaaatctttgccttccttgtttcatcaatgcggccacctgagctcccayggaaaggctcagttctgttttagaaccaatctgtacctaggcagacagtattcaaacagcctcagtcactttttaatccagtctttttcaatgaaattgagaatggctcactgtcttggatcctagagcctgggattcttctggtttatatctttggaacttcctttacctctttcctggatagctcctacatgttctcctaagatgcaaaattcaatacaggcattatctctttgggggactcacttcccatcccctcatccagtccctcctctttgctccataacatgcgatttatctctaccgttcttctctcaccacgttgacatcacatattttatttatccactctatacagtaaacctaaatccgggaccaggcctgtctatctcctgtgcttggcacagagcaggcattcattagacacttggaagataattacaggttgacacagtctgaagccaccctagactcataattttctgacaccaattcccaggtctggctttctgtttaggctcctcttttcctgtcttcatttggtcaggcattttcctaaacctggagtcttggcttttagagcctcactaaggtttagcagattgtccagaggacaatcatctgcctgctggactatagtagtactcttgggactcccaactactgcattccctccatagatctagcactcagagttgccctacagagctagacttgccttgctttcagacatagtgctgagcatgatttggatcctctgctgtctcagggcctgcctggtgaaaagctattctctgtactctgtgttgatgctttaatcttagagctgaggagtgaatatttatgaagaatttactttaggtagggcttttgcttactttattattatatcatcaaatttaatcctcacttaatgttattgatgagaaaaacagagattaggtaaattgtaccaaatcatacagctrttgtttcagagtctaaattttaacctctgataagactgaagtcttaaccgatattctgtagagcccaagagagggaacctttaagaatattacctcagggaagctgacaggagaaagttcattrtttatatatatatatatatatatatgtatatatatggatttcaagttctaaagttggccatttaaaagacttattcacagtattccccatatatatataaatatatatatatttaacttttattttaagttcagggcctgctatattttttcatccatctttggtgatcatttagaatattgctaagggtatatttcagaagaactagaaaagaaaatagctgtttttcaaaactttcaaggtgttttcttggttgattctgattagcactgaaatttttttaactcaaattttctttaacaaagaacattttgtcaaaatatttacaacaaataaagtcgctttctttgtttgtatctatctcatttgcatattattgatctgcttaaaaatttgactaatttacttctctgaacaggctacataattttcagatctcaatgaaaaaaatgaaagtagagtctcttgtttaaaaatgggggtgtggacaatttcaagacagcaacagcagaacattaagtcatgcaggaagtcaccctaagtacagcatcctttgcaactgcttgggttgcacaacttgatgtcmtaaacacatttataaatattcctgaaaatgttcttaatagagaagtgatyaaartcataataaaatgaaatgctgatagtgaaaaaatatatatgtaattgtctttgtttcctctaatttgattacaatttgggtagaaacatgtttgtagttagataatagtgaagagacaccacaggctcttaaactatagtttacattttgctagagcttaggaaaatgatttgagtcatttatatcttatacttaggaaataggtcaaaggaagaaaagcaatttgaaacttttgtttctacctcactccctgcctattttrttatgaaaaaaatcatgaaatgcctctacgaagcctctgttaattgtgaccaaaattcaagcatatgaagaacattacyggaaagaaaatacaacccattataacctctttgttacgtgaatgctgcatatactctgtgatttgcatacaagttattcatggacagaaattaggttttattttgatttagtaatgtgaatttgtcacataatgaaagagagcttataccagcaattttacaagtaaaagtgtctttagaagagaaaaagtgaccagaaacagtgaagawtccattattagtctagtttaaatactatttccaagactgatatttaaacacattatgtattttcagcccagtgaagaaccattagaggatgaataatatatttattgtgtatttaaaatgtatcacgtatctccaagcagtaaaatgtattattattgtgtatttcagtcaaccaattaatgcctacatttgtatattacaatgtcagagaattagtaagctggatggakacttggtttggtaaatgctgtaggtttggttctcttggtgtgattttgacaaataaaaccaagtttttggtttttttttttaactggatttgtaggaaaacaagatagcttgctccattattattgctttcctagaggcaattttgcagctatgattataaataaacttctattatcaagtcttatttcccaaaagacagggggaaaaaatctatcatcgattctcctttgtgttagtttcatagtttctggcaatatgtaaaccttaagagttcatgctatctgtttagactttttaaagcttatcttgactttctagaagatttcttttgtgttctacatatttttcttcaaggaaatttatactgtaggagatataaaaatagactagggaaacagcaaatcaagttaatcaacacttattgaccactatgcacaaggatataggataattgtagaaattgaaagaagtataaaatatagctttatgccatctaggaatttacaatctgctaaagaaatcaaaatttgaaatataattatatacattcactgattcttttacacaattattaaacaaatatttaccaagcaactaataggttccaagatctgtgttcaatgttggtaatttaatggtgaataaaatygcatataattcctagcctcaccaagcttatggtctagtgaaaaagactggcaatcaaataatcaacaagaaacataaaactgccactaggataaaagctgtgagaaagatcaccatgatgctatgcctaaaagagggtaacttgatctcctttcctctgccttttctccattaccctgttttgacatagtagccagaatgagatttttaaagtctatgagatatgccactctgctgttccaaagacttcccatattattcagaacaaaagaactcatttcctttctaaccttcatctccactctttttatattcattcctcttcaaccttaagtttcgtaagcatgccaggcatgctcctgccttgggacctttgacctgcttttctctacccggacttttcttctttctcagttactgaatgtcttactcccttaccttcatacagttctggttcaartgtagttttctcagggaggcccttccagaccatcctagctctgatactgtctaattgcttccctcttttattattttttttttaatttttatttatttatttwtttatttttgagacggagtctctctctgtcgcccaggctggagtgcagtggcacgatcttggctcactgcaagctccacctcctgggttcccgccattctcctgcctcagccttctgagtagctgggactacaggcgcctgccaccacgcccagctaattttttttttttttgtatttttagtagagacagggtttcaycatgatagccggaattgtctcgatctcctgacctcgtgatctgcccacctcggactcccaaactgctgggattacaggcgtaaaccactgtgcccagcctccttcttttatttttctccagcactgatcattatataacacagtctatcttttatttccttttctttactgcctgtcttctggctaagatataagctcaacaaasacacataactttgtttttgtttttcgtttcattattctcagttcctaacacagcatctgcctgccacataggcaacacaatatttgctgaaagtatatatccatggtcatggaggttggaagagaatcactgaggaattgatcacttggcttacaacctgagaatctgagtaggtgttagtcaagtaaagagaggaagaaataataattatagtattagctgtagtagtaacaattacatataatgcttactatggattaagtggcttacaaatattaactctcaatctttataactgccctgcaaggtaggtaaaattattatttccactttagaaataagaagctggggtacagagggagatttctggggagaggaaatctaggtgtaaggaaatagcaggtataagagctttctggctggaggaaatgcagtgaggacacatgaaaagagggtatgtcaggaactgagttagggaatatggtggaatggaagcctagagaaaatggccagggaccaggtgactaggagacttatttgtagagtgaccacatattcctgattcttcaggacactcctgctttatgtctgtttttctggagtaattaagtcaaccctcttttattctcaaaggaggttttccagtctgggtagtgggaatagagtctatccctggacctgtgtcagccctgggcactgttgccactaattgtctctgttggtccatttcccaatcagtagtagtttcttcagatggacccgctgatcaatgcgctgctgagtcatccaggggaaccccctgcatatctctgctgttctttctttgcacagttttcttgtctttgctaatctattttatgaactatagccacctcgctttctccagactctcaactatgtcttctcaagaaaggtagtttgcctaggtctgtctgaatttccccttttatatcatggcctggaaactctctaaagataataaactggggcaattgtagggctcatcgaatttgttctcatcgcctaggaactattgtccttcattgcctgatgtccaatttcatttgttgaaaattaatgcttcatacatttaacccattttgagattgtctcaggtaagagtaatccagtccctgttactccatattggatgcatgaagaaatccctaaggagctattttaaaatgtagatttgtggtatygagagattctgattcagtaattctggaggggatatctgtaataaattctttttaaaagcctcagtgtgactcttaggttaccaggatatttaatcacttgtctagataattaattcaataaagttcaaggtctaagaaggctttatgaagagagtacacttcgaattagattttaagaatggattgaatttggcgggcacatgctctgtgccaggtgccagtggatgagcaaatgtttgaggaatggataaattgtttgatcctcccctgtttgcttagaaaacttctatttcacgttttaggtttatacctctctatagctttctctttcttccccagacagaatgtaaaatgtacagctttttgcctttgttgtgatagttcacacattgtcatcatcaaatttacatgtaccttatatcatagttattttgtttcttccactaacctgtatgttgctttggagtaattaatttatttttgacccccagtgcctagcacagtggttagaatagctaggtactcaaaaatatttattgatctgagctgttgctcctcttttaatatttacaagtaagtcgtaagtaactattccaatgtaaaagtcatttccaacctgggtgttttaaatagtgaattgagaggcacaatagtatattaaactatttattgttatataaaacatcaccccaaaactttgtggcttagcaaaacaaacatttattatactgcagtttctataggtcaagaatcttggaatggcttagctggatcccctggcttagggagtatctctcagaagactgcagtaaaagtgtcgggtgaggctgtagccatgtcagtgagtgtttggaagataatccacttccatgcttcttcacatggactttggcaggctttaagtgcatacttgctgctatccagaggcatcaaagttaccatgtgtttctatccatagggcagttcacaacaaggcacctgagggagaggtcaagagagtataagacaaaatcataatcttgttgtaacctattcttggaagtgacattttataacttttgtatattttagttgttagaaataagtcattaattatgtcaaccccaaactcaagggaactacttagcctcatgtagaagcaataccacttatattttatccaagacaatatcaaatatatagagagatggattcatagagagatggattcatagagagattacttgttatgtctcgaagatatggactccattaccccaggaaacttagcatgatgctatactcatgttttggcctcatcttcatctaggagcaaacatggcctggcaagtagatatggtagcaatgctattctccaaaaagtaacaactcttttctgtggaacaatgattttcaatatgtattctctgatgtctaaggttccagtggtaccttggaagtcatgcagggaacaagaaacgggtgctgggttatgccccctactattaggtgccacctagctctactctgtcatagtactcaggttgagttctgagttcattgaataaaagtgtgaaaatatttgaaacttttgsaaaacttggctccaagagcaatggtttttgaccatagcatagcatagcagtttagtcatatgagctctggagcaagcctgcatagtgtgtttgtatacaggttctgccatttcctagccatgtgttgggttatagaagtctgggtttgagtcccatctgcaattatatcttgttcatttctgtttctgaagccaaaactacttgggcgcrtgtgatattgtgcttctttttatttttattgtaggcttctattatttagccaccctgtatttaccttaacatggtttaatataaccaacggaatggttgatacatttaccaccattatgcttactattttccttcccaataataggtttctgactagatgatgtgtgttcttcattttgataaactcttcctcagaaagaaaattatccataatccatttctgtatctgtcaaagcatagtgtttcataaccagttaaacatttttacaactgtggaagcaccaatttcatggaatcacttattctaaaatttttgcagaccaacattttcaattttattgttaaatagtctgtaaggtacaactgattacacacatctgctgtcctaaaataaattaagaaagtatcttgcaatatattaaatagtcagttttctggttttattaatgaaggagttccaaaaaaggcacacacttcatattctacacatgtacttgcaacaagattaacccttgagcccaagatttaattgttaatgttgtcttttttgttttatattccagctgcttgatactcattaaccaatgacataacgtttagaatttttattacttagtctgtgtaagacgcaaaatctttgtgtcccttcttatgtcttattagatgactccaactcaccttttgagtgtaatttagaagttgatttttcaagtagaggcaaatcactttggttttcaaaatacttttggcagaagatattttttctgaaaaaagagaggaacaggtgagttgagtaggggggaggaaagtcatgaaaaaaactgttgtcagatgctactttcattcctctgtaatgtgaggttgaagataggtgcaatgtgaggaggaatrtgagaaggagggagtttaacttgtactccagtttccaagtttgagcagttgcaatgtagtgaaaactgtggggcctgtggcaatttatataaataaatccctaaaacagaattttggcttttaaaatgcatagaacatgatgtggtcatagcatcatgaacattgaaagcctgttttctcagccagggactttaaaataagagctccacataagagaatgatgggggaaaaatgtatacatctaatgaagcaaatagcrcagcaagatgatggttaactgaacaacacagaaaatctgcctttcttttcttacaaatatctctttggtgggctcccttgacaggcattcttttgttctctgcttcttagatgagtcttttctttcgctttctggctcccttcctccccagttttaaaccataaatatcctacaaatatctcctcttactttagtgaaaggatgttacttgctagtttcaattattacctctataaaatgatatcacttgtatcttcagccttgccctcatctcacttctcctccctctctctatccatcagcttttctgcttgtattctcatcacttcctgagaagtgatgctaaatttatataactgatgaaattattttatatacataagttagtgtgtgtctctaagttttatttccatgactttttagagcttccttttaatttmttttatgatattatcttgtggaatcatcttctgtgtaattttaagatccaatttaattttaacctgtgataataagagaaagatcacataaaaagacctcatttctgtgacagcctgaagaaactattttccaatagatttttgtactcaaatacttaattagagatatgtcaagaaaataatagtcattacaaaaatattcaaccaatgttataactgaaaaactctgtaatcacatgacatagagaaatctcagctaacgtttgtaatggttgtcaaggartggagattatataaatatataaattaaaaatagaaaagcctatagaaattagagcatagagtcaaaaaagggcgtggtaactctaaagcaaatgttaccatctaaaatgctttctaagcaatataagccttcaatacaaatgggtaaacaattcctggtaattttaattgacatagctttcagttcatttgtttgaaaccttgagaattatgttcaaatcttgattgagagattgaccccaatggaaacagtttgtggtgttgaataagagcacagttctgccaagggtaaccaaaataaactagctattacaagtaattaagagacaaaaattcaaggtgattttcctactttgtaagttcatgaagtaaacaaagttttatcttcatgttcatctccccttgtaggcatcctcttttatagtcatttgttgaccatttcttctcatctttacttatcaccagcctcccatatgttrtcattctgactaattctacctttttttttttttttttgtcatggagtctcactctgttgcccaggctggagtgcagtggcaccatctcggctcacggcaacctccacctcccaggttcaagcaattcttctgcttcaacctcctgagtatctgggagtacaggtgcacatcgccacgcccagctaattttttgtattttagtagagatggggtttcaccatgttgtccaggctggtctaaaactcctcagctcaggcagtctgcccacctcggcctcccaaagtgctaggatcacaggcactttgctgggcgattctaccatcttaatatatctgaaatccattctccatctccaggccaacactactacctcagctcattttattcttatctcttaaaaacaaaacaaaacaaaacttactgcaggatgttactcactgattacctgtttccagtcttgttctttcttcaatccattcaatccatacagttttcctagaaagatccttctaagatgcaaattaaacatgttttactctttcttaaagtctcttggtgcatctctatatggaaaaattgctaaaattctcattttaatatataagactctgcaagacccttaacatatgacttagaatatgtttaactttttttttcagtcaagtgcaaacaattatataatcatggtcctttttacaaatatgctggtaatatgactatcactgaacaacctttgaaaagctgtctccacaatagaactttctgcaatgggaaggaattactagctggccccaaataatgccacataagacaaaaagcagcatgggtgccttttggtgcctttgtgctctcataaacctgagtttaaacttaagtgtttttccttacaagctgtaaacctctgagcttcactgtccttatctttaaaatgcggctattaataacaattcagtatgattgttgtgaacattaaatgaaatagatattcttggcccactagcacacatttttttttttgccttctaatgcttcattcaaaataacaagaatcaaaaggcaagtggtaaagatttgatcaatgcaaagacaatatcagccgagggcaaaggtggctgggaaatagggaaaagatacaaaacaggactatcagttgccaaagaaggtagatccagtattggaggaagtctaagaaaaacacgtgtgtgtgtgtgtttgtgtgtgtgtgtttctagtagcaggagtagaagtagtagtcttagatgaaatcaatcaaggatatgtagagcaaaatatctatagctatcacttctggaatatttattcttatatactaagcattgtgctaagtgctttacatgtattaattaatacaaaagaattacaggaaacaaaggagaacaaaaggaaacacaaatgtcagtgaggaaaagcaacacttaagagatgaaccgaaaaagccatttctatggaggaataataataagtaggcagagaggtagaaagaaaactcgaaaattgtggtgtcaagcaatctaagggagaataaaatcttaaggaagaagtagacaatagtaacaaatgctggataaacagtcaaataaggaaaaggtcataatttggtcttgaggtctccctcacaagaggactataaatattagtcctgccctgacagggcttcaagataaagctacttctttatcttggcagatagccaaatacctaagtgtccaatttgtgaccagttgcttctctcacaggaaacttgttgatatttacagacctccttgtggctcttatctgacctgtgtccagtattttcctacaaggagggtcactctttaggagagccctgacttagaaaacaggctcaatatgtcagtcaggtgagatacagaggaggcaactcaacaaagcacatgaaataacagaagctgtcaactgcaaacagtaacatagtcatgatcctttttacaaatatgctgccaatatgatgatcactgaaatacctttgaaaagctatctgctcaataggactttctgcggcgggaaggaattactagctggtcccaaataaaaccacataagacaaaaagaagcatgtgtgctttttggtgcctttgtgctcccataaacctgagtttataagataaacttacagatctcagaaagaagagggcagcacaccttacagggccagtgggaagtggggccagggacagttcaggacacatacactcaaccagcacgtggggagcaagagagagaaagagagaccattatgctaaagcttttattgggttccaataaggatccaacagttacacaagtgggtttcctgagggaagttctaattaatggctttagagtaagcaggcactagctctgtggggccttgctgtgattgagagggatcactgctgcttatctgctgctcagttgtgctaggtgtgagcatcagaggagcaagccaagtagattattgtaggagatcgatcagagtggtgggagaaactatagggaaaggagcagaccttctgaaaggtcagaaggctctgcataccttcggggaagaataagctgaagtcagctgttctctgacactgaggcagagggcaaggagtaggtacaagtaagtgtgggggaattaatcttaaacaggcttgtttatttatgttgaccaggaactgacctttgatcatccgcatgcatgagtttctgtgaaaggggaacaataaatgttacttacccacagactgtgtttgctccaggcttttggagttatgtctacactgaataaaagcaagcagcttgcactttggccactagagccctgcagacccctagctgctcttacactgcatacctgtgtctgagtactcccctttcatccatcgctcagccaggtctgtgggacggacctggtgattatgtctagctgtcccatagggagagggtcaccaggagattgtcatacatggcaggtatctggatcaactacattgaggaactgggaagaggcagagaattagaaactgtgtccctggtgactaagtcctgcttgtggtataagaaaacttatattcaaaatgaatcctgagaaaacgtaaaattataagaatccactacaggctaaaaagcatccatgagaatgggcaattagggggcctttgatgtcattttccagagaaatatccctggagtggtgagktctaaagacagattgtagtgggctgaggagtgaataggaggtgaggaaaggtagaggaaagttggagatgactctttaaaaaattgtctacgaagtttaggaggaaggacaatagttggaggggaccataattgagaactggttattgaatgtcagaactgaaaataactggaaaaaatatcaatcctaaatcaactttcatgctaatgtctttaggatcattttgaattgataagtcatcactttggaaaaacaatttttcctctaaagctttactaatgcagatttttccactaaatggaaatgggtgtcatcccaatacagcttcattgttcttctctctataaatctcaataataaaggtgagacacaggcatagagaagagaaaattgtagctttaagcaaactgtaaatcttaaggaaaacattggtataagcatgaatttgaagaagatccaaagaaataatagaaaataaaataccacttaaagcaaagaaaaatttaatttccaagtgtagatatttattgaaagtctgctaggtatgagacactgtatttggtttggcaatttcaactgagattgattgccattttatttcatctagaatttaccctattctattttctcttccatgggacatttggttcctctttatacggtcattcttttttctcctttaaccctgcccaatgacttccttaaaataaaagagagggagctaaatggaaccaagtcaaataagttaaagttatactgtagcaaaaacatttaacaagaaataacagtgaggccctttgttattataggcattacttttggaatttctgagattttaaataaggtctggctattttagttataaggattaaatttcagggcctcaggtgaaaaatccttttacctggagtcaaaacttcttacactttatagagacaactttggaacataagtttaaaattttatgaaagagtgatttacccacagtgttaattaccagaaagattacattgtgtcactaagttttataggcattcagaaaataagtgattaatacaatgacctattttcaaaagcttttcatggagaacatgagaactgagcttggtcatgagactgggtgtgtggcaaacagagaaagagaagggaagacattctaaaaagaaaaagcaggctcatgcctgtaatcccagtactttgggaggccaaggtgggcggatcatgaaatctagaccatccttgccaacatagtgaaaacctgtctctactaaaaatacaaaaattagctgggcgtggtggtgcacaactgtagtcccagctactcaggaggctgaggcaggagaattgcttaaacctgggaggtggaggttgcagtgagccgagattgcgccactgcacttcagcctggagacagagcaagactccgtgtcaaaaaaaaaaaaaaaaggaaaaagaaaaagcagaatgtgcaaatcgtgtttaaattacaagctagaaactggaggaacttcacttggatgttttttgagagtcaactggtaaataaaaatattgtaaagggtaattcatacagtaattgttatactatcaaaataaagagctctgacttattttctgtgctcataaaacaaccacttaatgggagacaatttatagtccttatccttccatcagtgaaaagtaccaagttaccagcccatatttaaatcttagttctttgataataatactactgatatatatatttaataatatttatatagatatattttataatactgagatataaaatactgctactgagatatatatatatctcagtattattcttatatatgtatttcagtagtagcatttaatatatatatctcartattttatatattgagtatatataatatatatctcagtagtagttttttaatatatatatatcagtggtattattatatattactattatattaatagtattattatatgtcaratatgtctttttatatatcagtactattatwaaatataatcatatatttatataaatatatattctatacatttaataatattaaacacatatttaataataatattaagatgtatatttatgtcagttatataaatctaagtatgatacaatttatatccttaaagtgtttaaagatttatatccttaaagtatattaagatagctgtcataaaatctgtttctagtttaaaattttactagttatttttttctgagaaaaaaaatcatgaccatatagtctcacaaaaaaattcaaaataacagaatatataccatgcaaaaatgttaataatatatttaaaactccaataacaggtcttggaatatagcaaacacttgagatttgctgaaggttaatttgaaatcaattatcaataaatgtttgatgaattgaattatttaaaaattctatcatataattaagtcctaattattaatgtttatattrccttatgcctggtggcatatataccttccaaatttgtactttaactgtactggaaatacatccartttaacaattattggatgcctattacctacctaccatagtagggaacaaaatagattcagtctgtgacttcacaagagtttcatgtagtggaaagagtgtgaagttgatttaccaactttttcaggttctgaagcagatgaatcatgagtaaaataacttgataggtatatattgaagcctaaatgttkgtatgagtgtacttgtcttagtmcacgtgacggacaatataccatattcccgttagaatgctgggagatactctccccatcattactccaaaggtcatacaaattagtacatgaattctactcattagctaaaatcagataattctaaaatgcattgctctcaatggttaaatattttyttgaattttaaaacaaactaagtaaagcctacaattcaaaaatgactctgtatggtttcattaaaacttacattttgacactttctcagaaaaccaacacttcataattaatgaatgttcagccaaatgttgaccttctgaataactggagaagtgcaaacttaggaggaaaaaaaatggctttaaactgtttattaaagcctaagaactcttatcttttagaatgaaagttgtggaagcatgcctaagaaattggctctataggttaacatttgaaagtccgttttgcataaaaattcatgctgtctactttatgctatatttaaaataagaggaattgtaaaaagcttaatctaccttgattgctaggggcctccttcaaaggttcctgagattcccaggcatgtgaagcctaaagataccaagctcttgttataaatggcttcagcattcattttcagtctaaatctatggagcctctactgacagatggcttcttcctatctgggattgaattagttactttatttacttaaaggttagtgttaataaaatcaaggtcagaggagtggactggtaaaaacaagatttgatgtcaaacagacctggttttgaatttcacttctgctccccagaggttcagtttcttcatctttaaaatggagaggagcacctctttctgtgttttggcatgaaacagagtagactttgattaccactgatacacttgtttctgggcctgatacataatagtccctcaataaaagctcattgtggttttaatttttgtattataaaaacagctcactgtacacaatgtgtattctcctgatcattagtcagcaatattcaagtattaacaaagaaaattgttgtgagaatgtatagaagcctatgtacctgcttatatttggacccatcagaaatttcggatttttcaataaaaattcgtgattttatatgacaactattagcatctccaatgctatccccgagtgaataaattatgaggtaagcatgtaaaataatagttttggctcatatttgctcaataaattgtgtttaatggatgaataggtgattaaaaattaactatttcaaactatgaagcactcagaaacaaagcttgaggcaagagactaaagatttagtttcctattgacactgacttgctctatgacctggaaaaatttcttaattcctggttctccatttttttatctttaaaatgtaagggtttgatatgtaatgtccacagtccctccctagttctgtaggtctatgattcacacaattgacaaaacatgacttaagcggcaatttgttcatataaacagaagaggtgataggacataagtcccttgagctcttaaattccatctttctgttttctcttctaatagacttttgaaaaaatttcaaaatgtgtaatatttgaccaactgaagaatagacagtacattagcaaagtccacaatgaaaatgaacacatttgaaggaaattatttcaatgtgttgaacagaaaagagagactcgaagacaggtatttaggagaagaaattggaaatattaacaagtttgttgtgaaaggtagcaaaatatgcttccccaaaataggctactttggcgtattgattattttgagctacagaaaattgaaaagaaacagatataggaactctttgctctccctctatttgcctaaaagagggacataaatttatgaaggattcctttctgtcttctctaccagaaaggatagaagttaatcacaagagataactctagacacttatcagcccagagaagtcaccagaggaatctatataagaaactttgctaaaactaacttttattttccattagtttcctccatatatttaccttcccccaatttgttgccagtagaagttcaaagttatttttctttgtcttattactgctctacaaagttattgtaaatttttgttaagattatagatgagaccaagttctaactactacttggagttactcatcactgagtagtcccatttatgtgcaatacacatgttaataaactcctgattgtttttctcttatttatctgcctttttgtcagtctaatttatatggcctcagccaataaacctaaaatggatagaaaaaatattttttttctcccctacaaataccaatctatggctttccatgatgacaattggccaacagttcctggtagggtttttcatttgttcattcatttcttcaacaaatatttattgtatgattgttatttgcatgatcacatgctagagtaagagtataaagatgaatctgacatacactttgtccttaaagaaatttctctttagtaaggatggtaaggtatgtatataaatagaaaaatgttctaaattatatgagtgaaagttatatgagatttatgagaaggtaacatttaatttcagccaggcagatggcaatgaagggagggaaattgaggaaatctgggaggagatggcattttagctggagataaagcatgaatatatgaggcagaaggacatttctggctgaagaaataatgtgaacaaagcctcaaaggagcaggaagctggatgcagtttgactctrcaattgggtttaggaaagagactaatgagaaatacatttaaaacaaacactgtcagattgaagggaccttgaatgtcatactaaggaaatttagtctttatctttcataaaaaaacaggacactggaggtcttggataaggtggatggaagaaagttgtgttttagggtggcaactcctgatgaagatttgtgcatggtggttgtaaactgaatcttaataggcagataactcaactgaagttcttaaccataatcattttcttgtccaggctgctgatgtgctgttgcaacatggagctaatgtcaatattcaagatgcagtttttttcactccattgcatattgcagcgtactatggacatgaacaggtaagtctgacagtaggatttccaaaggttaggtgttgcttaagtgtaggcttttgttgaattgtcctagcttcaaagagtttatatttaaaatatatttgaattatttttgccatattctcatcaacccatccttgaggagcttgtagatccatataagcattacggttgtcatgttactcatttttgctgatgatcttattacacaaagaggcagaaaagtacattggtaagtgtgtggcctcaggaatcagtcagcctaaatttgaaaaattcctagtgttttgaccaggtgtaggttatgtaatccctctgatcttcatttattcacctataaaatggggaaagatattaattataacctcatagggttgctgttaggatgcaatataaattgtttggaaaatgctcagtaaatatagctgtgatgatgctaatggcaataacaataaaacaactcataaaggctctataaaaacaattactaatgtgctttataatttactttaaatatgtgattctataacaggtccatatttataaaattttattttctgtaataatatatatagaaactttaaagtttttaacatacttttgttcaatacatgatttttatttaaccttcacaactttatgaaattaatgaattgccacatgactgagcttatactatgggataggcactatgatagaacctttatctttttttctaatttttccacaaccctgaaattggctatttgcccttttttttttttcttttttgtgagacggagtattgctctgtcgcccaggctggagtgcagtggctcgatctcggctcactgcaagctccgcctcctgggttcacgccattctcctgcctcagcctcccaagtagctgagactacaggcacctgccaccacgcctgactaattttttgtatatttagtagagacggggtttcaccatgttagccaggatggtctcgatctcctgacctcgtgatcctcctgcctcggmctcctgaagtcctgggattacaggtgtgagccaccatgcccagcctatttgcccattcttatcaatggtatacatgaagctcagtcaggtgaggtagcatgccagagtcatgcgctattaataataaatagaagagctggaatatgtactcagttctgtctgatcccaaagcctatattgttttgctgtaccaaagtacctcttcttattcttcttcaaccagtgagacaaattatcaagtccaaacaattttcctaaatggagaagccagaattcaaggcaacattttctaactctaaagtctgctgattttcaaccttaacatatcaaaagacaaaatttctatgtttctttaaaacactgccctttgacagtgagaatactcaaggaactgaaaataacaaaaaaaaaaaaaaaaaaaaagagagagacagagagaaatacaaatgtaactggataaccgaatataactgttcattgaatactccattttcactcttcctcactttgtctttctagactcattcaattgtaggttagaattatacctttttaccttcctggaggtcatgccacagcaccacctgagggttccaagttgaagatcaaacttacttgtgtccctgtgctcaatagtcattgtgcctttattcctctgctagctggcatatgcctggacactctaagacctgtgaagcgtgacctataggtaggaagattgcttatttcattgatgtgctgctcagagtgcactggagtgcaatgaagagctgggcactgaaaatacttttagaagtacaggcccaraagcacaagtaatggaaaaatcccatcatttcctaacctcaggcacagacaggatatatacaatgcatattatttgtagagtcatcctctttgacgattaacctcatcacccagcagaaacataaagagcctgtatgcatgttgggtggagaactaaatttgtttactttccctgaaaatatagtcacagtcttataaaattatgctaaaatgtggatggccyttttatgataagggactcactttctgtgtgtgaaggcagcacataagtaatttatggaggctattgtcatttgctaaaatatgctgacaaggagaatggtacattcaatatataaatgtacctaatgtgccatgttccttgtcatttgtttatttacttatttttaagtggaagagtagatgttttgcaccaagagcaatatttcctaggtatgtaataatagtccttaatagacaatcgatttcagagatagtttaaatcagtctattataaagtcacataatcagaatatatggagtctgtgtaagtggaaatatctgcttaggcatgcaaggttcttgaaactaaacttctgctgttctgatttcacctgaattaagtcttgatctgcccattagccaacaaagagataaaatgcacatgctccaagttggggctaccacttttactaacagttattgaatgccaggcacttttctgagtgcttttcatgcgatgacttatttaatcctcacaacaactccaagaggtagaaatattattattccaactttagcaatgaagaagctgaagtatcaaaactataaacaatttkttcaaagcaatatagctgataagtagaagactgatttccaaacccttgctcttgtctattgtactcaataggaactcagttccccacatcacacccagctaatattttctctagaatttctctcaaatgtctaccacattcttgagagatttatactcaagacatggttatttgctgactcatgggaagtaaaaatagttttagagcttgaattcacttttgtgctgacacttcagtggtcaagacaattgagaggggtcaattgctatttgaaccctaactgctattttaaggattcagaggcatcctaacttaaccttagtatcactgaggtgacttttgaaattctcaggagagccaatatcaagtttacagaagttatttggaaagttcttaagtatatatataagtgactcaaaggaattcctaaattacctgaaacaatcgcaggaagactcccacatgcttcattactttatccctctctgaccctatggatgtagagtctcagttaaatggagaagatgccagggctactgtttctatctccagttcactcacatatccagaaaaagacccatatgactgaagctgccatgaaaatcaagaatcaagtcaactaccactggctctggccagaaggagactttggaagagatcattcagagaagattctgcatgactctagagaggattatttatgtaaagtgaagacctacattatgaaattgacaagagagttgatactaaagagagcaaatgacaaaagtaggttttcaaggtcaaaaaatgtggagatgatttttaaaaaacgttttcaaagctccctagcatctcatctagccccacattaactctgaaacagaaatggtaaacaacattgtctcagttcaccaacaaaaataaaaaataacatttacagaacaaatactgtatgtcagtcattgtgctatgcactttaaacaaattcctaatctaatcctcatgacaacccatgagttaagtcttaatattattcccattgcacatatgaaaaaacttgggtatagataaattagctaatttttctcaagaacacagagytgatataaatcagattctagattcgaatctaggactatcttaaactgcaccttaactcttaatcagtatatgatattacccctcacgttaacaacataaggtcagtagcaggcactattgtttgcttaggcaaagctatcatttcaactattaccactttgggccatatattttttttcttccttgctgactccttattttatttcactgttcaacctctctcctagaggttgtgcttagagatgctcctatccccagcyactgtgtgttagatcttaattagctgaagccactcacagtaaatctttccccttgcccagggattggtttagaaagttgcaaatgacctagtccagactgaagagatatgggaagatggtttctggagagtttttaagaaggaatttctatatttaaaaaatggtcgcttgttccaaaaggtagaggtcatctcctgctctaccctgtgaacttcagtttgtaatggctggagatgctgcagctctcttactaccatgagttgatctatcctacttgctgagcatggcagaacagaatgacagaaagaacttgagttattaagctgttgtattaatcaaccctagaattgttccagttttggacttcttgctaggtgatataacaataaatttttgtggtttaagccagttgtgttcttgtatactgccaaaagttttgcattattgtttgaatttttatactgatttcaaatgaataaatcctttaggtaactcgccttcttttgaaatttggtgctgatgtaaatgtaagtggtgaagttggagatagacccctccacctagcatctgcaaaaggattcttgaatattgcaaaactcttgatggaagaaggcagcaaagcagatggtaagattatatatttaaaagacctttgctrtcatttgctttatgtataccttttacttgtacttctcttactagagaataatcttgaagttgactaatcctgtagtcatgtacttatttgctccacaagkcataattcatctttaatatatttatcaggcctacatgcgaatccttcttaacatgttttagctcaattcttttttatttttaattatactttaagttttagggtacatgtgcacaacatgcaggttagttacatatgtatacatgtgccatgctggtgcgctgcacccactaactcgtcatctagcattaagtatatctcccgatgctatccctcccccctccccccatgccacaacagtccccagagtgtgatattccccttcctgtgtccatgtgatctcattgttcaattcccacctatgagtgagaatatgtggtgtttggttttttgttcttgcgatagtttactgagaatgatgatttccattttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatggatggctgggtcaagtggtatttctagttctagatccctgaggaatcgccacactgacttccacaatggttgaactagtctacagtcccaccaacagtgtaaaagtgttcctatttctccacatcctctccagcacctgttgtttcctgactttgtaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttgtgatggggttgtttatttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttattaggagctccagtgaaagtaaagagttctcttagatgaattagatgtcttcactgttgttcactaatcttttataaattgagacattatttacttctagcaaattctgaaatcttaaatatataacctgatgaatatttatgtatgtatacatccattgaaaaccacccagatcaagatttagaatatttaattactctgaaattttcccttatcttatctttcccttcccttacctcatctcaggtaaatagactttaccaccaaaggtaattaatattctggcttttattgctatatatagttttgtctgttcttgaagtttgtataattttgtgactggcttcttttgctcaacaagatgatttggacatatatccatgttgttgtatggatcgtagtttgttcttttatattgtttatgattgcatgaatataccataattggcatatccattcttctcctagtagacattttaatatttctagtgtttttctattatgaatacaattgccagtaacattcttattcacgtctttttgtggacatatatgttcatctctcttgaatatatatataaacacacatatatatatgagagaattgataaatcgaaaggtaataatgcatatgtttaatgttttaggaaatttctagacagttttccaaaatgtttgtactattttaaaatctttcaacaatatatgagaatttcagttgcttcccacagcatccccaatatttgatattatattactatactttttaatagagtttgagtgtgatccatttgggaaaaaraaagctttagaatacatagaaggacttcagaatcagttgatagaatagaatttcctttcatttttattttcttaattataaaataaattttggaaagtttactataggtattgaaaaatttctttttttcgcttttcctcacaaactttattttttgacaaaaattcactcagagttgcgtcttgccattaaattctctcaggcatatccaacattcttccatcgacccccaagagacctaattaaaagcccagctgtaagaactgctggcctttgcagcgggaacaatacacatttccaaaaggacatggttgtcaaatctctggaactgccagttccttggttcaaaattcagattgatatttagttaataaagctaatcaatgttttttatctacccataaggaatayacaaagtatcctagagacaaccgtggcaagagactaaggtaatttccagtttccaagttgtaaacaagggccactttatttcgtaaaatgtaagaaacatagcttgcattgttttctatacgccagtatgcagtaactcaggcagctactttagagcattattataaacaacctatgttgtcaggatgtaaggaatgctgttccttggaccttgtttaagcagtctgtttcattttgttagtctagaataggcacaggtacacctgtgtgaacgactaaacacataatcgtgtttttgaaactgcctcactcttccaaggggtcaggaactacatcactttttcctttcattattgatgccaaccttagctttttattcctctgcacaactccagagctcagtagtgtcaaaatgaatgtcatttatgatcagcatgtctctttcagtgcaaaagrcattgaaatgtgtaatactacaaccatattccscttacataccagcatcatatgatacaatttttaacattttctttttgttgcacgcaagtattacatgcctcttattcaattattttataaagtcaagagacggcgtgactcacatttttaagtatttttatttctttctagtacacgcttgatatttaagtcccatttgtacttcaaccaattgcaaaaaataaaccagaagatctgctatgccaatggacactgtgcaggacttattattagttagttcacttattctaaaatgtagctaagcctccaaatgattaattttagatctggaccctgcttgtggtaaatggacataggagaaagattaaataaatgaccccaaagagagtacaatttgaaatccagtatttacagtatgtttccatggtaacagaatgtcacaaatgaaaataaattcaggttgcaaaattacccaaaatgtaattctgaaagcagcctctttggttcagcatgtttgagaggctgacctattcagttaggtatgttttaagtctctgttttgcttctttgtatctcttagggtaatgaaaaaggagaaatataatgccccctaaatgagattgaaaaggttaaaatattgatggactgaataagaaaaaaaaatggtgatacagccttcaaaatatgccattttgataatgttaaaaattgaaaaaattaaatttagaattaataatttctgtcatcttaatcataaatgctatatttctttaaaataacacaatccttgcaactggacagagctggatattacagaaagccacaaaaaattcctagaacatgtccagccataggaagtgttttattttttgaaatatagcttgttggatgtattacacagatctgttactgaaagcttattaaagacagacctgggagtaattttaaagatcttataggacctgctgacattgcttggtcaatctggaaaattttattttatttttagggtcaataagcggaaataaagaagaaacagcacccattcacccaatattcaatatttctttcaaaagacatcactatctacctactctcttcaaaacagagcaccaggaactagatattttcctaataatgatttacatgtattttttgttttaaattctcctttatatgtttctcaataagatgctaagttagagcaaatagaatgttattcatgcattcaatttttctaagatataataatatattttcttttttgtctttgcaaattggtcgaagacaaaactaaatacatcacaatgactgaggcaaaaacagacrtgtatacgcataaattctatgtctgattccatatttgtcctggcttgttccttcagttggtatttacatcttctttgatgggaataatgtttcagccactgtggataattcaccaagtaaataacctaatttgaagtttactaattcaattggcgagggatactgggtggggccaaggatggccaaaggcaaattataaattaatagaagattgcactgcattctgctttgcatttttccttctgaaccttaagaattcttatgtcacgctccagatgccctggacycctaactgttctcaagcattgacttgtggcattgactatccctggcttagaacagcatgtgaacaaaggaaaagcttttttaaaagggagataatcagaagaaccaacattcttctgaatgaaaggcgtctttttgagctgctcattaataaaaaaagattcaaaggtttgtttgtaataacagccttgggaggagaaactcagtgactttgttaaagatttccctttggcttaaaatcttgcagaacaataaaatgaggatgattgtttacaaatatagcagctacaaggcctaattaagaccctgtctagattgacaaagtaatcaaacaataaaacaaatggctttagagcagttgattccattattttagttttaaaaattattaaagccagattaggaattgagcagtttgatgttcagttgttwttacttcaggactgtaattattgactgtttaactagactgtaggttatttgagagtatagactctgcatttatctgttattagctttggacacagcaaatttctaagatggacattagtaaaaaggttaagtaatwtttattaaatgtctagtatgggacaagcatcatgctagatagacgctttccaatcatgatcctctttattcttttcagcatccctggaacaatgatcttattatatccattgttactgataagacatccatacctccaacagtagcttaatggctaatacatagtgatcacttgattcttgttgaggaaagagagtgtatctgtcaagtttttttgtttttgtttctgtttttttttttttttactttcaagtattagaaactaactcttgctaatttaggcataaaaggagtagattaaaggatattatgtagcacacagaatcttcttcctcagaacagagtagaaagccatgtttgaaattctcacagtgaggaacaacatccagaatcatgcccaaatgtggtcctgtgaagatgcactgccacccttgctaggcacacataaactgttgtgcttctgatgccaacaatgcagggcattgaatctgtggctggaattgctaccatgggaaattggatggagctactgccaccactgccacattgccaagatagattaggccctgcattttacgtcatcagctctgaagtcagagtctcatatgatgtgttgattggaggagtctacagataggtatccagaccagggaactgttgagagtaaaagtgtcattattaagaattattccaggataacaagcctaaaccaggacatatggtcaccctctgctatttctgttccctagctgcaaacagatcttggaaagcacattttctgcttctgtgatagaatgtggtcttggcttctcattaatacttgcagtatacggaattacccagacgtgagaagaggttataaggctgggtgtttcaacgagaaggacacatgtctactactgaatgaagaattgaattttaaataacctgtctaaagtaaaagaattaatgaggtctgcctaagtctaaattgcttttcccttcatgataccatgctttgcatactgtagtatggcaattttcagctaaggatatacatcagagctgtttacaacagtgttgtaaacatacagattgtggggccccactctaacctactgaacccaaatctctgggaatggtgctgtggccaggatctgtaattcttaacatcattcagatagaaaaacaatcaatttgaaatgtgatccttgtagaaataaggccacgtgtaccttttggatgctattagtttcccgaactgttccactgtgtaagatagatttgatttgatgtgttccatagaatttatggaagctagaaggaaacctgtttaatgtggtagtaggcaatagaataacattaaaattttaaaaattggtcgcccttaatttcctttatgattatcattaactggcaatttccaggaatcactcaggcacttagaaatgtccatgatactatacatatgaaggttgagaaacaaacaattctagataacatatctttttctttcttgctgataacagtgaatgctcaagataatgaagaccatgtcccactccatttctgttctcgatttggacaccatgatatagttaagtatctgctgcaaagtgatttggaagttcaacctcatgttgttaatatctatggagatacccccttacacctgtgagtattatgtagcattccataggttctccaggtatactgcrtgtacttgcttacaatattaacaagmtattttcttcaaatctagggcatgctacaatggcaaatttgaagttgccaaggaaatcatccaaatatcaggaacagaaagtctgactaaggaaaacatcttcagtgaaacagcttttcataggtaaaagaatatttaagtgcaatagccactaaacttagctgacactctaaagcacctgaagttgtgggtataaagcaagaacaaatagtggcagatgttgcaatcagagagcaatagcagaggtagggcagaggacaaagagccagagctagatgcatggaagaaaaggtggaggcagatgctgcagtcagtacaacagatggggccggagccagatgctgtgttcctggcagcagccacaaagacagggactgatgttgccaaggcaacaggcatatcaacatctgtaagcatattgcttctattcctcttcactccatggaaagctgccaaaaagggatgtgcccataatcctcctccaacaagaatctcattaccagaattcatcagcattaaatgtgacacttgtttcctttccacttaaaccttatgtgaaaatgtgtctacctatctaaaacatccatctgtcagcctgtaaaagcctagtcagggtggccactcagatacctaagaaagcatcagctcttctctaggaattcgtgagagccctttacggtgtgctctagaaaagcacactgaaggaacagctgggattagaaaagttgcaaccaaaataaaaagagagaaaaagaaaagaaagaaaaggttgctaataagtcagagctatagttccctaaaatgcccaaaaggaaggtggatgttttataaaatctaaggctttcatttttaatgagtaactattttgctaaaacagtaaaagcatagtaatttatatttagtagatcttgaaaattagtccatttgcctacacattacatatgtttccattagtttgtaacctctaaaattgtatttgaggctaatttgttgttcacataatgtttttgtattgcattgatgaataataaaaatgaggagattctctttatttcttaccaaactaaaattaagcttgtgcttctgcatcaggcatcaacctgtcaaatttcacatacatttccagatttttcttgtcaaccaaagactcagtcaaacaagggtgaagtaaaaccaccatttatggaatagtgaccatatgccagatgattcgcatccattatctcatgtaatccttacaacattttatgaagttggatttattatctctcttttacagaagagaaaactgaggctcagaaaagctaagtaacttgccaaagtttcttatggatagaaaataatgttgcaaatggctacctaattctaaatcctgtgctttttacatttcttcatgttctagtaccaaaatattttgtctgttttctacacactcagtaacagaacagatgcaagaactccttagatcataccttcagtcaaatggatcagtggaatctgtccctgcaggggacagttggcagaactgatatgtactggttgctggtattctctttccgtttaggtcatgcctgttacagctgacacctcaggctagttttcaaatcattttgctacttcatgcactaaaattaaaaccaactgtaatcagagggtgactgtcacctccaaaagattgtttatatgagaagatttgtaaagtgagttgaaagtatatacccaattgttttatttcgtgtaagcctgtggctactcagagtaacagattaatgtttttgttatattcattttaagcaaatatttataaaagaaactccttttacgtgaggaattcactctgaatatgaattttttatgtacatagtattttgcacagagtaagcactcagtacatttctgttgtggttttcatatgtatacacacacatatacaaatatatatgtatatatatgtacacgcatacacgtgtgtgcatgtatatatgtgcatgtatgtatgcatgtatatatgtgtgtacacatgcacatatatacacatatatgtgcatatattcagaactcattatctgtaagtagtttctttgaaaaagagcaatgaatcaatattaaatgtgtactgttatggatcgtatttataatgcaaatagttaatgatgatatgatatattgcactgagatggtagtttttttattcactcaataattcaagaaaaagtcattaaagacctaccttgtattggtgctactggggacattaagatgacaggattctttcagtccttaaaggagccctattgtaaggtatcaaagtaaacagaggtgtatccaataccatattacagtgtgataagcagtgtaagattgaaattacaaagaagcagaggggtcagcaatgaattctgcctttggttcattagaatacttcatattcagtttaattggataaagaatgaatgatatttcatgaaagaaaaatgacttaggcaagcttaggcaaggccatcccaggaagaggaaatgctaagacccagtgaactccctctttttttctagaaccaagtccctatgcccttcctttagccattatttagttggggctttgcccagtgctagttctttccagtcagttattacatacctcatatctcttcatgacttgaatgtagagtattgttagttaacaagtgatagcaaaagcagaggtatgagggaaactacaggaaaagaacatttatgagaattactaatcaaaaagttaaatccagtagtcattactaggcatgctaatttcatacaaaatctttttctcaatgcatcttagctttcccagtaaccagtagaaatcagaatttcagataagtatttcaacaaatctgtgtgcaaaatttgtctataaaaatcttatttccttgcatcttgaaatttattaatttttccacaaatactttctcacacctggaaagaactgataatgaaaggtcctctacaatttgtaatgtgattctataagcattaattcacttgaaatttcagcaacaatttggcacattgatagggtattgtctattatagttttatagatggtaaaactaaaactcacagaggtcaaagaacttgtccaagatcctctggtttgtgtgtggcagaattctggattttgagtccacagctaattctccttcagtaaaatgaaagctttgagatcttatcctctggtcaagaagtgtttggagagacagtagatggttttaccaggaatcatttcagactgtgacctggatttgactaaaactctcagaaccctcctgaatttctaatttgattgtcctgcagaatatttccgaggtcctgcagctaaaaatgcagggaactcttatatcttatctccttttatgaaaaatgactaatatccctgaaagcagttgataaaaaacactggaaattttatacagctcttttcttaaagttccagatgtgagaatctttaggattttctcaccatatatccacattttaatttagcctttgtagatggtgcttgtttatttttcatcacctcctcccttctctgtttctttggctctcttatatacatgtgtgcatctagaatgcctggcataatcagggctgcatttgtttgttaggactgtcataaagaaataccacagactgggtggcttaagcaacagaaatttatcatctcacaattctggaggctagaagtccaagatcaaggtgtcaacaggtttggcttctcctgcagcctcttcccttggcttgcagatggctgccttcttgctgtgtcttcacatggctgcctctctgtcaatgtcacctgtgtcttaataccagattcttcttataaggatgtcagtcatattgaattggggcccaccctaatgaccccattttaaattaaatacctatttatttatttattaattattattattatttttctactttaagttttagggtacatgtgcacaacgggcaggtttgttacatatgtatacatgtgccatgttgctgagctgcacccattaactcctcatttatcattacgtatatctcctaatgctatccctcccccctccccccaccccacaacagtctccggtgtgtgatgctccccttcgtgtgtccatgtgttctcattgttcaattcccacctatgagtgagaacatgcagtgtttggttttttgtccttgtgatactttgctgagaatgatggtttccagcttcatccatgtccctacaaaggacatgaactcatcattttttatggctgcatagtattccatggtgtatatgtgccacgttttcttaatctagtctatcattgttggacatttgggttggttccaagtctttgctattgtgaatagtgccgcaataaacatacgtgtgcatgtgtctttatagcagcatgatttataaycctctgggtatatacccagtaatgggatggctgggtcaaatggtattgctaattctagatccctgaggaattaccacgccgacttccacaatggttgaactagtttacagtcccaccaacagtgtaaaagtgttcctatttctccacatcctctccagcacctgttgtttcctgacattttaatgattgccattctaactggtgtgagatggtatctcattgtggttttgatttgcatctctctgatggccagtgatggtgagcattttttcatgtgttttttggctgcataaatgtcttcttttgagaagtgtctgttcatatccttcacccactttttgatggggttgtttttttcttgtaaatttgtatgagttcattgtagattctggatattagccctttgtcagatgagtaggttgcaaaaattttctcccattctataggttgcctgttcactctgatggtggtttcttttgctgtgcagaagttctttagtttaattagatcccatttgtcaattttggcttttgttgtcattgcttttggtgttttagacatgaagtccttgcccatgcctatgtcctgaatgrtattgcctaggttttcttctagggtttttatggttttaggtctaacatgtaagtctttaatccatcttgaattaatttttgtataaggtgtaaggaagggatccagtttcacctttcyacatgtggctaaccagttttcccagcaccatttattaaatagggaatcctttccccattgcttgtttttgtcaggtttgtcaaagatcagatagttgtagataagcagcattatttctgagggctctgttctgttccattggtctatatctctgttttggtagcagtaccatgctgttttggttactgtagccttgtagtatagtttgaagtcaggtagcatgatgcctccaactttgttctttttgcttaggattgacttggcaatgcgggctctttcttggttccataagaactttaaagtagttttttccaattctgtgaagaaagtcattggtagcttgatggagatactattgaatctataaattaccttgggcagtatggccattttcaygacattgattcttcctacccatgagcatggaatattcttccatttctttgtatcctcttttattttaytgagcagtggtttgtagttctccttgaagaggtccttcacatcccttgtaagttggattcctaggtattttattctctgaagcatttgtgaatgggagttcactcatgatttggctctctgtttgtctgttattggtgtataagaatgcttgtgatttttgcacattgattttgtatcctgagactttgctgaagttgcttatcagcttaaggagattttgggctgagactatggcgttttctagatatacaatcatgtcrtctgcaaacagggaccatttgacttcctcttttcctaattgaatgccctttatttccttctcctgcctgattgccctggccagaacttccaacgctatgttgaataggagtggtgagagagggcatccctgtcttgtgctggttttcaaagggaatgcttccagtttttgcccattcagtatgatattggctgtgggtttgtcatgcatagctcttattattttgagatacatcccatcaatacctaatttattgaaagtttttagcatgaaagctaaaaacttttctgcatctattgagataatcatgtgttttttgtctttggttctgtttatatgctggattacatttattgattttcatgggttgcatcccagggatgaagcccacttgatcatggtggataagctttttaatgtgttgctggattcggtttgccagtattttattgaggatttttgcatcaatgttcatcaaggatattcgtctaaaattctctttttttgttgtgtctctgccagcctttggtatcaggatgatgccggcctcataaaatgagttagggaggattccctctttttctattgattggaatagtttcagaaggaatggtaccagctcctccttgtacctctggtagaattcggctgtgaatccatctggtcctggactttttttggttggtaagctattgattattgcctcaatttcagagcctgttatttgtctattcagggattcaacttcttcctggtttagtcttgggagagtgtatgtgtcgaggaatttatccatttcttctagattttctagtttatttgcatagaggtgtttatagtattctctgatggtagtttgtatttctgtgggatcggtggtgatatcccctgtgtcattttttattgcgtctatttgattcttccctctttccttctttattagtcttgctagcggtctatcaattttgttgatcttttcaaaaaaccagctcctggattcattgattttttgaagggttttttgtgtctccatttcctgcagttctgctctgatcttagttatttcttgccttctgctagcttttgaatgtgtttgctcttgcttctctagttcttttaattgtgatgttagggtgtcaattttagatctttcctgctttctcttgtgggcattcggtgctataaatttccctctacacactgctttgaatgtgtcccagagattctggtatgttgtgtctttgttctcgttggtttcaaagaacatctttatgtctgccttcatttcgttatttacccagtagtcattcaggagcaggttgttcagtttccatgtagttgagcagttttgtgtgagttacttaatcctgagttctagtttgcactgtggtctgaaagtcagtttgttataatttctgttcttttacatttgctgaggactgctttacttccaactatgtggttgattttagaataggtgtggtgtggtgctgaaaagaatgtatattctgttgatttggggtggagagttctgtagatgtctattaggtccacttggtgcagagctgagttcaattcctggatatccttgttaactttctgtctcgttgatctgtctaatgttgagtggggtgttaaagtctcccattattattgtatgggagtctaagtctctttgtaggtcactaaggacttgctttatgaatctgggtgctcctgtattgggtgcatatatatttaggatagttagttcttcttgttgaattgatccctttaccattatgtaatggccttctttgtctcttttgatctttgttggtttaaagtctgttttatccaagagtaggattgcaacccctgcctttttttgtttttcatttgcttggtagatcttcctccatccctttattttgagcctatgtgtgtctctgcacgtgagatgggtttcctgaatacagcacactgatgggtcttgactctttatccattttgccagtctgtgccttttaattggagcatttagcccatttacatttaaggttagtattgttatgtgtgaacttgatcctgtcattatgatgttagctggttattttgctccttagttgatgcagtttcttcctagccttgatggtctttacaatttggcatgtttttgcagtggctggtaccagttgttcctttccatgtttagtgcttccttcaggagctcttttagggcaggcctggtggtgacaaaatctctcagtatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagatctgctgttagtctgatgggcttccctttgtgggtaacccgacctttctctctggctgcccttaacattttttcctttatttcaactttggtgaatctgacaattatgtgtcttggagttgctcttctcggggagtatctttgtggcgttctctgtatttcctgaatttgaatgttgrcctgccttgctagattggggaagttctcctggataatatcctgcagagtgttttccaacttggttccattctccctgtcactttcaggtacaccaatgagacgtagatttggtcttttcacatagtcccatatttcttggaggctttgttcatttctttttattctgttttctctaaacttctcttcacacttcatttcattgattttgtcttccatcactgataccctttcttccagttgatcgcatcggttactgaggcttgtgcattcgtcacgtagttttcgtgccatggttttcagctccatcaggtcctttaaggacttctctgcattgattattctagttatccatttgtctaatttttttttcaaagtttttaacttctttgtcattggtttgaacttcctcctttagctgggagtagtttgatcttctgaagccttcccctctcaacttgtcaaagtcattttccgtccagctttgttccattgctggtgaggagctgtgttcctttggaggaggagaggtgctctgctttttagagtttctggttgttctgctctgctttttccccatctttgtggttttatctacctttggtctttgatgatggtgatgtacagatgggtttctggtgtggatgtcctttctgtttgttagttttccttctaacagtcaggaccctcagctgcaggtctgttggagtttactggaggtccactccagaccctgtttgcctgggtatcagcagtggtggctgcagaacagtggatattggtgaaccgcaaatgctgctgcctgatcgttcctctggaagttttgtctcagaggagtacccagccgtgtgaggtgtcagtctgcccctactgggggatgcctcccagttaggctactcgggggtcagggacccacttgaggaggcagtctgcccattctcagatctcaagctgcatgctgggagaaccactactctcttcaaagctgtcagacagggacatttaagtctacagaggttattgctgtcttttgtttgtctgtgccgtgcccccagaggtggagcctacagaggcaggcaggcctccttgagctgtggtcggctccacccagttcgagcttcccagaagctttgtttacctactcaagcctgggcaatggcaggcgtccctcccccagcctcgctgccaccttgcagtttgatctcagactgctgtgctagcaatgagcgaggctccgtgggcataggaccctccaagccaggtgcgggatgtaatctcctggtgtgccgtttgttaagcctgttggaaaagcgcagtattagggtgggagtgacccaattttccaggtgctgtctgtcacccctttctttgactaggaaagggaattccctgaccctttgcgcttcccaggtgaggcaatgcctcgccctacttcggctcaggcatggtgcgcttcacccactgtcccgcactccccagtgagatgaacccagtacctcagttggaaatgcagaaatcacccatcttctgcattgctcatgctgggagctgtagactggagctgttcctattcggccatcttggctccacccctcttaagtacctctttaaagatacaatccctaaatacagtctcattgtcaggttatgggggttataacttcagcatatgatttttcgaggtgtaggggagagggcacaatttagttcataacaaggaccttctatctttcttgttttatggttttttttttcagtgcttgtacctatggcaagagcattgacctagtcaaatttcttcttgatcagaatgtcataaacatcaaccaccaaggaagggatgggcacactggtaagactgtggtgaaaacaccactagttctakatgcttatcaatgattaagaataatggtatgcaaagggatgtgggggcattgggagtgctcaactccagtgggaaagggtattttatcaactgccagcatttagaattgataatgactgataataataaaaagcagactgactttttggtcaattttattattgtgttaaattatttgcagtcagtgcatcctcttatggccagcactagggacagactgaccacactgctctgcccttgatttggtgatcaaaaaaaaaaaaaaaaacctgtgatgggtctttgttcctttatttgtgtaaagatgctaacatttgttcttggtaattacagtggatgtagaaatactataattgtactgaggaaaagacagtctctgtagaaggttgagtacaatataatacccgttttgcttaaagtgatgtctcgtttggtcaataataaaattagttctttatcaaagaaatcaatccttacttcatacctttggaaataatgctattatgtggtgatgactgtcttttgaaaattggggagcagtttttcttttttctccttttgttctttcaattcttttctattacaggattacactctgcttgctaccacggtcacattcgcctggttcagttcttactggataatggagctgatatgaatctagtggcttgtgatcccagcaggtctagtggtgaaaaagatgagcagacatgtttgatgtgggcttatgaaaaaggtatatttttaatcatcgtgtctctatagtgatacattgaactgtgtgcatagattatgtcagtgcatcaataattactttgcttgcatgacttgaacactctcatttcttctgtagattttacttgagtttctggggccttggatcaaagagtccaatacactgtaatcagagaaggcaactcctaggctgcagatgaaccaaaggcattctcagtattggcactttgaaaagggaattgtcacatttctaagtaccagagaaacaaaattgtgatagataatgatagtagagtgggctcagagctagtctttatctcttatatgggggaattttcatgtggtttcaaatttataagaaagaagtacaagggggggggaaagaaatatttgtcagatctaaccctgctgacaatgcttgtgctagaaaatgtgagggacccaagtgtaaacttatttgaatataaacttatttgcttaagtataaaattatctgagctcaaagtggtgaaagcttgagatctggtatgaaaacaactgggtttaaatcaagccatattatttgatcttgtgcaaattatttaatatttctgaactccattttcttcatctgaaaaataaggattataaattctactttataagattgtaaagattaaatgagataatatacgcaaattgcttagaacagtggctgacacaaaataaatgctaagtaattgctattttagtgtgataacagtgggactactagtagctcagaaataaagatgattgataacaaattcatcatttcaagggagaagtaactgaagacattcagatggtgaaaagcatctttgtaattgttattgagatatatttgcctcataagcaagctctccatatacacatacactcctaaggagtttagatttttaggtgatatgaaagaatatatattgtctttgaaattataggttataattgaatactataaaaaaatgccagattttaaagtcacattttaattgttattttaacttttgatgactgcattgtctttttacratattaaaaatgtgtaaagaaacatagttatctttttaaatactcaaatcctaaaagattgtactgaaaataacaattattaagctataagatttcctagcctaccaagttgattcgaaaggttttctgactaaagtgggatatgggccaggcgcggtggctcatgcctgtaatcccaacactttgggaggccatggtgggcagatcacaaggtcaggagttcaagaccagcctggccaacatggtgaaaccctgtctctactaaaaatacaaaaagtagctgggtgtggtggcagatgcctgtaatctcagctactcgggaggctgaggcaggagaatcatttgaacccgggaggcagaggttgtggtgagctgagatcatgccattgcactccagcctggcaacagggcgatactccgtctcaaaaataaataaataaataaataaataaatgaataaataaataaagtgggatatgaaagtccatcaatgaaaggagaaatgtagtctgatggatgaaaatgtagagctgttgtaagcatgcagtaagcgtatagacaaggagaaggaaaaatgtacaggtctgaagactgctagtagaaaaatgatgtgggagttactttaataaagacaagtgaacagacatagaatattaagtaataagttagatataggcttgctgtattttggtgggcttattttgctttttatttgaatattgtataaatacaaacatatatatacctttgcacatattataaccatataggtcaatgaatttcacagattgaactcacccagcacccaaatgaagaaactgaacataacaagtcccctaaaagccccattgacattctcttccaatcactcccctaaagaggttaccactgccttcttgtggcatagtcgttttgccactttctgcactttatataaatgaaatgctatgctatgtacttctttgtgtctggcttttttcagccaacaatatgtgagattcattcacattgttgcaggcagttgtagattgttcattcttatcattgtatagtataatgttttgtgactatatcacaattttttaattcattctactgttcacgagcatttggataattttcaatttggggctattaagagtactgtgttatgaacattcatatatgtagatatatgtctttcgttgaatatatggttgcatttctattagatataaaggtgttctactttgtattaaaaaatctaggtagctctatatcttaatatcaattggaaaatcttaaattttctgaaatctcaggaggccttactaaattctacctcctcaacacattgcatttattcaagtgattctcagacagtgactctcaagaaatgttagcttcagtgtaagactgtttacaaagcattagtcttccggaaggcagctcagaaattgctgctgcagctatctcttcacagaggttggctttgtttgtttttagctgattgagagtgatagttgaaaactggctttacttttatttttcatggaattccacacttctatgaaacagtgaatcattgtgtaagcttctaagatttcctatgaaatgtcaacaaagatcctttaacttagaggacttgcccactggcctcttcaacatatgctgtatttgtcactgtatttgttcaaactaatgtgccaggcatcagtgttgcattccattattactatgaattttaacaaattgaatgttgttgctcagaagacagatggatgttttgcaaatgttctagggcaaagcaagtcaaatgacaaatggaattgttgctatttttctcttcctaaaaaaatgttgcattgttttcatgtgttcagggagaactgaagtggccttgttaatattgtcagcagtgcacctgtccccgtatcctttgaaacaagaagtgcttccctgcctccttggagagggaatcactatattaattgatatagcatactaaggagttccctgagcaatttggaggtaaagctgaggaaggactaaaactctacttgatgtaagaatggccccatcatggtttaccatgyaccctatcctatcccgggagagataaacaagaagggagcttcacaatcaagggtgtctatttgaataggtctacttttggatacgcccaatttaaatagttcatcctagtctaatctcttaacagaaaaccatgcagtctttctcagcagcacccgtctctatctgaatggctctaagccaaatttttcacctgacccaagctaaattttagctgaccttctttctactattctgatatggcacattgaagtgtgatttggagttctggaagagttatatattctcttttggaatgctttcagaaaagggtttactcactatggttccctgtggaatcagatataaagaatgctttctatttgcatagcccttctaacctaaatatatcaaaatcaatcttgaaaataattttcctggtgacygtcatcctacacagaagccactgtttaagtttcaatatttatctgccagagtgcttagagctccaattttacaatatttagagtgtctcccctccccatctctccccttcttcgtttctactattccaatctgaaagtgtagcgatcgctgtctcactcacttggatttgttctgcccttttcctgtrgtacaaaggaccwgcatgaatcaatttaaattggtcagaagaaatagccagcagcctgcttatgttcaaatcctctgccctaatcaccagtatggaaaacccattgaaaagacctacacataatcttacatccattgcattaaagatgaaactgccgaattgaaaagatctcagccaattagaattgaacacatagctcaatagtgtgtctggcagttagatttgaaaaggctgcctttgacaaagaaaagcactcctatatgtcaggctgtttagggtcagaaaataacctaaactagaaacagaactaaaaacttcttattcgtttcagtactgacaccagttaaagtaatatacagaggctcctatcacaatatcaaattacccagaatacaatatttgtatacagcaaaggcgcctaattcacagtgacaggaagctggaggtggagaattagtgaataagggagcaaaaacaataaaaatcaaggctcctgtaccatgatatatactttgttcattccttttgacaagtgtagtattgtgtgaattatttgtagtaaatgtactatagtgtattctctgaaagtaatgaaatcttacagtcatgagtttctacagtttttagacagtaaaaaaataactgagaaatgagggtgggagaggagtacaagtaagaagagatagattcattaaattatttgataaattttcaccaatagattatgaactctcaggctttttctatattgaattcctatctatttcaagtttagttacttagtttagtgatactggtttagtgtgcaagagtggattggggtaaggaatccatgtgtgaatttttgttttcgtatactggttatcttcttacatgtttagctgctctcttttaaaaaaaataagtaagtaaaataatctcaactgtcattagaatggaaaaaccttcatcattgcagggagataactcacaaaaatgtttttgaaatataataacgtaagaattcacatacttaaaatggatagtaaaagagaacttacattcattgagtatcttttacagatgcatatatatgtatatataatttaatcaaaataaccctttaaatttttattatctttgttttatagataaagagattaagacttagggctgctaagtcacacttgcccaatccatgcagttgttgagtagagaggcagtaccaaataggaggtctgtcttgttgtagaattcaagctcttaccaacacactgtaaaattagatctaagccaaaactccatccttattatttaatgaccttgtgcaaggcctttaacctctttcagcatttaccctcaaattcaaaatgaggatattaataaccactttacagaattctgacgaggtttaaggataagatttaagtgcttggcacrtaacagagtctcaataagaatggcggcagctcttattggtaagtgcagagcagagattcaatcgaatccrcataactcccaaatttcatggtctttcctaatttataacatgtacagttagaaattttaatatattaggataataggaatccgctataaaccctctgatgaagggcttatattcctgccaaacgcctctggacaatccctgcatatataaaagtgtgtgttgttttgttatattggtatttcttatttatggctcaagttataccattaattttaagcctcagaactgaagcaaaataaaggagattttgaaaataactaatcaaaatattatgaaagtaatccaaagacattattctaatgtgcgtagttgcatgcaaatacataaaacaatattttaaaactatagcacaaatttgcaagcctctttcctacagcagggtttttctccacagtcaaggaggaatgtcaaagaatttgtgatcatattttcaaaccaccataccaactgactgcttgatttctttgcttggatatctgaggaccctgcaaaactcaacaagtccaaaattgaacttaacatttttttttgtcctcatgattctctttcttgtactatgtatcctttattcaatcagccatttaatggtattaccatccactttgtcacttaggtcagaaatcttgaatgatgcttgattactttttcctcctcaacttctcctcccaccacacatcctatcgattcaatcaaaaagtcttctttattttgcttaataagtacatttttaatccatccttttttctttttttttactatcactattttaattcagatcctcataatacttcttctaatccattttaataacctcataactgcccttttttgtcctcagcattttgaaattttccaactgtagactgagagatatattcaaggtgcaaataaggccgtattattccccagtctaaaacctttctctgatatactgtcacccataagaaaaagtctcagcttgatatcataacacacagagactttattgtcttgtgtacttcttgcctcttgaacctcatatcctcttactcctgttacatgggcaaccccacatgccacaaccatcatcatattcgctagatcaccaacattcactcagtgttcactctttgccatgcttgttctaaatacttcacatatattaactcatcaaatccacataataaccctgtgaggccgtgtcacttcacataatagggatagtataaaactgctcattcatccttacatatgtcatgttatttcatgtttccaagacttttacatggcagtccaatctgcctttatgtcctctctgtcctctccatgtcaccccattctttaaatttctgattgccacttggtcttcaagacttagtttatggaagtctcctagtcttattgaatatttctagaaagtcttccctgacattccagcctagcacatacatcctttctttatattttattttgttatgtgcacatctctttctctgtgtttaccactttatactgaaacactctcttctcttacsaaattgtaaacttcttgagagcaagcatttgggcctttaattcattgtcttccaaaaatttgaattcagtggatgactcctaatagatattcatgcttgttgaaatcagtaagagagacaggaagaaaatattttagacaacattcttttccatgttctgctacatggcatctggtgagttgatattctaagaaatactaactgtcacttttctgttgtctctgtaactatttctgtaaatatcataggttccttattaactgcacagtcctaatattcaaataaacaggcaaaatattttaaaatatgttctaaagctcctctttccatgcattggaactgcaaaaattttcttctggttggaatgcttttctcctacctttttgcttaatgagtttgtcctcatctttcaagttgagcttaaaagacagtctcaactatcctgactcttccagactgttgtaagattcaccattatacacattcacatcatgtaccttttcttcctagagcttggctaaataaaatttgagtgaaattatatttatrtaattttttccactagatagcattgaatataaaagtaaataatatttctttttcaaccctctcactcatacctagtatcattcattcgttcaacaaaaatgtattgccaacctaatgtgtgacagacactgtgctaggaacagtaaaacagataatacctccctgatcttagggagtttgcatttttaacttgaagacacaggctgcaagcaagaaagcaaatagaaaatatgggttaacaataagtactatgaataaaataagaaggaaatgcaatggtgaacacaaaattcaaggatactatctaaaattgagtaatcatggaaggggaaggtctctctgggaaggtgttattggagctggcccctcataggtgcacaatgaatatttgaggaagaaaaggaaagagaaaggaaagcagaatgagaaaaagagaaaaaggaaggatagctaaataatttagtttggatataaaaatatcttggcaaaagcattcatgcctgtggattcttctcttaaggtaaaggaccagtgacatccttactggggcctgctgattaaggaacaagaataatgggtcaaaggggatgtgagttccctctctgtgatataaaattaggacatctttcatatttaagtgatgagaagatgtagcaagccagaaatttttgtcgcctctgatctaataatgaacagtgtatgggaccagggtggtcaggaggaaggtgagccattgaagggcaattgtccaaagccaccctctgattccacttttcaatgcttctggaaagtgagtttttaacataatgggaaggggatatattaaaatattgaacaaagcctaatatttatcattactgtgaaagtttsattatttgggccaggtataaagtaaggcctagtctgttcctttgatgacctgagcatgtgagacatgaggtcaatgagaattccttctgtaactgagactaaatctccatgttctctatacagccgtgaacccaaagggtctctgagtcaccaaatcatggagatcttagtactggtgtcatttaccactaatctccagatctagttcttaaaatattctcagagcaagagattagaatcagctttcattgtttttaagttaaaattgtgggggacagagagacaaccttatagggagataaattgtacttcccttcttgaataattataaagcatctattgtatatatgactatgatgtagatattaaactgtctttgtaacagtctcttggattgacttgtcatcttaaacaaaacctaggttttaaaataactattaagaaagttgaaagcaaagaggatttaacagggggagaaatcacaccaaatataagaagtaaaggaacacaaatagacaaattaaagggaaagcactgaatttggagaatacacacaggactgaaagagtgaggagcaggaaatgaaagagatttcaagctgggagaagaatcacatttgccaaaaccctcaggtgctccagtgaataatactctaaaagtgcagatcatcattagagttgcattaggctaataacatagcgaccttctattttggtaaaatgcttgggtgtagatagtaaattcttaaatataggaaaacattttatttaattagtggaagtttgattatctctggaggtattccattagtgtgccttggttatctgggtgtatccattatcaggagtttggcttaacamgtccatttagtgagctccattaaggtttatttttctgcctaactccttgtggccaagtgtccaggagctgggctttagtgggtttcgggtttctttccatgtactttagtggcttgtcagagcagttgtagtcatggaaaatttcccatacgtgggtgccttagcccacagttagcatgaggggggaaatcaggcagagatgccttccagagctgagggggcctcttggcattttcctggcagcctcatgcttatcatcagccagaacccaggcactcattaggctcttgatgaaaagcatcccaaagaaaatgccagcaaattgtgccactgtgctggcaggaaatgaaaactgctcagagcaagtggagccaagagagctgttgaaatgaaaggtaacatcaagggtgtgatcactaactcacacaggcgctcaggattcaggatgcaactttctgcttcaytggggaaagcatgaggccctctcatctgtcagccgatgtcaattctatataggggctgakatagactggaaggtgggctctgtgaattaagctttgttgtgcttgggtaaatgtaggggtttgggttgtttttattcccccaagaagtgtctcctaggaaaaacagaaataagaaaaagtttttgtttttgtgtttttcctgggcccaaacacttgaagaccaaattaagtaaaaggaagattccaaaagcactataggtcctattaatgtgggattagacagtgtgaagggaggaaaaaataaataaaaaataaaaaaaaaccttagaatctgtgactctagcaaggaacagatgaggggtattattattattattattattattattattattattattttagagacagggtctcacccaggtctagcccaggctggagtgcaatggtgtgattgtagctcactacaatcttaaactcctgggttcaagtgattctcccacctcaggctacccagtagctgggactacaggcagatgctaccatgccccactaatttaaaaaaaaattttttttagaaataggggtcatgctatgttgcccagcctggtcttcaactcctggcctcaaacaatccctccacctcagccccacaaaacactggggtatgagtcaagacactcagccaaattttaattccaaaggaatttttggtctttagtactacttttatcctgaggttaaaatggccaccaaagctagaaaagaaaatgctcaacagcaggcagcaccaacacacaagcaaggcacaagcacactgaaatattcatgaaactggatgtggtaggtagagtaatgccccctcaaagatgttcagttcctgttcactggaactgtaagcaggctgccttacatggggaagaatcaaggaggtagagtaatgccccccgccacccccaaagatgttcaggtcctgtttgttggaactgtaagtaggctgccttacatggggaagaatcaaggttgttatttagctgactttaagagatagattatcctggattatcccagtgggctcattgtaatatggaaaaggggggcagaagcagaggtcagagcaatatgatatgaggactaagccaaccattgctggctttgaagcaataggaagggggctacaagccaaggaatgtgggtggcctataaaacttggaaaagtcaaggaaaccaattatctcctaaggcctctagaaagaaatgcagtcctgctgacaccttgatttcagctcagagaaaaccatgttgaacttttgacctccagaattataagataataaatttgtattgctcaagtcactatgtttgtcataactagcaatagcagcaatagaaaatgaatacactggtatttagaagattcgtctgaaattccaaaaaggagtttccaagttcacctacaattcttggggcaaaaagtaaagtgtaaaagcagtgacaagacccaaaatgcacactgatgtgttagaactgtaaggcatattacatacatcatcttagttaatctttacaacaatcttacaagggtggattatcgtttctaacctgtagatgacgatctttttaaaaagtaaaacagatcatatcctttaactaattaaaatgcttcaggggctccccatctcgcctaccctacacgaawatctcatctccttatcctcacctgtaaagctctacatcagtcgcagtcaaagtgcagattgctgatgagcatcacctgggaccttgttagaaacacaacactcagcccctactacagactttttcaattgtgatctattgggacagggcttgggaatctgtttgaacttgcacttcaagtgattcttatacatagtaaaaaaatttgagaagcactactccacatgaagtacacttgcctacctctccaaccaaatctgataccactctcatccttgcttgtgtagccacactggccttttttcattctctaaacatgttatgtttgctcccatcttgggactactacattatctattctctctgcctattaggtgcttcccctagaaattagtttgttggctaatgtccttaaattagtcttaaggtttccctgatcgtgagctcrctgcagtccaaagaaagaatgccaatgggactgccccccacgttatttcattataacttattcctatgatttgagaaaattagagatccaccagtcatgaatagaaagctggagatgataagaaaatagacactagtttttaactatgtagatttaagttttgctaccagttttagcaattgtaatcacaatgctttttttttttttcctcgaagaatcttagccttgttacctttggaaaagcttttcgtgtttgtaaataccatgatttttccacctcatgatcttgaatgcactgttcatttaaagtttttgcggaagggaagatttgaaaggcaagcaaatctcagcatatactctctacataagctagatgtatgctyaacccatgttaactacagatcctttgtgatggataagtatttatgctttttcaattccttaaatttaccagttttacaataagctctgttgtatttcacaaatcctatggcaacatctttaaggttggctgtttttctcttttgtaaattagcttcatagattatttttatagtgaaygcattaaaatagtattgaagtttaattttaytgaaaaacattgcattactcagaggatcatttggcattttttatccttcacaatcataagcccctagtgtaactagtaaacactagattgttggtggtgttataatagaaaagtatttctcatatagcacttcagggtgggcatttctggtcagtggatggctttcttccaaccctcagagcttcagagccttctgcatctagccagcaaatgggaagagtagagaaggctcacctgtttcttaaggcacagacctggaagttacttcacttttgctcatattcccttcatgaaaatatgtcgcaaggccacagttggatgcaaggtacataggaaaatgtcactgggtgggcagccattcccagtgacaaaatcaccctgtgaaagaggagtacaaatattggcaggcagccagctgtctctaaaaacctatgtaaattatcttagtgctgcataatactacaatactgaatcaaatgtacgctcaatcacagcaaatacatctctctttcctgattactgtatgtactttttgcccttttaatagtgcccttattatatattcccatagtacttagtattgccttatttagaaatcctcatcatttttctgattatttgttcaactacattgtaagcttcttaagggtaagaccatagtcactttgttcactgcatcaccagtacccattcccagtagagtgcctgacatagtgcttcgcatrtggtagtcttaagaaatcattttgaaccaaagaatgaatgaactaaatttctattgcaatacattacctcttatgatttgtcctatgttgtaagctacttccaataatttttggatttgagagtagactgaataacttaaacaaaatttaggactctttgttctttgtatcttttcataaagggcatgatgccattgtcacactcctgaagcattataagagaccacaagatgaattgccctgtaatgaatattctcagcctggaggaggtaccccttttcttattcagttttcattattgtataatatattgtgcctaaaggtaaacctgtgtttctgttactatcattctttcaggggttagggaggagggcatagcctatgtcagattagatttattttaagtaaccttatgtctgggagaggctgaacataaagaagcctccatttcagctattttctaactcaccaatctgcagctcctccaagtttaacatttcccagactggatgtttatgaggcttgtgcatgactaggaaggcctggataagctgagagcagtcattttccatttcagtaatctattactgaatactcatatccagagacaaattaaatctgctagagtctgctacaacttggattttctaaaaaatctttttatgcactttctaaataaacacttgcagtacaatttcagtatccagagaaagatttgggcctgaagcgatagttttacttcgtttcgtcacctgcttatttttataatgttgaacttttatgtagaaaaaaatgatcgctactttcaactctattatataatttaatttctagatggctcctatgtgtctgttccatcacccttggggaagattaaaagcatgacaaaaggtacctataatctgggacaattgttatatttaattactaaggataactattgcttcaaatgtaattttcaattttgttttacatattacaaatgatgactattttacaagcacaacaaatattattgacagaccgttcttttcataattaaccttaccctttatctcctttcagtgcataaagatataataacagtgaaaatttcacataactattaaagaaaaatcaaattctcactggactgtttagatgtttctgttttttataaaaatgaattataaatattaatatttctttaaggagaattgggactagaaaacatatgtgaaaaaatatatattatttttcaaaatatccccaataagtaatactttgggaccatttttgaatgtatgcttcacacagaaatgaataacattggaccaggaaagtaaaaactttgattcaaatgtaaatatatatttaactatttggaatttaaattccaaatagtttccttagaatgtagaatgagtgtttccttagaatgattcatacgcttatttcctgtcatttaattggcatccctttgaggttagtttatggatatttggctaagcctattggaatagactgaagagagttaccagatcagaacctttatcataatgtgatacggactggactccagggttgccatgtcatgcaggaatagatcaggaatagaccttcagccctgctaacaaggagtgagtagatcaggaatagacccttagcgctggtaaccagatcaggaatagacccttagccctggtaaccagatcaggaatagacccttagccctggtaacaaggagtgagtaatcaagacatagaactaacatgattttaatgcaggggggtagggatcatttgggttaaggttttagcatctttaagtagtcaattacagttggaaaattaaaaattaaatgttattaggaaattatgtttttagttaaatatrtatatgcacatgtatacacatccatgtgtgtggtttttaccttaaaaaataaaatgacaatttctctttgcagagaaggcagatattctcctcctaagagctggattgccttcacatttccatcttcagctctcagaaattgagttccatgagattattggctcaggtaacctaaaataaataaataaataaaggtccggtttagttgaatgagcttaagttaatatgtgtttatttatttattttaaacaattgtaggttcttttgggaaagtatataaaggacgatgcagaaataaaatagtggctataaaacggtaagcaagcaaatgaaaaaatttaacatccaggtggaattgtgacctttgagaagcatgtgcatggcmagccccttgtttggatccatctgtttactgaagattttctgttgctgccatttccagttatcgagccaatacctactgctccaagtcagatgtggatatgttttgccgagaggtgtccattctctgccagctcaatcatccctgcgtaattcagtttgtgggtgcttgcttgaatgatcccagccagtttgccattgtcactcaatacatatcagggggttctctgttctccctccttcatgagcagaagaggtatgggtcttttgttctgatttatccttggacattccgtagaaactactcttgcaatacttcagagggtttcccattggatgagccttcaccttttgaaatctgagtgctgctagcaagtgtgtcatttttaatatcgctaataatttatgcctaataactgtgtttcaatgaatagaaatactttatgctttcttagcagaaattcagttgaagataacaaatttaaggaatttaaattggaaactggagcttaaaataattaggctaaatttgaaatactgataaagaagatatatgtaagctcagaataaaataaacttttaaaaaagtgatcttgaacaaatccaatgtgaattcactttctgagtttatgcatatagtaattagaatgtagtttcatacagtgattaaaatagatttcattttacaatattacaaagaaattaagtatagtattataaataaattataaaaccaagtataatatcttaaacaagagatgctgtatatcttaaytgattcataattaagcattttctgatgtaggaaagctattcagatttgttgaatttctagcttaaccttcaagaaacaaaaaatggttaagatgatataaaataacaactcttacacatcatttgcttttttgatattcgttttgaccatttcatctctgttaaatctatttttaaattctaggattcttgatttgcagtctaaattaattattgcagtagatgttgccaaaggcatggagtaccttcacaacctgacacagccaattatacatcgtgacttgaacaggtatttttttcctaaataatgaactcagaagggtatgactaactgggagtttaagacagatttcagtgaagatacattttagacttattgcagatcagggtactctgtggttaagaggacaggctaccataagcttaggcgatagaaagttwtgtcattgtcttttaaggagtagaaagctgtataactgcttctcagggatcttttaaatctatgaagaatattcacaaatatagtaatatctgtaagatgcaccagctaactagttcccaggtcagtaaggtcacatcaagcagtgagctaaatggctattaaaaaaatgatatgtctcctataaagtgaagtgttggagtagctcctgatataaaattatctgaaacgtactttgtgctaccgtaaattcagcttaaccacaacagcttatttacctagttatcaggtaaagaggatttcatgtgaaacaaatataaaatcagagtgttccagtggtggaaccccaagtgacctcaaaacttttcctaaatagtgaaaactttctctgagtaaagtcttataggaaaggccaatatacaaaatggagcagtgttgggtgaaggtaaagtggggaggagaaaactctatttacttcccatttcccactgctaaggagagagattcctgcaccacctctgtggaagcccaaaggtgctgtagagaatagttggacaaacactgatttagtttatgaagcaagtcagattattccacatcaatcactttcattttatgatagtcaataagattcaaatagattgtgtatatagtcctttatagaagctttacagttctgaagctagtaartattgattactctagtcagtcatttggtcaacaactatgtttgaacatatatgtttaaagwctattttcagcacagtagagcttacaaagtgggacgttcatagactacattcagggagttttcacactctatgtagaggagaaaaatatttacctaaatgtatttgaggtataaaataataagttatatacaagatttagtacaaaaatttcaggaacaagaatattaattgcttctgaggattctaacaacaactctatggaagggatgacatatgagcttggtcctgaaagatgggtagagtttggaagagcatcctataggcttagggaagacataataaaatgcatagagattagaaagttaaaggtatatataggaactrtagtttcattttagtatacaaagtgtataaatgtatgtaatgtgtataatgtaagaagtggacaactggaaaaaggtatagaaaaatagaaaaagagcacagacaccagtgaatgctattactaaggtatttcagattttttttcctgtaaggagaccataaagaggtttgagctgaaaatcacaaatttggagctatattattgaaagatgaatccagcatctggtaaaatatcaacttgaagggaaagtcaagaaactagtgagggagttgttgcagtaatctagataagaagtaacgaaaagcagaatttcaccggtggcagtggatatgaaaggaagagacatgtcaactttaaataacaaaatacagagtttattcaagctcaaagcttgaggatcattacccatgagcatggactcaagttgtcctgaatacatactccaattagcagtggttacaagatagtttttaagaaaaaaaaaaaaaagcagtttttaagttgtttacaaagaatttacataaataatataaactattgattggttgtaccttgttctttaatcaaaaattataggaacataaagataatgggtaacacagctagtcaggaacaaaatacctttacactattgccccagggaaatggagattggagagatgactaaagtcccatgctcatgtctctctgggcctgataaattttgtgttgctcatacagctcagactgccctcagctatttttctcttctcagatagatatgaaagataggagagataaatcagatacgtgagtggtagaatcttaaatattgaaagtaaatgtaaataagtctcaatctatttataattatttactagttttcacataaaagtcatttcttaatttttagctattagttctttacctttcttaatttcaaaccaaacatttacgttaacaaacatttaactatttcagacacagatttagatgataaattagcataatataaaccgatgattttgagttttaagagtattatctttccatcccaaacatttttgcacatggtattaaaacaaatgagtaatcattgcaataagtaatcattgcaagttttctctagctgtaactcttcatttgtggggccattatatattctgttgccctgagttatgtgcaagttgttaccaccagttgtcaggcaggaccaaaaatataaatgttgattaaaataaaaacagaacatttactatatagctgatataagtttatatctacaatttttgctgcctctaatctaacctaaatgcttaattgcatcaaaaagtttttaaatcttatgaaacaccattttgtaggtgccttcattatgacagagtcccaaactattgtatcaattatttgtagactattttctatcaatctttaatctggtagcaacagcaaaacattgtttttcagatgcatgcatatgtagcattctacatggctcaaaagagcctgggtcctttccctcagagagcttactgcactacttggcaaataagacatatgcccagaaagcaactagagttccactttatatagaaaataattaagggtcaaaatgatgaaagagcaactttcagaggatttcaagtaagtcaaagatgaaagttgagtagaatgcttcttagcctatgtggagctaaacgtagagtttgaagaacaggcattaatcttttctcaggcttttcacagcatactaacctctgctttagcatggtacctagaaagtctcactcaaagaagtagagagaaagatgcacatcagagactgggaaactcatacacttatttgcatttgtattgacatggtgtgtttatatttttatattccccattagcctgggcaagtcagggtttcaggggcagagactgctctcttcatctcacattttctgaactaagcattgtgtcttacacagagaagatgtctaattaatattttttaactgaaccaaattattgtggatttctatgagtgtcatttcacgaagcaatgacctaattggtataagtatgactacttgtgtatagcatccaacttgcccaataacttttataattttaaagggaaaaggatgtttgagcccacgggatggggcacttttatatttgagtttgtggttgttgcaattgtttgagtgaaaaaaaagaactctacttttcccatggcaagcaaagccagctgagggtttgtaccatccagttctgaaagttaattttgatcttcagtaaatgtcccttggcatctgcaggggattggttccaggacctctcatggataccaaagtctgagaatgctcaagtccctggtattaattgctgtagcatttgcatatttcctatgcacatcctctcctgtactttaaatcattgaaagagtacctataatatctagtacaatgtaaatgctctgtaaatagtttttgcactatattgtctagggaataatgacaaaggaaaaagagtctatacatcttcagtacagacacaatctttaaaaaaattttttgatccatggttagttgaatccacagaagtgaaacctatggatttagagggccaactatatatactaaggaaaagttcaaggaaggagtaagaaagtagttattttcaatgtaaatgatgataatgataatacctaccatttatttatcaccatatgaaaggagctttgctaagtttttcatgctttcatttaaccacgcaactctatgggatagttgttattatttccattttacagataaggaaactgactaaagagactaagtctgtagtattctgtatcttctactgtaacaacaacaacagcaaaaccatgtgagaagagagagatagaaggagcgtactgatgatattgaatgggcatcagcaatatttatcagccttactctctgtactttaatcttttaaaaagtcaattcctgtgacccaaacaatttctcatatcatcttatgcttctgtgttcctgctttatttcttctttcacactccatgttctgctggtgtggaacagatgttgcatagaaagcatgcagataggttttgtttggcccatagtgtttaaatattttgaaaatgttcataattcaagcaggaatgtacctctctaatttgctgtagacctcaccacctaccaacttatatttggtctaatttatacattcattttgtggcattggagtttgctagtcattatttatagcttaaaggatttaaactttttacttaatactagaagctgtgtgtttttcttggaaaagtatatttttcaaattgtttgacactgaagcagaaacatcactgcaaacatacatggatcaaatacatgatattctccttctataaagatatagtattatatgttatattaacactgtaaggaattaaatagtgataacctccatcacaaagtgcacatggcattcacatgaaatatgtatatgaaatcattttataaactgtgaagcaccatacaaaatgcattttttattactcttaattcctcatttgttccctttaatattggggatggaaaaacactccacaattaaaaccacctttgcaaaaactacaactgagaaaattatgactgaaagatctgacttgactccactttgcttctaacctgcaagctgttcttgttcattcatggacataggccaaaataactttgggaggaacttgaaactaagacaataatagccctttcacaaaacaaacctctttcctgcctggggactacactaccttcataggactaacaaattagccacaagattagaaataatggtttaggaatcacatagctggagactgaaagattmgaaacctccccagattscttctggggataaatcactattgcaaaacctaagatcagtgcttgagatattttgcagatgctgtacaggatggctcagctgctaccacccagactgataaactgggtcatctggtctcctggccccaggagactgactcagcatcaagaggacaactttgacaccctatgatatcatctccaacccaaccaatcagcagtccccactttcagacccctacccaccaagttttccttaaaacccccatcctcaagtttttgagaagactgatttgagtaataataacactcttctctcctgtacagctggctgtgcgtgaattaaacttttctctattgcaattcccgtcttgataaatcaaatctatctaggcaccgggcaaggagaacccactgaagggtcacaacgatattctcatacatacagaggttttttttatatgatataactaattagtttggggtctagatctgagaaggactcaccgtttttgactgtcagcttattctagtgggtataaaggaaaataatgagtgataattttaaaatagccaactttccaatgacaaatgacaggtaatttaaaaagacagagctgttatgagctaaaaaaatcttaattttgaagatgacatttaactcaaatagtgaagattttaggaactgccaaagaaaaatattattgatagaaaattataatagttgcttttaatttgatatatgcatttgcctctcagttgaatgcaaaatataaaattcctgcatgtaaaaaaaacacaacaattaagtaaaataaacaaattgttaattttctaatttgtgttcctcaaattccatgtattatagagtccctctcccagctatttctttaacttgtgacttttctaataagtgcttaaacagaaagaattctgcatccattggcaaatatcatcttcaggagacttctgaagacctatatgcagaccaattaactgattatattaccatacttataaaagtcctgcaagagaacccattaaaactcttatgaaatccttgacaaccctgtatctgtgattctctagtataaaaccagtcatcacaagtagcattttaaattttatcaattatttttactcatttgcacttgaaaaatgtcaattaattaaataatatcaaatacttattgaatacatgatatgatctagggtctatgctatsccgtaggggtacaggtgagaaggacagatcataacactttttccagcagagcatagagcctaaggaagcatttacaaactttcctgaagaatcatttgggggccttcattaaaaaaaaaaataaaagattcaaagacactgaagggactgactgattcagcatgtcttacgttgggcctgagaatctacacttttaaacaagactaccaattaattcttatgacctaggagaggaaacattgttctagtgcagtggttctcagtttggctgcacagtatctaagagaactttaagaaaatcctgatgctgattacatcagaatctccagtcttggggcctacgtatcatatttggagagagagcacttcaagttattccaatatctaggcaaagttgagaatcacattttagtctgatgtcaattattcctcttgatcatttgccgtataacttcattcttctctgctgccagagtaaagtgggaatattagggaatcaagtcacaacgtaactccaaatgttttcaaagtaatcaccctaaagtcagtctaattattcattcattcgtacatttgtgtatcgacttactcagtaatgaatgtcaaagacagagatccacacacccatggtacctatggcacagaataggtcccaagatttggcagtttccatgggagttgtaccatacaaggctcctccagagaaaataacttctaatttatgaatgacactagaaaattccctagagtgtagaatcttcacaagtagccaaaacagatacaaaagtttcaataccagacaattatattgcacatggtttatgtaagtactatatatccatataatacagaattatatgtaataaatagatacacatataaagagaaggattcatatatatgtgtacatattctatattagtctagggtttatagccttgaatacccacatgaactgcagtgtgcactgcagttgtctgatattaaaacttttatttctgtttcggctatctgtgtagattctacactcctgggaactttctgatatcacccacgaattctaagtaatttgctcccaaggagcctagcacagataacacaactcccatggaaactgctagatctttggacctattctgtgccatgggtaccatgggtttgtggatctctgtctttttaattcactaytatatcaatgcacatataagtatacatatttatatataaatgcccatataaacagacacatttccatatgttttcgtaatgcttccagccttttaaaactagaagaaagaagtcagctctacagagggtgagttcagggatgattttcaaatctcctcagcatgagaaataatcactatcatttggagtacatagaagaaaagttaattcataatatacaatggatgccttagggattagggctacctgtagttctgaaatgtttatgtccaaaattgtaatctgatttcagattttcaagttaaaatttttcttaaaaaagcaatcaactgcaatcagattcaattttattactgctttgagtaatgaaaaaactaagctatataatttattaatatttacaatatgaaattcagattagttagggtagtttatctgctgtaacgatagagtccataacgtataatggttccaatacaattgaaatttgcatcttgattgtgtggatgaacaagttgttgaggcggtccctatccatgatgttactcaggacccatcttcaacgtgtgacttctagggggtcaaccaaattcaagtgagcactaatgaggcaagaatatataagatgtacatgacatgttgtatgggccaggcattagcatggcacacattttgttgttgttgtcagtttaattttatatatatatatatatatatatatatatatatatatatatatatatttcatttcatcacctcagstaatccccaagggcatttacacaattcataatgaccaatgtgacttgacagtgacgctgagggcttggcattgggtgatacagtcagctctgtcttggtggcaccatatgaggtcctgggaaatgtagtctagctgtgtgcctagaagaagaggaaatgagttttagtggtcagccagaagtctgtgctacattgaccctatgtatactggtgataacaggtaataggtgtctgagtaatggttataattaagaaggctgatctggatttgcatgaatcagttatacaaatataatgttagttgcatactaaatatttttagtttattaatgtattttcacaatttatgaactaatagcagtaattgggaaatgaatgaaaactacttaataaagcatgctatatatgaattaattttgaaataactcttctcattcacttttgttaatttaaaagcatgagaatagctttgggagtgtggcaacatatgtctatgaatcaaaatgtggtccaagaagaaaaacctcattatgactatgtccctgaattgaaatatggctcaagaggaaaaacatataactatataaatataatagtatgaaataggctatatacattttaaaacattgtcataatctcatgcactatatgtcagtaaacacacatacacgcgcgcacacacacacacacacacttttttttcttcaggagtaaacattaaaataaaaagactatggccactgtatttagagaaccttgtaccacacccaacagaaggggctccttaaccacttagttctacaaattactctaatcctatttatgagctgcactcagttgttggtgtccagtcataatttctatccccatttctgacatgctcagtttccatattatgaagtcagtctgtctgtctgtcctcagcaacctgaacctccagaagaaacagtgagttctctctgactcaagtttctacccattatttccacagagattcactatccaactcttcctggtttttctctgagggtagattcatccctgcctcctcgactaatgctcatagtttccagagggccaactgtgtcccaaacattctcatgacatttcactttggttaatattctcccccctatacttcactactagaatgtcctttagtcctgagttgtcctctttttgtctccctacagaaatagctaaagtttcctcccagggccagttaaaatgttgttcttctctcatctgccttcattaggtctcatttaattttggctgcattcaccaattctaaaaatagtgctcttacttaacaccccattaagtaaattcccttagacacactccctttaaatgaaaacaggtatatttaagtcagaaaaagtcattcgttttccccacactatcatattgcttgcataaacctggacaaatttaccatctcttacagtagctcccatcagaatctttgcctcattcagcccagacagacaaattccccaatctcacatcttctgtatgccatttgaaatgctacacaagacgatgtgtgtgtgcaaataaatgtatctgtataacagcacagaaaggtactaatttgaccaaaactagaaatcctgcgataccaacatttactttttatttgctataaaaatagtgctactccacactggaacctggcaacaggatttcttattccagtgcgttcttgtggttgaagtggttcactctgcagcctctttccttaatacaacactcacacggtgcgaatgctcaaagctagcgtggtaactgtaccttccctgtaacaatgtcaccttcccgcacccacagactgagcgtggaagggagaagcgacgcccctcctgatcctctaaaacctttcaaatgctttcctgtaactggtggtgaactcactggcctgcaattttctggtgttactggtttcttacattgccattttctattctttggggatatggcctgaataaagttggcttttgaaaatgtcaacaaaagcttttctctgtttggcttcgtttcttctctgctctcatttcttgggaggcactgtgaatgccctcttggcaccttgtcgatttcctaagcagctaacctttcaataatgatattaatgctgccgtgtggtaatctgtgcatttctcacttgatcgttttcaacccttgcttgctgagattgatttgtgttgttgtgttcttaagattctggagtttaattgagtgcaaactgactagggacccagaaacaaaatttctagctaataaatgagaaacaatcttaataagtggaaatttgtttctaattgaatttccaagagctagctatactttgaatttggccttgaaaaagagatacagataattataaacctttttaaagtctcatttaatattttctatttcaaaatcctccctatttggaagaaagtttctaaataatgttaatcttctctggctgggactacagcatggatgcctctggggatatgtgttgatgtgggctatcaccctattggaagaccacaggagaactaattgacggcatgggctctgaagccagactaagcatgttcacatcccagctctgccacattttacctgtgtccttggtcaatttatttaacatatcagttttctaatttccaagacggttatatttaaatgcctaccttattggatttaaatgagaaaatacattascattattagcattatttttcttctttattctttcgaaagaatcttttcactattaaattttcttgcatgccctagttgccctcctgaattaaatgtttctaatgatctagctctccttttttattgtattacacaaactttgcttataatatctcagatggataatttcttcttgccctaaagatctgggaaataattggattgttttactgtagatctctttctatagagaaggtcaaggggattcaaataacagattactgccttcattaagacctctcactccttcttggttcgaacttgaatcagggattcagtctgatactcccattagacagaagcagatctggaatagaatttgattaaaaatgtagctgagggttagcaaggttatttgattatccaagatccttctcagtgattcttcttcctagggctccttcacaaaacttaaaggtgcaatttaaacaccatccacttagacattcaaccattatttatttggaaacataatggcagagaaggggaagtatcatcagaggcacattccagagactaaaaaatccaagtaagagaggctctatttttgcagaggatgtgtatagcacctatgtggttaggcaccttttcttctccatactcaagtagcactcagcgactcaactcagcagttgtccttccgaccataaacaaccagggaggatgttttcaaaattagcattgagaaagttgtcccttatccttccttcagtagtgaaagaaaaggaagaattcatcctatcacacctttttgattcccaagagacaattctcaatcgtttttgtcatttctattcatgttcttactgtgttgctgttatgtcacttgacgtttttctgcttcagatttctgatttacaaaatggaaataatgatgtccatgtctaccttttcacagaaatacccttgtgattaataagggtaccaggacaacagtcaatggaggattttagagaaagattctgcaagagatatttgtatacaatgtatattaattacataaagcagggttaccagaaagtcttggactaagattcattttgtatccagctgctgcatcagtactatttgcagaatagtctagattatctttctctaactgaaggtgaaaggttttgttgttactaaatgatgtgggaaacagcatagtccctttctgaaagatgcagtgtttctttggccagcatggaggaaagagcatgcaagcttcacagaatgattagaactctttaatcctggatggatggtctttgtatcaattatgtttcaacccttgtatgtgaagaactgtattctcagtcactaaaccctcatttaatggttttagcaacctacagaaagttagtgaaaagcatgcctggtgccatagatgaaatagtgttagagcgttgatgatgtctgccttcttttcttttgggagggaaatcccccttctaaattcttaaaatagagttggctttcattaaatctattcagagttaagggtctggggatcttgagtgacctctttctttgggaatggagcacattttaataagctttttcctgtccatggtctctgaaagacagcctctggcagacctcctgaattgctgggttttttaaaggaaaggattgattacaggcttcgaattctttctctttctttaatttctttttttttttcttttcatacaaagaatgtgaaagacattctgagtcttcttctgttgagatatgggtggccttgcaggcagacatttagcattgaacttttattaattttctgtgggtttgacaaagtttcttcttttttgcttcctaaatatgagtgaggctaaagagctgttacttgcccagcttgttcttcagcactgtaagtgctagagaggaaaaaaaatagtttttttgttcttattttgttttctggctttcttggtggaactgcctctatagccttcatctgaaaagcttcatttattatagctcttaatacatgctattccctcagacacaaacattcgcccctgccttacctctctcttctctgtgcccctcctcacactttctccataaaactttccttctaactcctgtctatcccaaatgcttcttgcaggaagccctcctacacgttcccacagcacatcagactcttgcttatttcaggagagctcttctcatgctattaaaattgctcatgaacttgagagtgttcccactacacactaagcttaattggtacaggagctgtggatttttcaccattttattctcagtgctttgtacaatgactggggcctaataaaaattcaattaatatttgtcagatgaatgaattaataataatcaagraacataaggataacatatattaatgttctttatgccaggtattgaactcaatgctttacagagatcatctaattaaatcttcgtagctctatatgatgacagttttgaatacataatgacagaaaaaggctaaaaagagacttagcaaatcatcaaggtgataaagctggtaagtgacagactaaggttattacacacactagatagttaggtaatccaaaatataggaatgtatagtcatttagccccacaaaacaggarcagtagtcagataatccaaaatatagggatgtatagtcatttggccccacaaaacaggagcagcactgactgaatagcaatgcaatgtatttttcagatcaccttaccataggagctgtactttctagaattcatagctgaaatgagaaggtagttctcacttaatattgaacaattctgtggcatttaagagtgtgaaagtcattcttttgctcaattaacacgctattccacaagtcacttctctggctattttgtgctgtagataattatttgcatgctagtcactaaagcctgcctataaaaaacaatgagaaagggaaagacaatcagttgtttgactgatctgattttctgttttacttaggtgaaaagttagtcaaacaaactcgttttgcaatgtagctatagctcaagactatctgatgcttttgaagaaaaatacaacctcctgaaattttagtgatttccagccactactgaccatgtaaatttgaaccaatacttgctttttctaaatcaattgattttccttctcacaggcaacattttattttctaacctgcagcatttctatgcctgactggaatatttttgcatttgattagtgttttcatttgactttcaatgaggtctcaaaacagtttggcttgtcacagtcaaattatttaaatattcctctgaaaagagtatgtgggaactaaaatcagattcatgtgaacctgaaaaaaacagtggcaacgtttcctgaacttgttaaatttttatgtctaaattaatcatttcacaattttctttcatgttgatgttcagcttcttaaatatagtgattattggttgccttaatggaaaacttttaatttttagctgacccagaagttggtctctgataaggatttttgttatttttaaatattccttatggtttcaacagcaccgatatattgtgccttctactcatattagtaaaacttattttaatttatctaacccatccttttcacttctcagctactcctcactcctcctaattgatcagaattatctcaattatgggttcaaatatggtcaacattctctgcctacattccacttatgccctgtgaaagaaagcacacgtaaaatagtacataccatattatcccacttgtatataattttagaaaatgcaaactaatcaatagagttgaaaagattagtgttttcctagggctgaggtataagaaaggaattgattgcaagagggaccatgaatctttttggggtgacagaaatattttttgtattgattgagatggtggtttcacaggagtatataactgttaaaactcatcaaattgtagtctttaagtagatgtagttcttccttctcatgtggatacaagtaaactgcctaacatgggtggtaaatacaaaaatgtgaaaatcttagaaagaggtatgtaaagtaatgtgaattggcacctttccaatcatgaacaaaggtatttgtccttttcaaaaccttaaaagggagaaataatcatctgccaaataatttcatcaaggatatcaaaaacaattccagctaaaggagaaaaatcaacataactgaaatggaagaaaaaaaggtttactaagatggcattgatgaatacaaacctgtatcacactgaggtcaacatagctgtctgcaaaggttaagagttcagtccaagcaccataaacactgacaggaatgaagatgagagagtgcctttgagactgtgcacttactttctattcttgtaggttctggtctgatgcaaaagatattcaatgacagaaactactccttagccaaatatgaaagtgcataaattggatggcaaaggaaaggcctagagtatttatatatcatctgatatggcttggttgtgttcccactcaaatctcatcttgaattatagctcccataatccccatgtgtcgtgggagggacccagtgggaggtaattgaatgatggggattagtctttcccatgctgttcgcatgatagtgaataagtttcataagatctgatggctttacaaaagggagttccactgtacacattctcttgcctgccaccatataagatgtgactttgctcctcatttgccttccaccatgattgtgaggcctccagccatgtggaaccgtgagtcaattaaacctctttcctttataaattacccagtattgtgtacgtctttattagcagtgtgagaacaaactaatacatcatcaaacaactggtagattgaagacttcagacctattcagtattgaaaactggcagatataacatctgaaaagaaaaaaaaaaataccctaaaatcattccatttattcagagtaatgtgttactagatatgcaacactgaaatgtggagcatgggagtgcagctagaataagtttttccttttataaaatatcatttatgagaaaatgcatctatgggatctaatgaaatttgatacagtaactcagaaaaaatacaataaattaattaatttacaatcaagttcaagaaaggaagccatataaataatataattcatgtgtaataaatataaaatcagacttcttcaaaattagaattgtggggcacttttacatagtctcaacaagtgaaaattatatatcaaataactggtctgtgaaaaatattttcttttgtactctgatccaaggtcagcttagcccaaattcagacaattgggttggacaatttaaaattagttgacagaaagaaattggtagtgtgaaagttaaaacttcaaaataaacatgatgaaggtatttgtgataaattaaatcatcccttgatgactataaatgactcacaraaatatagtttacattgatctcatttggacagtagtttacttactttgctaaccttaactgtatattaaggatatgtactcattgtcaagacaagggagatttgggaatttcagagagccatttgtttacttgtaaatgttaaaatttctatagacaggctacacagtatatattatctatattcattcttattatttggcaaatacatttaacagatagtttttgctgaaagaaagctgtaattgtataatttcctatgcttacctttgttcaaatgtctcaacaattgaacaatacaaacaatttatgatacwtgttttctattgtgcttcacattctttagaatatgttaaggaaaagtgtgatcttctggtatgtaaaacctaccatggtgagaacaaagaatatactctgggtcaaagaaaccaaaaaaagcaattaaaaaagaaacaagcgaatacatttaaaaattcatattttcagcatttgattagtgaagtgccatgaaaatcgtattttggtcaaatgtttgtataatcagcaagaatacacaactttatacacaagaaattcctgctttgaagattaagcttcatagctaggatttgtttcaaaaagagaaccatagggacttcccaaattgaagcccatgtctcaaaagctgggcttggcttgcccaaaaaagctttcggtatcatttcttataaaggaatttaccatgagctttggtcaacaatacagagattaggaatcaagatggcagttttaacagtagtggaaaaataaaagagaacctgtaaccaaaatatagcagaaagactgtgcactttgaagtcggcggtatcgaggcgtaatcccagctctgccacttcaaaacactgcaatgattaacaagttatttctaaacatcaattttttcattataaaatagggacaatatctacctcatagtgttttaaaatagctagcagtgtctggcacatagtagatattcaataaatgttagttcttggtccctttatcttaaatggttctagaaataacttgtttgaatgtgtgtttattaaggtatcaactctcatatctttgttacaagtaagtttcaaataatacctttaaagaacacttaaggccgggcatggcagctcacgcctataatcccagcactttgggaagctgaggtggatagatcacatggtcaggagttcgagaccagcctggccaatatggcgaaaccccatctctactagaaacacaaagagtagccaggtgtggtggcgcgtgcctgtagtcccagctactcaggaggctgaggcagaagaatggcttgaacctgggtggcagaggttgcagtgagccaagattgcaccactgcactccagcctgggtggcagagcaagattccgtcacaaaaaaaawaataataatttttttctgtcttcccactctcctacccaacaaatattcttcctcttgatggccacaatatgctttgtttacattaatcatctcgagaaatagcaagaaacagtggaaaaggaggaggaggaaaatgcagatgcagtgacaattcaaagaaagtaatagtccaaggtcaatattaaaaatataccttttaacagtcaaaccacaactaatcagtctccctctcctcatctcatccacaacatcggacttcgtcttttctcagccacctgagatctgattaggtaggaaggaaacattaggtcaccagaaataatttgtgggttgaaaattgagaattgacatgatcctacttttaactttatatttatttatctttctgacttatctgaaaaatataacaaggaaaacggttctcatatttgaatattttcctggtattttatatttatttttattttttgatgcttgaaaaatataccatcaaactacaggtacagaatctcatactaaccttccatactgccagagtaacatctctcaggaatgtctccccacctccaggtttcaaattaggcaataagtagctgggaagtccagcacagtacaggaacttcttgctaggaattcttgtgcaccatctgtgacattcatgtgctgcctgcaacaggcagctaacacaaatatgtaaccatcctcaaagcactcatgcaactgagagtactttgttggatgaagagaccatgccccgacctcagtatcagctaactgcaagggaacrgaccacagatacaagactctctggcagtgttatggagagtggcttagtacaggagcatttgccataggtcaggaggaaattaaaatagcacaagctggaagtaatgagtgttggatctgagacggaagccatgggaaagcaaaggaatctaaagattacagatttatggtagaggtgaaattgactggatctggtaactgatcccaagtaagggtgagaagaagaaaaaatggaaagatgtcaatcagccttgttgtcagggtagataatgatgcacacaataagatgcacataaagatgttgaaactgatttcaaccattttgtttgaaatgccagctaaataatcgtctttataggaaactgtgaagaatatggtagagggcatttggaaatttcatgaaccttagtatcttttagaagctttgtttgatacacctctcctcttagaccaggttaggtactgcctttctgtgttcctatcacacttgttttcttccttatcttaacacttatttccttttattggaactttttaaattctgccacctcacttagaatgtaggctgggcaagataaaggaccaggaccattttgctaaccttagtaccattacaccaagcatagagcctaataaatagaaagtgttgaaaaactgttgaatgattaaccattcatttagaccctttagaagttggaaagggctagatgtaaatttcaggaaaacaaaaggttatagctgtgggattaaatgactgcttcatgtagagagttcaattagaaatagcagtgggggtaaaacattaatacaggattaggagccattaggaaaaggagagaggggtaatcatggagataagagaaaagggacaattttagatagtacaagatgtcaaaagtatcagttaccttaaaaaatctaggacactgggagaagataatgatattagaggcatttgaaaggtggtgggcaatgaatagcactggcagagcaaaaataaaaggtctcattattagtccaaaactgggaagaatgagtttgagaaaaatgtagagagcatcttcatagctcctataatcactggattctttaattcagtgttttcctaaaggaaaactctggaattctggtcaagtgagatatgccatggaaaaagactctctgatgaaagaagtctgggtaagattgagtattatctctcacttttagggatcctgaaaattaattagacttacccattaacatacagagaaaatcatatttcctggactttattttgaggtactctgctttgattgtgtaacagcaaattggcttatattctctaattataaaaggtacaggagtgaatattgtcagtatttaactctgaaatgtttctggttcagatgactctttggaagtgatatattcattgaggtcatcacagtgctttgagcagtagtgataatactgtattttaacgtttcttttttattttaccaagatttattgtgcacctactatctaccaggcactgtgctcagtactgaggttataggattaagtaagatggcaaaggtctctgctttcatgaagcatacagattacaagtgggtaggagrggtagggcaggaggagmcagataataatataaataagcaaggatattttagatatggtaagtgctgtaaaatgtatagatgtgagagtaagttattaggaatagagagactaattttgattgttggttatgaaagccttctctgagagggtgacatctgagctgagatctgaataatccaaagcagctccatcctggtaaagatatgggtgggaggttatcccagagaaataatgagtcagcaagtgaaaaatctctaggtaggaatgaaaaaaatatatttttttccgaaaaaaaaaaaaaaaactgtgtgactgaaacacactggataatgaaagtgatagaaaataaaataaaataaaactttagcaaaagccacaacatgtatgtcctgtgggccatttttgagctgaaatcttactttgaatatgataatacaccattgagatgtttaagcaagagagaaacatggtctgctttatttatttgttcattcgacaaatatttggacactagagatactgcagttgccaaaacagatcctgcctttatggaggttatattttattagattaatactagaatattctgaatgtattagggagaaaagggcaaaaatgaaagctgagagagcagttgggaatctatggtgacattccaagtggcagatgaaaatagattggaatagaatggtgacagtggacatggagagaaagcaatggatttggtgggttttgtttgtttgttcgtttaggtagagtgtactagatacatataggagatgaggggaagagaagaaataggcagacacaggtgagatttttgagacgttagttgggaagtagcttttgggaaataaaaaccaagaggtcttttgtggccattttaaatttgaggtgcctgttagacatttaagaagagaccttcagaaagcagttggaaatgcaaatctaagctcagaaagagacaaatacttaaattatacatttgagagtttcagcaaatggatgtcttttaaagctatggagtagatgagatcatttatggagaaagaaaagagaagagaagaggacctaagacagaggagtgggtgctctcagagaagactgagaaggcctgagaaagggaaaaaggaaagccagcagcaaatggtgctatgggagctgagaggggagcatttttcaattagtcagaagttatcactatgctgaatgtacatgataatttaaataagatgagcaaaacattcagatggtccttgatttaggatggtacagcttattattttttttttttttttttttttttttgagacggagtctcgctctgtcgcccaggctggagtgcagtggcaggatcttggctcactgcaagctccgcctcccgggttcacgccattctcctgcctcagcctcccaagttgacttcacaataagtttatcaagatattaaatgcactgtccacttaggatattttccacttataataagtctgtcrtaagtggtaactggattgtaactggagagggctgtgggtcagggagggatttgaaggatgggagctactagagccggtgtccatgataagggaataatctggtacagaggaaaagtagatgttgcaaaatagaaggatctaattgtgtgaacaaagtcctagcacttggcttagggcctggcagaggtaggagctcagtatgagcctgctgaattacaataaattacttaaactcagcaggtaacagaactgggatttaactcctcgtctctgactcctagtttagttctcaagtcactagaccgtgctgtccatagcccttagtccagtctacttctcatctataaagtcatttctcccaggttccatcagtarccctactgctttagatgcagaaacccctgattcaatttcttgctggaatggatttctcacaaataaggataatcctccatttcatgtttactcacttggttgacttcctgttttccacactcttcccacaacaggctttgcagtttttattttctgagacattccaataaatgagagttggtattgtgaccgagtacctcccgaaatgcataatttttcccctttatcatttttgaaacgaatgaatgaattgcaaaggagctacattaatgagatgtttaatttgaggttttaattttgcaaatgttgggaagcataattaaggttcaggcagtatcataagtgtcttcaggaatacaaaataactgtttttgcatctagagtttctgggaacattttctgcctaaacacaagccacttatagctgttttcctgtgttctaaaagcaccccaggcactgtgaagacacagaacatgtggtactcatagaggtrgcaaataatcagcatggctgtcattgtgacgattagcagaaagcagtgtgctgagaggagtgaaggtataggtgaaaggcagcrggcactggcttatatttattttattctcataattgcagggcagttttcttcaattttattctatatgctatctcagatmattaaagcagtggagaaggacaggaatattgagttagttagggatatagataggatggaaaagcattctggacaaaaaaaaatgagcatagaaaggatttgaaaacttaagaaacaaattattctcaagcattttctttgtatcagcataccatataatttaaaaaaaaggagaaagaaaaatttatatgggcctggaacatctatcaaaagaacgtgagcttactttatggggtggagaaagggctacttgtgttcaagcacctgaaatcactgtttctttaacagaccacaaaaggactagaaatagaaattaattttccaggcaatttctatctcttgtgctatgtctaaacacacaagccagtttgaacaaaaaataaggtggatcaagtaacaaatatttacaaaattgctattttgactttttttggaatagtattatacagcagcagtacccaaactttttggcaccagggagcagttttgtggaagacaatttttccacagaaggtggggaagtgggggatgggggccctgaggggaggcaaggccaggaggggaatagtttcaggatgaaactatttcacctcagatcattgatcattagagatttgctcataaggatcacacaacctagatcccttgcatgcatagttcacaatagggtttgtgctcctatgagaatctaatgaccctgctgatctgacaggaggcggagctcaggtggtaatactgacctgcttgccactcatctcctgctgtgcagcccagtttctaacaggccacaggttgggacccctgtcatacagccatgggataaaaatagtgaaactctattgatttattggacttgtattagggtaaaccgtatgaaactgcctttggtcaaatattgatcaaaatggttgcaaatcaacaatattatctggttcaaggtaatgctatctttaagctaatgggaaaacctcctcttatgatcaaaatcaattaatatgcatttattccatattcaggactgcaccagatgtttcaaatcagtggttagaaagcttttaggtgttgcaatctcttttagtattaaaaattaggaagacctcaaggaatgctgttgaatttttagagtctgtctcttttagagcgtgcttaaccatgcttccctaaagtgaataactcttataaataatttttatattttatttactatatgaaggaaataatgtatacagtggtccatttccaagacaaagtgccttgaataggcttaagtcagcaaactacagaagaaacaggatatactaggcccctgctggatagctgatgcctgcttgtcarcaaccccctttcccccattagctgccctcacccaaaccaaagaagtttagtctaagatgaaagtttactagcctgcaaaatagctcacttttgtctgttctattcagcctgcccagctatttaggtcgtaagtcaaatacttgaaaagcctctgagctaaataggattgcaatgtattgtgggctgcaacaaaatgcagcaggacaaccctaaagaaaacacttaggccgggcgcagtggctcacgcctgtaatcccagcactttgggaggctgaggcgggtggatcatgaggtcaggagatccagaccatcctggctaacatggtgaaaccccgtctctactaaaaatacaaacaattagccaggcatggtggcgggcacctgtagtcccagctactcgggaggctgaggcaggagaatagcgtgaacccgggaggtggagcttgcagtgagccgagatcgcgccactgcactccagcctgggcgacagagcaagactccatctcaaaaaaaaaaaaaagagaaaacacttaaagcccctacacaacaactgataggtgacatccgggaagactgtgacccccatagtacccagcctatgaggaaccagggactactacaagcaatttaggggataaattgcttgttgtaaccatgctgggggtgcctgagcatcagacacctgatcttgcaagaccatcattaaaagtctcactttcagtgttctcaaggtctctgagtcccttctttgggtttggacaggtgagtttatttctcaggacctggtggcctatatggggaactctgtgcctgcatggagtgggactccagccgagaggggagatgcatcccacctgatttaggtggcctgctctgcccaagtgtcttgtctccctgcagaacccatagacaaacctgagactgttattcaggagatgatgaaagtgacacagggagaaaagctggcaccccagcaactgggcaacctcgtgtttgagccaaggtaggaaaactggactatgtgtactgccttggtggttcagcattttcagaggttgagtgtgtgtgactgagatgtatctaagatacgaagcgagtgcagagtcccaatccgtggttatgtcctcccacaagggaaacagctggagacagatgaagtgattctcagggcatgcaggaaacctccagtgcgggggctgagtacacagggaaaagctcagacacagagactaactgaaaatgtgaaataagaattctaggcctagggaacagaggaaagagggaactgaagagactccctctgaaattcccccagagggaaaagcagaagatgataaaatattgctgttttatctggcccaaagagcccattcatcagcctttgggctcttggcctaagtttggctcagatgaggattgagtgtgccaagctttaattctttatgtgaataataaaaccccatcctcacaagaggagatgggttatgctctttgttggattagtgaattaaccctcatgctcccccttaaagaggaagaaaaagagcgtaataaatagccttctctcaatgaaaagctctgggatcccctaacatgcttgccccatctcaaacatctcacaaagtagaggacagggagatcagagggcagcaggaaggccagagtaagagtaatctgggggtcatgaaggagctaaacccaatgctcctttaaacccttatccaaacttgaggaaagaattagaaaaatgtaagagagacattgagaatttccccgttccttctaaacagcagatgtctaacaggtaccctcttagagaagtccctgtgggacagggagaagttggatttgtgagtgcacttctaaaaagtactgaggttaggaattttaaaaagagaatgaggccactcttggaagatcacctcggtttatcagagcagctagattaattgttaggacccaatttttatacttgggctgagataatgtcaatcatgaatattctgtttactggggaagaggggaatgattagaaggacagccatgaccatttgggagagacagcatccgcccgggcaaggagtcctgccagctgagcagaaattcccaaatgcacatcccggatgggataataatgaccccaggaaatgggttcaaatacaagtccttagggagctaataattagagggattagagtccactcctagggcacagaatgtcccaaaagcatttgagaaccaacaagaaaaagaggagattcctcctgcttctgcagaggctcagggatcaaatgagaaaatattcaggattagatccagaggacccagtagggcaaggcctcttagaggttaattttgtgactaaaagctagcctgatattactaagaagctgcaaaagactgatggatggaatgagaaaacgattgaggaattactgagggaagctcagaaggtttttgtaaggagagaaagtgttaagctgctgaccctgaaggcaggggaaagccagccatgcagctgtgtgtgggagctgactgctgaaagttgttgatgaaagctgctgctgaaatgacacgggggagccagggcacaccacagctcggctcaggcacagagagagaaagaggaagaaaccgagtatgagggagaaaggaaacatgatgacagagagagagacagaagaagaaaatgagtgagagaaagactgaaaaagacagaaattaaagagatacacagaaggtgagactggagagagagagataatgtaaaaggaagagtacaagaggaagaaagagaaagagagagaatggcaataaatgacaggaggcaaagagacaaaagtacaagtaagcagtagctgccacggccctgctcgtagaggagagtagaaagctgaccttcatcagggccctggtagtgagcaccctacgttaggtcaggaatatattaaatcaaagagctggaagatgcttgactggttcccaaattttaaaatatgaagccatattattataaaaagataatttgtcttaacaatagatacttgcttgaattcagccagtttcttatgaaaaggagaggaaaatgaggaggcatcaaaccataactgtttagatatcagagtgtcaaactcaccttagagcaaaccttaaagaaactccactacatgatgggatgagtctgtttgtggatgggtcatcccaagtgatatgcagcatatcatatgttatgatagcataacacaatggctatgctgtcattgatggaaacaaacaatctttatgtgaaaaaggtagattacccaataactagtcagaccaaacctctgaattatrtaggccctaaagctcctagaaggccaagaaggcgctatatatagtgattccaaatattccctatggagtgctacacacctttggaaagatctggacagagcagggcctaataaatagcagggggaaaaaattaatacatggagaactggttaaaaacgttttagaaagcctcctgcttccagcagaggtaaccacagttcatrtaaatggccatcagaaaggaaacactatagatgctgtaggaaacaggtgtggggataaagctgctaagcaagcctccctggaggaagaagttaaactgtttagcctaatcccagatattcctaggatggtattcagaccctaattttctaaaaaggaggaagagctgagcaagatacaggccacccaaactgaggatgggaggtggatgctccttgatggaagagaagtaagcaaacccataatgagagaactgatgtccaaactgcataggagaagttattggggtccccaggccacgtgtgatgcaataccaagaattatgtgtgtatagggatttatacccttgctaaataagtgtgtgggggttgtgcgacctgccagacgataaacaaaaaggtagttagaaaacagactaccagagggagacctcttgggttaaggccatttcaaagcattcaagtagattttacagaaatgcccaaaatagggagactaaagtatctactggtaatggtagaccacctctcaggctgggtggaggccttccccctcccaactgccactgccgggaatgtggtcaaaataattttagaacaaattatacccagatttggcctgatagaaaatattgattcagacgatgggagccactttatcttgagggtgctaagaggaattatggaaggtatacatattagatgggattaccacaccccttgttatctcccctcttctggaaaggtcaagaaaatgaatcaaactctcaaaaagcatactactaaactaatcttagaaactaaaggctgagtatggtggctcacccctgtaatcccagcactttaggaggccaaggcgggtggatcaaactcaggagtttgagaccagcctggccaacatggttgaaaccccatctctactgaaaatacaaaaattagccaggcatggtggcgggcgcctgtaatcccagctactcaggagtcttaggcaggagaatcgcttgaacccgggaggtggacgttgcagtgagccgcccagatcatgccattgcactcgagcctgggcaacaagagcaaaacccattaaaaaaaaaaaaaaaaaaaaaaacacccaaaagcaaaactaaaatgccttggaccaaatgtctcccaatagcactccttaggattaggacaaccccaaggaaagacttggaattttccccttacaagttattatgtgaactcccgtatttaggtaggactactgaccttcctagtgtggaaaccaaagaccaatttttaagaaattatatactggacctatcctccacactgtcattccttaggttgaaaggacttctgactcaaaccccacctcttgagttcatggttcaccactttcagcctggtgactcagtgttaattaagactcaaaaagaagacaagctccacccatgctgggaaggtccctttcaagtgctcctgatcactgagacagccttatgaacagctgggtggggccggggggcgggcggtggacacattacactcgagtcaagakactggtaaaagaatccccagatggaagggaaaaggatgaatgggaagtgtatagatcacctaaggaacccttaaagctaaccctaaggaaaacccagaaggaagctatgggcaggctctgttattgggggtggatgtggttaggattaattctactaccaagagtgagagggttcacaattattggatggagcacaatagaaaaagaatatccaatcaaactaatagtcaacataactagaaccttcacccctcagaccataaaatttgatgtctaccaagtcttacattgtgggaatttagggaaccaaaggcagatgtcacaagcaaacaaatatctatgtcctgaaacaggtcgctattggggaaagccctgtgctggctggaatgaggtctagtggaccacccagttttgaggctgggtgagccattcttccaaaaacaaacccttaaagaataaaatacatttgtataagggccctatgccacctaactgtagaaatttataatgcaatcctatattaattaccataaacaatccagctactctagaccaggaaccttggaggtatggattaggaatagacatctgaggaagggatcccatgggatggttagcttttaggctagtcaccaactccacccaaacccacctaggattactataactaccgatcccactacttcctttaatccaccatacaatgaccctaagagagtagaaataattaaggtaactgacttgaggctgactttacaaatttagactggatatggggatgtaaatacctaggttgaatggtccaaattttcggtactagctcttaatgagagcaactgttatgcatgatctcctgggcggcctgaggcacaggtggttccatttcycctaggatagtatatcaatcgcaaccaaatgcactgcatgttggctctatactaggacagggatgcatggggaaatgagacttgcaaaagtctatcattgctctttcccaccttgcagaaatcagaccctacagcaattccctccttctccataggaaatatgaaccactcctcttgcttctctagggagggggcagagttcaataagctcatgagagaactctcaacttatacccacatcctaaacattactggtgagtcaaacaaaggcaactacttgactcttcatgtaccccaggctgatgtctggtggtattgtggaaagaggaacctccatgagctactaccattcaattggactgggatttgtgccttagttcaattggccattccattcaccctggcattccataagattcctgagaatccacatggccaccaaataattttaagtctaagagaaagttgaccttggtagtacttggaaaagggatgtcaagaatattggaaagttttaaagtctttaattcaatattcactttcttacttttcaaagttgacaatgagcctaatactaaaggcaatttttaggtagttgttctgtactggcaaaggcattaagtaagtgagggtagcctctatacctatagaaaagctttcgtagaaacatagatatcttcctataaatcattcaagcccatatgtgtgcatgcatatgacacatcaaatgccatatatggttgattttctaggtcatgcaattctggtactttgtacagttctttgcaatgttctaaagctttttttaatgcattcacagtgggaagaaaaatgtttttcaaactttttatttattggtttcaatactttactgtataattcagaccattgttatttacaagtggtattgaatctttaataacactatcagtgagaaggcatgtacctgtctgcattttgtaacaaaaaagaaaatatataaatagcttgccattgtttggtaaattctactgttcagttattgggaagctaaataatccatactccatttgaacaagttagaaaagaatatttaatgagctacagagggaagtacttttagagtactaaacattttcacaaatgttgctggagaggcaattgctcaaatataattctcccattaggaggttaagagagataataacagcttaacacagagaaaataacagaagaaataagatgtcaaatatgatcagattcgtctttgccatgtaaattcaaaccataaaattgctatgtaattaattcaaatctcttcttattttatgtttcaatatttaattcttcaagcaaaggtctgccattacctctaggatctggatcacccatagtatttgcatctggaggggagctcattactttaacagggaagaatgcaatttcaggtgtatgcttacttctgccatcctaaaaggtattgatggaaatgatacaaagttaaattttatatatatatattttgaatattgaataataaacttaagttggaataatctggttctcatcctttagagttttttagtttatttcttcattttataatagctaaattttgttccaccataaagaattatccaagtgtagacagacaaaaacacaacggggtcaagtgatctgacttcttgaatcaactcttgcagtaattatgtgacttttgaaaaggatggaatggggcggtagtaagaagttatttcagtagacaacccaggaagcctaatgcctgctttcatggtgattatactgctcttcttttacaagttcctcaggaatagttatgtagagagaactatgacaaagcaaggaatagtaagatattattagctgtggatctacctccaaaacccactgaaaaaaatgtgtttctggtttggaccatttggagaaaactcatttttctcctattctggaattacacggaagtcttgaaccatggcaagttgaatcaaaactcgaatgtgtaattattaccccttccccaatactgatatgtgattccatggattagacttgcctatttttaactctatatatgtagattcatagacaattttcatatctggtttattttgttaaacttttttggtagagtcttcaattttaacattttaacccacttctgaactattcaggttgctggcagaaacagttcttgtggttgtaggactgaagtccctgtttcccttctggctatcagctggaggcttcccttatcttctagagtaagcttgtccaccccacagcccacaggctacatgtggcccaggacagctttgctttgaatgtggcctaacacaaatgtgtaaactttcttaaaacattatgagtttttatttttttttagctcatcagctatcattagtgttagtgtattttatgtgtggcccaagacaattcttcttccaatggaattttaacaactctgtagtattccactcatattcataatatgaaattccatcattattttttcattctaatgatgatagatatttaaactatttctgtaataagaatatgctactctcagcattttttacatgtctcttggtgtgttctatctatgtgcttctgggtattttatttaggaatgcaataggaagatttccaaagagaaaaagtgacccataattctggagtcacatctcctggtttcattctcattctggatcatagccccttaattcttcactgtatttagctgttttygaaccttcaaaaaatattttatacagttcctctcagaagtagttttcatctgttattatcaatagtaaaaatctcacggtacatcctctttaagtgattttaacttataaacatcaagcttgaggttcataaaatagagttatattttgttccaaattttctagttctgaagtaacatttgttctctcccgtgttactgccaaactttcagtatgtcaatactaattaaattagacatcrttgaacataaagtggggttcaatagacatttgatttattattattgtctactattaacattagattcaaacccataacaagtwatcagaggggcaaaaacaatactatactggctgtagctaccaaaatatatacatgaaaaatgaaaatgaaccagtggctttgtttacataagctaaatatttgtatttggggacacacctagataattgactgaagtttcattcttatatgaatctttggcatcatgtatgcaaactcatggaacttctgctccttgttaagaattcttgtacatagttaatgagaaacatagttgaaagacttggctgaagtccatgctaatcacattaccatggataatgaagagagagctgagtatttgtttttaaattttacttcttatgcttcattttgcctgcatcctgttcttattaccaccattwgagtaaataattgaaatttcttcggtcctttttatgtgttgtctatttagtaatgtgtgttagttaagaacctggaccccactgcccaccccaatgtcctttaatttgagctggattgactacttcatacataaaaagtcaggagatttggatatagattgtaagaagaaaatgcctctcacctaagaacaagaggtaatgtgtatctgagtcacctagaaagctttcattaaatatgaattattacatccatccttttcatcaccaccaagggtaaatcagaatttatatcttccccatccccaaacctatcaagacccacaaccttaggaaatattggctcaatattgctgtatgagttgttttttgtttctctatctattgctctatcccttctatctcttcttgcccgtttaatttcatcaggtttgacagcttaacttttcatacccagtttctcttaacttgtctccttcctcccaagaacttgatatcttaaatatttgactgtgcttgctaaaatctaagtcacccgtctaattctcttggcctatgacagtagttctcacacttcagcatacatcagaatcatctggacagattgttaaagcactgatttctggacttcactcctgagtttctgattcagtacgtattagttggggccaaaataytgtattgctaacaagttcccaggtgagactaatgctgctgatttgggaaccacactttgagaacctctggcctatgctgatctcccagactatggactcattttacctaatttcacttctctatgcttcatcctctttatgaatctcctataattgtggctctgattcttatttatgtttatagaccactataatcctgctaagtaaactcctggttatgattccgcttctcctagccctaaggggcaaccagagctctgttaactgatttgatgattggttgcttcatttattcatattaatttcatcattcaacacatattacttaatgcctagtatgtggcagtcgttgactatataagatttaaaaatattatttttaagaagtttacagtttaaaaaaagaaagaccattgagtgaactgacaatgtcaacaaaatcagtgttttatgacagtgttaagcattggcatctacagaaacacagagatgagagctctaaccctgcctggaagatagtactgaaggcttctagaaagagatggtggctaagtttagctcttaggtgccagttggattattcaggtgatgagtaaagacaaggcattagagacgggggagcatatacaaaaagttgtggagagcttaggtatctcagtgtgattgatcaaagaatatagatatgagtctaaaaaaaccatgaggctgaagtatgtgccaaaatacgcagggtggtttaaacyaagcaaatgagttttggaactatgaggagtcattaattttaagcaggtaaataatatgaccctctttacatttttagaattgaaaagtggtaaataaactagtcttaggtgataagcaatgatctaagtgaatgataatgagaataaaccaaagtagtgaaaactgatatgcggagaactagagaggtttttaaaactgtttacaaaatagcacttaaaagacttcatgacacagagaaaagcaccaaggattatctcactgtctttatgacagaaccaactggcacatcaggaggaaagattaaagaggctagttagatgggggaaaaaatgaggattagagaaaatgttctagaaatagaaagaaataaacatgatttcctatgatcaactactgggctccctgtaaacagcttttagtgatgttagaataagccaactgaggtgttattattctcttgtgattttcaaaaagtcggttgaatactaatctgaaacttttacatgtgaacattggacttttgcttactataagcatgttcacatttagttatattcacgtattaggttttccttgctggtataacaaataaccacaaatttagtgcattaaagcaacatacatttatcatctcacagctctataggttaaaaagcctgggctaatttatttgctctgggttttacaaggccaaaattgagagatgggtcagttgatctcctattgggaggctcttgctggaaagaacccacttctgaactattcaggttgttggcagaaacagttcttgtggttgtaggactgaagtccctgtttcctttctggctatcagctgaaggctttccttatcctctagagtaagcttgtccaccccacagcccacaggctgtgtgtggctcagaatggctttgaatgtggcccaacaaaaatgtgtaaactttcttaaaacattacgagttttttgttattttttgttgttgttagctcatcagctatcattagtgttagtgtattttatatgtggcccaagacaattcttcttccagtgtggcccagggaagccaaaaaattgggcacccctgctctagaggttgcaatccttgcatgtgggcccctgcattttacagtcaacaagacattttgaatctgtctcacactttaaatctccctaacatactttactgtgtctcttctgccttcagctccagaaagttctatgtttttaaggcctctggtgattagattgggactaccatgatatttcacaataatctccttattttaaggcctgtaacctgagttacctatgcaaagttatttttgccatgtacagtttaacacatttataggttctagggattacagtgtacacatctttgagtggccatcctgcctaccacagttcctattaaggctttacatctactaagaaaacagaaaccacagtcaagtgtgaatggcctatgccatttactattatcactgcagaatgtctccgctgctgttccaaaatgacataaagaacctccagaaatgtcctacatcaagcaaatgatttaaagatgtgctctttgcctcgtttcttccttatcctcttctggcactccatttgtcaaagttagtgtctttggtatcagtgaaaatgcattcccatccaagccttccaacaataaatctgttgtcaatttgagctatttttaagctaatgaatacacaggattaacatgtatatttgaaggcatgatgttcaacaaagccaaagttaatagtacaatcagtgaagattattctgctaaaatttttgctatctcctctgcacttaaaataaatgaaaaaatattcagctaatgatagtgtggttaatatatactaggaagtctaccaggggcttctaagattgagaaataatgctattaactcagaactcctcggaagatataattgtataaaatcttttatcttggttgttttgctactctgccatgcagcagggatttctgccatatcagatacaaggaaatgtgattctgatgcctaagtgtaaaggaaatagtatagaagttatcaatagaaaattaaattagcattaaattatacaaacrtttttttattcaggaaataatttttaaggtcctatgattaaagatttgcatttggcacagtcatagattttgttgtattgtttttctgaaaatacatatttgagtggaatttggtctgactctttctgtcatcttcagatttacacttcttctccattttgaagtacttatatatttccttcattttgaagtgaagataatgcctgacagctgctgatcttatacttgactttaagtgaagaggagatacctggtctctaaactacatcaactttctgtgctatttgtacagaatggtacaatttagaacctttttctaggtcccagccaaagaagatggtctagatcttctacaaagtgatgtaaggggataccacttatgatgcctagataataatataaaactttagcattatgaaaatcacctgctccttttgcagaccctacaggtatatgcccatggttatcaccaatttttcctttcaaagttccataatgtcactcgtcctcatagatcacactcatgaatttgacctactattgtggtcactgcttataacaccactaccactcccatacagtaacaatctttccctaagaaatctcaagactcctggagaacccttctcaaacacttcaagttgcttttctctaaatatcaccacatacttaatagctagatgtgagcacccttatgtcacataaaacaatctaccttgtttccacgacaaaatacagtgcatgggtaggacattgaatgccaarccgatgacaattttcaagtagggataggcttccttatgaagtgctggctttcaaaaagaccttagtgatcactgaaactcatttacatataccacctgttagcccatggactaaatcagctcattcccttttgtgcactcttgctttcttctataaaaactgaagttaatattgctggcttcatagcattccagtgaataataaatgaagatttatctccaaaataacttccacattgcccaatgtataacagatagctaaacaatgtggttcctgcactcagttctctctttcttgtttttgtcaggcttgtgttctgatttccccagttattcattctttccaagaaatctaagtctgtgtgatacatttcatctgcccacaaatcaagttcagaaaagatagacattctaattctgggttccctgttgatcatcagttactcaagttagtcacaagtcataggcctagaaagttaaatccttctttatttagtgtacctggatttttaaaaagcaaaagtcccygcttcaaatccaaatgcaacatggtaatgtattgtcagartccttcagactaagattatagtttaacatttaagtagataatttcataacgtaggtctgtataagacattttgttgtactattttgtagaaaacctatttaaactcatcacacatatgccttaattagaaaaagctttgtcttcattatgtataaatgtagaagacttcaagaaagatgacactcatctaatgcctccatataacaaaaaaaaaaaaaatagagtcttcttaaaggtaccagaattaactattctatcaaataaaattacattgtcatggcactttgcaatttataaatacttttctattcattatttatttgatcttctcaacatccctataagatagaaaagacatttatcactgatttgcacttgaggacactgaggttaagagaagttatattaattgcccaaggtcatgtaactaggaagtccagaacccagtattcaaacctaagtctgactaaataaagacagagcccaaactccccgctgttatgacaaagagccatccaaatctccttactcaataagcagtgctcttttatctaatctgtgttactaccttgctacctttttttgaggttatgtttaaatataaagaagcgttctttattgctttgatttgcttaagattccatgcataatactttgaactgtgtattctacaatatgtaaactattttattttctatttgtttctttttttttttttttttttgagatggggtctcactctgtcacccaggctggagtgcagtggcaccatctcggctcactgcaacctctgcctcctgggttcaagtgattctcctgcctcaacctcccgagtagctaggattacaggtgtctgcgacacacctggctaattttttgtatttttagtggagatgagttttcaccttgttggccaggctggtctcgaactcctgacctcaagtgatccacccaccttggccacccaaagtgcagggattacaggcgtgagccaccacgcccaccttttcttttatatttattattacatttgtgcacatctcaaattgtggggtgtagggattttatattttttattattattcttttattgacaattggataagttagtgactttactatgaaagtcaatgagtgaggttgcaccaagattccaactgattcagtgattactcttagaatctgtaagaaacatgggacttaaggaaatagtttaacccctgatctctgccaaatatgctaaaacaaaaagatagttaagctgcaagaatttaaagcatacatgtaagaacaattttgttttaaaataattattgagtgatgaatataatactggaattctatatgacaaattaattctgataaaatatacaagaggacccaggctgttaaccacatcaataaaggaagtttctattttttaattatatgttgccatttatagaatcccattttaaattttaaaattaaagtattattaatccctaatttcttgttttaaaactggaactttagctgtcccaaagagcttatattaattttccaaaatcaygcaactagttaatggcaaactgagattagaactaacattttctaactctgattcttaatccagtgcactttccactactccaggctccctcaatatatgaatctccaaattttcataacacaaatgtgtgtctcttgagaaataagaagatattaatttctaaaaggataaaataatctagttttatttgtgtttcactgcttacctcaagttacactacaattctttcattaacctggtttcagaccttgtctaatatttctcgaagagctcatcagctgcaaaactaaaccatgaaagactagatagaaacttggcatctaagaagagaatttttttaaagcctggtattccttctaagatacactaatgtaatagccaagatgatgagataactgtgaaaagccagtagggrtcttgaattgagatgtattctttgaaagcctaactatgctcttatggtgctctcaaaatcagtggtgccttatgaggaatcacagcctgagactggctttgaatgatctcaccaagagtttcaaacagactgatttctttcagtgttcacttgtgtcctgtggtgattaagagattgttgaaaagcaaaggtttttctctttaacaaagggtggattattgtggaaataattttttttgtctttgtgtagtcataccttaaagcatacattgcatgctaagtttcagggctcaaaaagttctaatgatcttccacatttcaattttataccataaaattgaagttgctggcaaaatgcacagcatcactggttttatcagctcccaggcttttatgatgtctatatactgtagatttttatatttgaagatttctcaataaaagataatagtgtgacaatttcattaaataataagcatggctgtaaggcccctgaacaggtaaggctctatttaactgctaattatcatcattataaaccatttgggatgcagctaagtgcggatacactgagatacaacctttttatctaaaagagaggataataaccatgggtaaaacttgttggttcttgtaagtatcaacctgagataaccctcaattagaaatttttatatacaaatgcagccaaaaggggtctaacacataggtcaaataggtaacaaactatttggtgtacattgaagaaggaccccctcccccaccctgacacacaggtcttgtccagaaataatggccttaaagacccctgactgctgcctgaaattctgctaatgcatttattcactcacattttttgattgcctactatgtgtcttacactgaggggatagaaaaatgaataagaaacaattgctgctttctaaaagatagtaagatagataaagaatggaaacaaataataattcacaacaaagaaaataacacgggatatagataaggtaaggagatattaacatttaaatgttggaggagtgagcattgaggaggaagaagaaatagagacagtgaatttgaatcttctcttgaaggctggacagaatttagacacatagctatgtagacatgggagaaggggcattccaggctgagagaattgggtaaattagagttgtttgttattaagaaatataaaataaaatagtttacatattgttcaatacatagttcaaagtattatccatggaatgttaagcaaatcaaagcaataaagaatccttctttatatttaaacatagctacaaaaaaggtaggaaggtagcaacacagwttagataaaagagccctgcttattgagtaaggagatttggatggctctttgtcataacagtggggagctgggctctgatttgtcttcctcacatctaattaaatctctgatttgcatccagagtaacttttccagactatgtaattaattccattattctttggtagattgttatattaatcccctcccccactccaaggaatcrtgcctcctggttatcacacacttttgtagtctgttcctaccctgactgaggacttagacaagtgacttaatttaggcaaagaaacaccagcaaacacgacacaagcagaggcttgatatatactcattcataggaatttgccctctggaatrctgctattaccatgtgagaagcccaagctgggagtaaggaggaggacgtggctgcagccagagtaggaggttgctaaagatttgggagttttaagatacctattaaatattgtctcacgttgactcartgacatcaggccacataattttgtactgttttttcatcacattcaatccttgtttttctttttgagatggagtctcactctgtctcccaggctggagtgtagtggcgtgatctcrgttcactggaacctccccctccagggttccagcaattctcgtccctcagcctcctgagtagctggatttacaggcatatgccaccatgcctggctaattctygtatttttattagagatgggtttcaccatgctagccaggctggcgtcgaactcctgacctcaagtgacctgtttgcctcggcctcccaaagtgctgaaattgcaggcatgagccaccatgcccagcccatcacattcaatcttaatcccctcttctctaaatgtacaccataagttctctcttgttcaggtaagaaaatataggtaactcagtgaaagatagtcattgtgggtagaaaagaatacaaaacaggtgttattagtgatgtcaggttaacaatgccacsttcatgaattgattattggtaattaattcagtcatctatgtgtttattctttcattcacagagtagtcatttatttaaacatttatgaaaagtttcccatgtgctggacactgtaggaacagagaaaggaataagacaggctcttctaaaaagcatagaaataaaagtcgatacactcaggcttgtctgaaacaaatgagaaattcctggatattagtatagaacaacattaaatataatttattcattttaattttctagcatcttctcaatacagtcacacaatacattgcactttacaaagaacatttcacacctcttcttaatcccaagctatattaagaaagctattgtttctgaaatagtggtaatcaattacaaaggtgttgttacggtagagccacatattgttcctaaattttaagaatattgtacagtctgatatgttaatgtttaagaaattaactgatatcttctgataaaatgtatttaatccacagtatctgtgccattacctttaataaaactaaaatgtagcaacttccatagaagttgattggaggcactttaattctgtataaagaacgttgcatactttgaatacaagcgccgaaaatttacgattatagtagtattctacattagacttggtgttttagtgtgcatccaaattattgtgttatttcatgttatttcttaataatgttccaagtgtctttcagagagaatagaaaacaatgtgccaagttagaacaatacatagatttcagtaaaatcagttgcaatcagttcttttaayggtgtgattgcagatgatttaacgttgatatatttatcattgcatttagaatgctttaagatacatatcatgcattggatttcacaacgagtacatcattttccatggctatttgctgtatgatagcagaataggagcactctacaagttttcacctcattaaaacctactgaaaaaaatgaatggatcatcaaatacatacagagtgacaattttataacggagctattgtgtttattagtgttgcatttgtggcatctgaattaatcacggatttaaaatcctatgaaatttttacttgaaaatattctgtccatrtataacaatctatgctggttagtttacaattttgattaataacaaatcattctgcattttctctaaaatttataccttgacattgtgatgtaagagtctaatagtgtttcattttaaagaataaaatatgcatggagtttcatatgaagaaattataacaataaaataaacataggaccatttatctggcatactaattttaacctttattacatccagttatacttgggattgtgattctgctcatgaactggtgtcaagcaacggatggaaaatttttgagtagtgttgatgccttttamattgttgtgcttctcttgctattcagcaatgcccattttgatgtacctgtatattagcatatataaattgaacttagtytaaaaatattaattgcttgttttagggcaaatgctatgttggtacaaaggatctacgttgaaaaatatatctgttctgtcatcattgaacttgaaagcttataagaaagataagcaaatcaataggtaccaaagacatctaaccattcaggaaattctgtcaactctcttgaatgtatgtgcagaattagactgtttctcactatcggcatcactgccatcttgatccaaatcactcttaatcactcacctggactatcatagtaaattcctgattcatctctctgtttctattctggctcctcccaaccctttgtcctaacctcaaaaaagtaacaaaagtcattaaaaaaataaaagtcagattatgttactcctacactcaaaaccttctaatggcttcctaaatcatttgcaatgtaagtcaaaatacaattgtctagaaggccctatgtcatctggtccctgtgaaaactctgacaaattctttctttctggtttactctatcccagccacgacggggcctctattttgttcctgaacactctaagcatgcccaattttaggcctttgcacttgccgctccctcaggttgaaacagttttcccccagcccatatggctgtccttctcatttccttccacactcaaatattatcctattagtgagtccttccctgaccattataggtcaaatagccacccccacccttgcagcttttcctgtttttcttctactgtgttgtatttttctacacatagcttacatctctctgacccatcattcatttatttgttaaaagttcattgtcttctcatactatatgtaaatactgtgagtatagagatttatgtattttgttcactgctacagctatggcttgaaaagctgtctatttttctaacatttattattcctgctttcattgttttcacctgttatgtttatttggtaaatctttcttactttttgaaaaatctttctgtaaaaatctttgtcttttaatatttgtctctaatagaatcacatttgttattataacttattaaatgttactaatttctgatttttatactttctactttattgacctttatgctttatatatttatacttttttgatattttcttttttatatctttcctatatagactaaattttctttgttttttttttccccagtgatttgaacaatatatatcccgttcttggttttagattatggtcatctttatatttttataaattattgttaaatctactttctctacataatatgagtgagatgagagtcctagctttttgccaagctacagctactactggtatgcagacattctggtttgccttccagaaaggaatatgctttagataattgtcatgaggagttttgtggacacaaagaacagaaagaatcatcagtgtgggaaggggaagtcttctaggatgacccagtctgagactgatcccaggctccacctcaaaatttcagttctgagatctttggaggaaggtgctgtacgtgggagtcacatttacccttttcaccagagtatctctggttctcaagcgtccaaatatagcacatgactggggaaacctcttcttgctttggcatgaagcatagcatagcaccaaaattcaaagacgtgaggagtttaaaaagcagagtcaaattttcaagtgaaggattcatagcaaagtcgggtgataataaacttgtatgtcattgtaggcactaccaaaaagggaccttagtgacgggctacactaatgatggagagtaacgagcagagctgaagaaggagctgtggaactagcacagagcaactgaaaagaagtctttgttagcatgcgtgacatagtttggggtgcctagaagttattggagtagattctcccaaaaggtagaggctttacactagtaggtgtgacagtgggaaggtggcttacatagtcaaatccaagaaccaaattataactttgcattcccctgataaaaagcaacaaaattaatatgcttctgtttccccttcctcttctattcattattttccagtgtaattgaaattagatacatgaattttaattgattttttttcttattcttacattaaatatcttstttttcaagaataatttttgcccgtacgatttaattttgtcatatttaccacaatcttttagaaaaatgtttgactggtagtaatgttatctggaattcttttatactatgttttcttcatttctgtctttctattttctacttatttcttccaaaatatatctttgtggaagactccatggtgtgtgtatatttttagcctttgaatatctgattatttcctcccattgtttttagatagacaaaagacttgactagggtgtctccagcttttactctcacctgaactccagaatcctatggctatctatggtcatctccactgaatgtttaaaagatatctctgttaatatgttatataaggtaattgtgtaacatattaacagagatatcttttaaaaattgaaatttcagagaaaagatgaaagagagagaaatgcrtaataatggcattttgattattcagggaaatatacttgttcttaggatatatgtgatgaagtattaggtgttgtagcaactatgaaaatgtactgctcagatctcctgtagacaggagcagaattgactgccgtgttggctatatttcatgtacttccctgttcaagccaaggtacccttcatgctgcttcccgtcagtggctgtgcacagtaggtgtactaatgcaggcccatgtcctcargaagtgggaccccattaacagatgactttggctcaagacttcccattggcctggccaaaacttacttagaaatgtgctgcgttctgaaatttttctccctaatctcttcttctctctgttcttcataggagtctcaagtatctctcagccttcttctgctgccccaaccatttgtttctcacagctcacacaatatatctcttgtaagcccaacttatactggcatctaattcacagagggtctgaactaacagggttacatgctatgatgtccaagtagttaaggagaaaagtgtacgtgtttgtgtgtgtgtgtgtgtgtgtgtgtgtgtgtgtgtgtgtgtgtcagagagagagagagagagatgagagagagaaaagaataaaaggaaggaagtaaatatctcaaaatattaataattgatacatttaggagaatactatgtgtactcattgcattattctgttttagatttgaaagtttttaagtaaaatgtggctgctaaaaaataaaaatctaaaaattacaaaaaaagatacatgaagctcaacatgtgtattgatgagacatctatttccaatttcaatgtctattctcctcagcaacaaatccctgattttatttggggcacattgcatccagcctagaattttatttcaattaaaacatcatctgactcttacattcaagcaatggaaatacaagtaaacatgttatatgggactgtgggaagtcttcctaaaaggtaggaggtctttccttttcaccctctcctatagggcttcctgaactatgtatgtgattgctagagctcaagcagccatctttgaacatgaggcagtgcatcagaaagagcagagcagcaagaaagaaggcatctcagttcctaacgaatgaagtcaccacatcagccatagaagcctgcctctaggactctgaaataaaaaagagaaataaactcttagtttaagaagttgttatttggtgtcttcaatttatttagacagctcattctaatgcttttttttcttttgtgataatttattttagagttctcagtagtaattttaatcttcaaaaacttatttgaggtgatactggatttcaaaagcattgtcaaaagaattttattatagtccaatgtgaattgtctatctttatttgaatattaaatattataaagtagtcaattttacatagcaaagagcgtttctaattgggtaaaaatttacggaaaatggttggcatttacagctcaacctaatcttacactgatattctgtccaaactaacgactcaatttccatcttaacctccaaaacaaaattctccctaacccattcttctagatgttcaagaaaaaaaaaacacataaaaatcatcataaactcccttttatttaagtcagtttctttcttagatgtttataggataccttcggtcattgcaatgttttataattcactatgatatgcttagttgtggctgattgctcctacttagcaggtgggtagtaatcacaaagaggcatttagatgctttctcatagttccttcttgtttctgctgttgctgttttaaagttctgggtttaaattaacaaagaattattttttaaccagtccatctatattagtttcctgtggcttycgtaacaaattatcaaaagttggtggcttaaaacaacaggaagttattctttcactgtcctggagggcagattcaaagttaaggtgtcaggagggtggttctctgtctagaggctctagggaaaattctgttcctttcctcttgtttctggtggttcttggtcatatcactccaatgtctgcctccttctttgcatcaccttctcctctgtgtgtctgtgtcttcttcttttcaatctcttataagaacacttgtcattggatttaggacccatccagataatccaagatgatctcatctcaaaaaacttaattacttaattactataaaaaccttttatccaaataagataatattcacaaagtctgggaattaggaggtggtcttatcttttgaggccaccattcaacttactacactatccatgctacaattaggggtgttttctttgaaagatcagccaatcaccgatttgtgctattgtgtattgagtgcctatcatagtgctactgtgaatttgtgtgtatgtgtgtttgtgatgtgtgtacattgtgtaagtgttttgtttttctttggtgcttcaaaaggaagtttgagggtacccaaaagcctgtgtctacaaactagatattcagcatatatatgaaattatataatccattctttttcaggcaaaagtttccatctagttctctgctctcaggcagaaaatttggataacctacacaggatattatcaaagtagcataacaaatgaaaattgctgacaaaagctaaatatgctttcatttatgcattaaacacacatctctgggatgactatgatgttccaggaatcatgttaagtatagaaatgattaagatacatawatattgtattcacagatttcataatgtattaagagggtgtgatacaacataaatggctatacatcaaagaagaaaataataaggatctgaggagagaatacattcaaatggcatgggtgttaggaagagcgataagagaaaagacaaaataatttaggggagrcatgcactttgattccttagtatatagatatgaaatgaatgagtaaatagatttggatgcattttttatgcatttgcaactacaagagaggtagaaatctgcgtagtaaaagccaaaaattaactagaagaagttctcctatatttggaggagtaaaactgcaaataaatcatttgctatgtttaaattaatatattttaaaactgctgtttgaaatttaacattttagaattcacataattcattctatgcacctatttgttcaaagaaaaggaagaaaagaacaatgtaggactctagaaagactgccagaggaaggtactgggatttgctcccatgcagtgtcttccttgaatttcactttgcctttgaggatgagaacagggcttgagaaatacttcaaagtgcttctctggccagctatgttttgccaagctctcacagctttctcaaagctttcaaaattattaaataccaacatacatctcctacacttttactttatcaggagagaacactgcaagcagcatcacagccttcagaattctttatcatgtcattaagcagctgcattcaaactgcaatgcttccactcaagccataacaaggcaacgttgacattaagatgcaatgttccgcagatgccagttttagcaatagctataataagtgtcagagaacattatcacatggtaactctttaaagttgggaatgtgacttttatcaatctttgaaactaactgatttcaaatttacatgccaccttagatagaaaagaatggctgcttcttatctatattgtcaggaattttaattagttttgttctttttcttatcttaacccatttatgctagaggttgcaattttttgaatttttgcatgagtgaaaaatcagaccttggcgatgaacttcagcagcatgatataaataactcccacatgcttagcrttccaataatggaacactaggaataagtgggtttaaaaatatcttttctctatccatagtcagcatcagttacttatctgcttttaggtggaagagcaattactggaattgtcttgagtctctatgaagtttaaaggctcttcctgatatttgacaagccccagaacactgccagcatgaataacgtttactgaatgtccagtgtgtaaaaatcaaaatcaaaaccttactgacttctaattgcgaagatttaaagaactgaaaggatgattcatgttttaaaggtgtttacagccaagtgggcgttcagaagtacacataagtgatgaatgattacatttgtatagtgctttgcaaattactaaaaggtcttacagacttattccttaatctttacaataatctggcaaggtagctcttagagataagagaaattgaggtaacatatttagatataagcaatttgaggtaattttttaaaaaagaaaagctatttattggtagagctgtggtaaagtctaaatcttttttctctaaattcactgttctttctacactataatatgaattaaatgctgtaagaacttaaaccagaaagaaaaatgattgcaaaatgagaaaatggtagatacttcacaaggatgagtggcttagcttgattgctaaggataagaggactgacatcacccgaatatctggcaggggtaaagacataagccattctgtgtcattgaggaaggggatgtgctgggccttctcaggcccactgtgtagcataccaccctcagcactcttaacatggaatggcctcctggtcaccaaactcccaggttttcaactttctgaatgcatttttccaagttggttaaaatttgaaaaaccaagagtcacatgcaacttagggaggaaagaagagccctggattgcttttattattattattattattattattattattattattttwgattttttcagcacaattacttctttttagaaacctactcctcataataaagggcattttaaattgaggagataaatatatactcactcacagcctttagagccataatgtgctaataccttctacaagagttaatgtcttcaggagatttctacctaaggttatgtattcttgttctcactatttaagagtgttcacacatcccctttaccggaaataaagtgaaggtatatgtgtattttttatcactctgtgaggaatatctcatttgatttttttatttatatcctattagaaagcaaccaattaattctccaatgcaggtatttcatttccattatttatttctttactgaaaaaacactatatgtcaggtttatgctagaggattttttccacaagtattatttaatttcatctttattaaaaatctcacattgctaaagaagagaaatgtgaagctcagtcaattaatttcttcccccagatcactcagtgaactaaatggcagagctgatatttgaacccaagtctccacttcacagtcccttactcattccacattccacaagagctctctaaccaaacttcaagtgcctgagtttagggccacttcaactcatcatctgctggagaccagccactgaaattaatgtttgcatttgttttcttgactatacagggtatgtgggtaatctttataagattcttgtttccattaccatggagttaaatagaacagctatacataaatcaagacaaaaaaaaacccactaaattctttaggaacaaaatgttcttcagcagggataaagcacagaatacaaagtatccacaatgtgctggatagctcgtagacatctttagaatactaatcatgtgtcacttccatgatgcatacaaagtctcagcagctattggtaaacttggataaaatcactgggtaactttcggctttgtctcagttggtggattcatgagtaacctgatcacataaagacatcatcatgaaatatgcatagggttgaactgtttagtcacacatcacattttctattaacacattctcattagattttctaaacactctcagggtaattcatcctttcacgcttcagcttatctcctccttcagatgccaaaggtcgcttccaccaccacttcccctcccagccctcccacaggtacacacctcacctctccccttcatgtggccctctttcttttgtctctccatgttccagacttttccttaatcatcatttttttgtgccctttgttgcacatactttctgtagcttatagactgcgctcttctaacactcattctccttacttccactaaaaacaatattcaaagcagatgttcccaaattaattcaacaaattagaaatctaggccatactttctaatttaacttgatttaaatcattctgtatgaccctgtcaaagcatatgtggaggaaagtaaatgaatttagaaaccagaacaatgtggattctaatcataattctgacactttatcaaatgtgtgaccttatacctcagttgtaaagatgaagtattaatattaccatataaggttactgtggagactaaatgagatgaggcattcaaaatatctcgctgtgttaccataccgcagttgcttaacctttctttgattacatttcttcatatggtttaactgtttagtcacacatcayatattctccttacacattctcataagattttctaagcactatcagagttattcatcctttcatgcttcagcttatctcctccttcttcatatgtaaaattgcataataattatatatctcattgggttgtgtgaatattaaactggttaacatatgttgcttacaactatgccccgcacagagtaatacttatcattataattacttaatacctaacatcatgtctaccattgaaaggagagctcctgtagttctacaaatgagatattagaaaacaaagtcttagattattgatttgtcaagtggagataagtgcacactatcgaattgagtaatacctaaaaagcataatggacacattagaatagataagaaaatagaattgttaggacatggtgacattttatgaaggagctgagaaagagggaggaatcaagaacagcccccagtttttatctgggtaactaaattcatggtgatgtccttcactaagagaaaagaaacaagctttggttgaaaagaaggagggctcaaaggcattatgtggtatgatataaagcctaaaagattccaytggatttaaccacacaatagtttacgttgaaaaggtttattggagtagtaaagacaaaatgagactgtagtggattgaagaggggatggtcagtgaagatgtagaagcagaaaaccctttaagaatattgattataaagaagagagaaatagaggctggacacagaggcttgcacctgttatcccagcactttgggaggccaaggtgggtggaccacttgaggtcaggagtttgagaccagcctggccagcatgatgaaaccccatctctaataaaaatataaaaattaaccaggcatggtggcaggcacctgaaattcccacttcttgagaggctgaggcaagagaatcccttgaacccaggaggcggaggctgcaatgagttgagagatcttgccactgcactccagcctgggtgacagagtgagtccatctcaaaaaaaaaaaaaaaaagagagagacatagtatgtttctcagaaggttgctttgaagagtcaagatgtaatatcagtaactatattgattattcacaaccataatgtttcttgagctgctataatttgctcagattgtaggggacaaatgatacaaagtggcttaagaatagttttaatccacctggagaaatatgagatctgtgcaaagagaaaaaaagtagtaagaagagagaacatatactaagtaccaaatgtatggaactgaaaatagttataaccatttagtctcaattggtgcaggctagaatatttgggtaaagattcaaacagcaggcaagacaagcttgttttaaaataaggacgaggaamatgttggtcaggaagggcataaggcagaagtcattggtgtgagtagagcttcaggcagaagggcctggcttaggcatggcagtcaatgattagagggataaagtgaagagtgtttattcagctcatttcctcatctttactggaaaggtgagtttattggaaagctgtgtcctgcacaatatccagcaatgtagtaaaagccaaataaatatttcataaatatttattgagtaaatgttgaatatatagaaaacctgtagataagaattttcctggagtaacactaaaagggaaaaattaaggttttaagtctcagcaagtttattttgagtcacaaattggatatttatacaaaatatgaaataacaatttggtctgataactaacgaattcaattctagggaaagttactgctaaatataaccaccacataaaattctcccattcttctcattctttcttgccctttactcctccagtgtcaggaatacattttaattcagtatgagtttgttggttaccaataactcccctggcatggttcttgcttcggtggagcttctaaccttactggaaacaaatactatgaaagccgggatgagaagaaataatcgagcagcgtcctgaaatatggggatatttatttagagaaaaagttgtaagtaaattcaaacttggaggagacaccatgaacaaagggagggagagaagcaagaaggagctagagggtattctggggacagtcacacagcattgacgaagggttagagctaaaatagccctaaaccatcgtggttgataacttccattcctgtgactaatacttctagctcacagggatagactgtctggtgtcttgaaaaaaataaacagcttctcagcaactgaagagacgctgaaaggttcagtgaatttaaaaaaaatagttatgttcatttcttgtgaattttcaaagtgtccttgatggaaggcatatgggactaagtacatttttaacctgcccttttgcagagacatgggcatttagtttccctgtgttcgctaaggggagatggagataccatagtaaaagctatagtttcagattagtccagtaggtaaaagcagtttcctttcctgagttaccaacaaatccccactttgcaaggagctgcaaacaaattcccctgaagtcatacttttaaaaacactcatttgtggctccttctgagaggttaaaagaaaacactccttagaggtcaagctctgcaggagcaaagcctctgctcgtcagagatagagctgctttgcctgctctgttggggttgcccaagtctgaggcttctcttcttaatacagaaaaccttgttcgttgataaagcccagctctcctcacagctgttatttttaagctcagccctcgtctgcttgacacatgtacacctacgccagggtcttctaacaggaaacttggcacacaaaatgtcaatggcatctctttttttctatcttactcgtctttcgtatagttcttcctttattctctcctctccctggccttgttttgtttccctcacctccccattagtgtctaggatttaattttaacatgcagagatggacagtattaacagaccttttatgtctggatgttgaataggtgctcagaaggtccctggcacattgccagakagttattcttggatctggtttcttaaatgtaagtgagaagaatccggtgacacttctgtgcaaatagatgccctgtagttagtgcctttagcatctgtatctccacatttcacataggctgtagacatgcttagatcctcagttcagggaaaaaagrgtaagtaatataggaaaaagaatagttgttagtcaaatgattcattaggtggccttgggaggaaaaacagctcttcctttatagaataagggatcatttaatgatcttttcctttcaattctaaaatattgcttgctatatctccttttttctgtctgctacatttctgctatgtagattttcatattgttttcctgcctgtcctttgttctggaagacttgtgtttgctcatcacatgtaaatgtccagtgcatttcagggctttatgtacagagtagggattgcatagagactttataatttttagtatattcaaaactgaatattcagaaaggtggctaggaagcagtatttatgtaatagttaaagagcaaaagttggaaacttttttttttttttggcttgatgactttattttagtaatcagactagctaattattaccttttcatacttaaatgtaacatatcttttgccatcttctttattctctaaggttttgactatatgctttatgggaaaaaaatctcccacattgttcacctgtgaccaccaaatccaagtttcacaaccaattgttggaagtcaaaaacctctgttcatccacggtaccaatgcactagagaaatgttagtccttatgaagaaaaattgccaattttgttccaatatccttcctccctttctcaattttaaatttaaaaaaacaaattatatataatgaatacatagctgtcatctcctgtgttgttaccttgatcgtcacttcagcattcaaaaatgttacattttgcagtttgcatacctaagattcttcataagattataccatgttaagatgaataagaaatgactgtaaccatacatagaaatgaaaattatacttgcttgttcattctagagcacttgctcatagaaacctcagaatcaatagcatgcatgtatgtggttagatttatttagtcattatcactcttccacttgctttttatggtgctgagcaaatagtaagtgaagagtatgaggttttttttttttcacgttaccctcaataaatgggtttaaccacaatacaaatcttataatccacctcttcaatcccactggcagtgggacaaatccactagctttagaggtaagccttcaaatatacttctactgacaggttgaagtttgttttaggaaaaatcaargttctacaatcctttgcatttattggagttttcagtttccatggtttccaagagttcactgaaattaggctttccatgtttagaagtcatgataggggctttggtaaattccttttctctaacctagattatgtttaagatctgtgtattgctattcctggatgagtattgggagctattgaatggtcaacacagctcttcacctgcatacctcctctacagaaccaagggtatatacgaggaatttcaaggcaatctatatgaagtcaaactagggttgttttctgggatcataaaataataacatyacaatttgtatttgtagtgaagarctgccttcaaagggattaatggggaagtctacatttgaggttctctggcctttggtaaggaggggagtgccctgataaaataacgtctaaaaaacagacttccataggcttcatttatcttgaagaaaattcttctggacatggtaggagtctgaagtagtttatgttaggccccaaggtacacggaggtgtcaagaatgtaggatgaagtggcctgaagcaggggctcatgcctgtaatcccagtgctctgagaggccaaggagagaggattgcatgagggcaggagttcaagaccagcctgggtaacgtattgagatctcatttctgcaaaatgttcaaaaattagccaaacatggtggtgtgtgcctgtagtccttgctactcaggaggctgaggtgggaggattgcttgagcccaggagttcgaggttacagtgagctatgatcacaccactgcactccagcactccagcctgggcaacagagtgagaccctgtctctgtaaaaacagaatgtcgggtgaggctttatttggccatgaacttaaagtatgcgatatctcatgttactgtacaattgttattatgtttctatctgcagcccaaattgtgaaacagcctcaggtagttcctgacagtccagttaccacataatatacatgaataaggagctaatctccctgagcccaaacgtactgtctctgttatcctggggctcaaaaccaggacctccagcagttatcctcaagaagataatgactttatgatcaacaattgttacctagctatgtaagaagcagagattagataagtaggtaggtagatagatagaatcaaataagaaaaagaccaaaataggaagcatatgagactatatttgcaactacaaggaactgatctagatgacttggaagagttttttaggaaagggtacaaagatccaaagtaagtggatgtgaattgcacctcaagggtctaatcagctccttgaaacaaattggaatcagttcagtgtatgggagtcttatgttcaggtatcccattgagtttggcagtggcagctgccaaaagttcatgaggggttttcaaggaagactcaagagaagagaaaaatgtagttgcctatgctgaaggtcaccaaggtaagactccccagaaaggtctgtggcaggaagagagttctgagccatcacatagctctaagggcaaaatatggcagccagcagatcggaagaccaggactccttagcatcaggtttgaatgattgcctgtcaggcagatgtgtttgtaaactaatgactttcacagtgtgatgagattgaaaatgaagcctaattgcttccactgatttaacccttggaatgcttccaggcatgctcacagccatgtgwctttaatcatgtgagttaatcaccttcagggatacatcagaaaacagtggcttataggaagcctgggaagcattgcagttgtgttattaagcctgcacttctgggggctgtcatctcttcaaataaggacrctgagaggttggccgtggtgcccttacactagtttttgttagtaacaactgacataggcaattacagaaaaaatgaattaatatttatgaatttttaagtgactttaaagaactcctaatggtagtggagtgaaagtagcaagtcaccttgatccttctaaggccaccatgaacttcagtccagctctggaagaaaatcagaattggaaagtggtctaataatcaggccagtctgattaatagtgacaattagtattggactacagtgcataamcaactgattatgaatcattcgagcactttaggtaaattttcaatacaggcaattaaaatgaaaagactcatgatccttacataatgacttcattaaattaattcaattctgaggttggggaaaattttcttttgtagaaaggaaccagcagaatttaacttccattcacttttggttaaaagaaatctggagaaaacataagatttaaacacaacacacacacatatgcacacaccactttgcaaacagcttattcatgtctgaatgtgaaccgtgttactgaggaagaaagaactgaaggtcagagcatggattctattcacatcgcttattcagatgaagtaaatcttgcccgcagttatattttgtattccactaagtgcatgcattgttaaggttaaaagaacattattgtggagtaatctgtgaaagacagacacttcaaagagataaatactcacttctgttacataaacaattaactcaagtcatttgcttcatggtaaaagacaaagctagagccaaatccaaatactgtggtatcagtgcagtcaggggaacaaagattcctttaagtgaaacaccgtcattcaatcaaagcagaaatagttttggagaaatagacaataagagtggaaggagaagagactctctaggactaagagtgacttgaaatattccacagtaaagtctgtctctattgtgagttttgagtcaraaagtcactttgcttccaagattcattacttaatacctaatgtatacagctttattgtttacaaaagtgcatttgcacttaagttgtacagacatgctgtaagctaggtattatgtgtattaataatagctaatacttatttagcagttcagaatttgccaaattccatctatctytttttcattttcttcattcctcttacaatttttgaagatgagaaaaagagtctcaaaaagttaaagtattataatttggccaaaatcacaggactagtaacagcaaaaactaggtattaagcagtcttctgactataggtcctctttctatgtagtacctcctgttcctcatatttcttaagactatttttttctacttggttaatgatcttttttataataaattcttacattcactatattattttctaggtatctcagaatgaaaaccactttaaattttagattatgtaccttgatctttctttcagtttgcatttcattcccaatcagaccacactgtctttctgaaggcatacactgcaatttctagcacagaacttagccttcgcagcagagatagtaaactaagtcagtaattggttgagctagaacctcagcccaagtcctaacatctggggcaaggagctgaggagactaaggagcaagagatgaaaagagatacattacagtaaaatgtagagatttgttcagatctccagattagtaaatgcgcttctagcatatcatatctcctataaagcagcgtgatcaaaaggagcaataaagccttctgagctgctgacactgcaaggttggctgggcacgctcttgaactaagtaacttgcttctgaacttaagcctcacttgacgcaacaaaattgcaagttagcaaacagcatggagtatagaaatcacacttatttagatgaaatcaaaatgttaaatgcagaaatgctaaaaattactctaagcataaaggactagttgacttttatctacttaaattcctttaatggtctttaccaaacttgctgttatctaaaaagcattcctcagtgactcttcacccttgaagatgcttctggagagtttaagatgcaagtctgtgtatgtgtgtgtgtgtgtgtgcacacatgcatatgcacagcttatgtgtacatgtttgtatattatagtataagtatagtataagttaaccattttccttgacctcaaaggtaagggctaaggcgctagctcaactgcaggtttgcttatctgtcaaatcaaatcaaattttgctgatttgccagattcaaatcagaaggatctgactcatggggctgtttccacgaatgttacaatgctcatgaatatgctctgcaatatcatatataacagaagactgcctttctctcaagattttatagaagagcaaatggatgtaaataaacctcttgggtggtcttttgaaggaaaagaagtctgagaattcccrtcacccttctatttctctcttctgatcctgatgattgtctccctggtgttgacactcttcatgtgcctggcttacttcccaggtcaaattgcactttccttgtttgcagtgattatgcttccttaacctacatttctttaaagagcctatgacatagcatccaatctcttgaagggaggaaagttagwctttgcctgctttaccttggtggaacagaggtatattgggtttatttctaattagcttattgatttcagtctcattaccttacagtaacatattgaaaacaggtattttgggcactagctggtaggcctgacttcacctaaacaagatttctggaatttctttccagacatctaattatagcagtcctgcatcgtcctttgggtatggttggtgtgagagtcagcttctcctaaaacaggaaagttttggagactgaatcctggctctacctcttcccagctatgatacaggacactgatttcacctctttagcctcaattatccatctgtaaaataggtatgctaataccatctccatagtggctccatgaggaatggaaaaatgttgaaaacaccagtgcctgctcacaggagaccctcactcaattttactcccttctctctgcactgccaccatctctgtcactgctcccacattcccacaatctttacactgctcctcacttgtagttcacgacatctctcagtaataaactcttgaactcacctttaataataattgtaccacttctgttgtcctagctagcttcagctccaagctcttctccttccctggtatcctcaaacctgacattgctgacccttcacacaacctccctgattttaaaggctttgactctgggtgtgatgcccactgaagctgtcactgtgactgattagcacaggttctgccagcttcaaccctgcctgccccycttcatgaacttcactccatataggaagcacggcttacttcaaaatggaaaaaatgtgtgaaagaatcttagagatggtattacaatttagttttcattattactgagtggttagagaaggagtggacaaatccaagactatcttgaagtgaatagaaactttcactttattctagcacttgctaagttgctctcaktctgcaaagtcactttcacagcatccttttgacatttagacccattattgctatgaactctcattgtcctgtgttcctaaactgtcactgcatcctttgttttgtttgacttgttactgttttttataagagttcattttgaatgtgacctcaatgtgataaatgttatagttgtttatcaggtgggtctaatcttgccaagcataactctgactcaagttccacagactcccaactaagccactagtttattcacaaaagttgccaggttttctggttatatggctctttctcactgtgtatattattgctctktagttagaagacaaagctagagttttggaggttatctttgtttttgttgttgttgttgtcttttagtctctaatatttaaactgctcccagataggctcccagatataaactgctctcagatattttgatggatccactctactgctttcttttttctactctaccttcgcactttagtcatttggtaattgcattctaaaattatttgraaataaccagtctgtgatttcagagcattaaaatatatgcataaaaacctgtactagtgccttctacatcctgcatcaagtccagaattgttctctaatttcaaattccctagcaattcaacaccactttcacccaaatattccctcattattttttagcatgcactctctgatttagtaagtacatttttagtataattcctattgcatactacacacactcccaactcttgccctttgccaagatctttccccaatctagaattcatttcccctttgtctcttccagcctcatctcctttacactaccgtataaattcagtctttgcctgtcttgttcaccactatatcccagtataaagaaattttcctggtacatgataaagtctcagcacatatttatacacttactaactgactgttcttcaaagcccacttcaaagctaatccctttcttaacccactctatctagtagtacagcgtgtagatgcaattttcttattgcatttgaacttccagagagctcctggtgctgtaragttctctgacaggacagtctgattctcatcatgtgtattaattagtaatttgtggttaaagacatcatcttggaggtccctgttttgtttgacatcctggaatacttctacactgcgctactgcaagaaaaatgattttaacatattttagattttctgtaatttaaaagaagattatttatactccaaagataaaatcagtagcaattacaagagaagttcaaaagtaacttttttataaatgtcaagtcaaggcgggaaagcaattatataaagtgattcaatatcatattggactcactcaagattaagaaatagtggcatttttcttgttttgaccatgaagcaaaatagttaagggtaaaggaacattatgtaatttattataaaataaatataatatagcccatatgcactaaaaaaatccagtggcaatctcctaatactgaaatgactcatttacaagccaaatgtaaaatgggcatcaaagacatatggtaagaagcattcaaagacaatcttggactatcatatgcatgtctgtaaaatagtccacaattaaatttactaattmtggggaagagtaagctctctttggactatctcagctttgatttacttcttaaaaaggacactcttttttctgcccttattgaggtataattaacaaataaaagttatacgtatgaggcacaaggtgatgtgacatatgtatacattgtgaaatgattaccataatcaggctaattaacatatctatccacctcatatgrctacctttttgtgtgtgttgtgagaacatttaagatctactctgacactcttcttaatctaacttgaattcttggttgaagggggactttggtgacctttatgctattctcctcaaaaccttaaaaagtggtttagttggcatcatttcacagatctcaaaacactcctttgtgctgagattgtatctagaatgtattgatcatggcattttccatagagaatccttttgctacattcatttcaggccttttcttgaactgtccttgtgcctagggttccagcaagctggttctcttgctctgactctaatacgcccatgatgcttttcactctttccttgtarccacaattgtgttagcaaatgagcctcaaggagctgaaaaactgatcttcagctgatgggtctttttgacaagtttagagggtttgtctaaagtaggaattctttatacattcaacattagataaagtataaacatgatyacattttataaatagctgttttgaatcagcaaaactaaaaaattttgatttagccctttggggcccatttattctctagggcaaacaaatgatgtctatggtcctcttctttgaggggccaattagattaggacatagcaaagcttactcaatgtctactttttttttttttttttttacagtcacaatattcttctctatgaggatgggcatgctgtggtggcagattttggaggtgagataccccmaaatggcatcctttttttctttgttcctagctggtacaatatggtgcctgatattgtaccatgaaactgaacactgaacactgacagctatactacactgaacactgacagctatcctaccataaatcattcaaatttcaatgaccctacattttgaaactctgtcatttatttctagtttttcttctttcttatctccagccaagagaagggaagtgagaatttgaataagacagaagtctcttgaggtttcaaaattttaactgtgatcttttaccttggttttaagatatttcmtttgacgtgatttattttctctttccctcagaatcaagatttctacagtctctggatgaagacaacatgacaaaacaacctggggtttgctgctgcttgtgtttcctataattataarccaattaaaatatgtaaactcagcatgagaggaygtaagatgaragcagttttaattggaagaaatgtcattgtctcagtgttgggataatggcttatgtctttatttttagtaagctgtcaaaataactatctcaaggctctactagagaaatagataakatatatatttggaaaacagtatggataaaataatacagaatatgtttcaaatataactgaaaagaacgttgtggrcatggatcttttcatatttagatcacctaactacttatagtaaagtaaacatttaatagggaactcacaataaaattagtagttcatcagcatctattaactattcatcrttctccactttaacattgtaatgtaataagtggtatatccaagtattaatgtttaagtaaaatataaattataataactgaagcaaggataattgtactcaaaatgtctgcaattaaattcattacctgccctctccttcactctccccaatccctccccctgaaaaaaagtagacttctctttctggactacttgtgataactaattacctaaggctggagtaatttttcattctttccctttcctgcttctacttacactcagtcaccttttctggatgtctctttcttttctttaagttcatcttaacctcttaaacctctcacttcctgctgcttcagttcagattctcgtcacttcttttctggactagtgtcataataggcttctaactccagtcctctcttcttgttcattttttgcatcatcaactaagttctcattcctatggagctaatattctactggaaggggataaatactggacaaattaacaaaatatatctcaggcagtgatgagtgttatgaagaaaaataaaagcagagtaaatgaatggagagtgatgaggttgacatttagataggatgaaggaaaacgttaacatttaataagaggcctgacatgggagtaatctacatggggggagagctatgcaggtgggggcaatagtargtgcagaggtcctggggcaggagagttcttggtgtgttcaaactaacatggctggagtgaggtgagcaaggaggaaagtggcagtttatgaggtaagggaggtgggaacaataagtgatcttttggcaggacacaaagctcatcccagacatgggacatagaggcaactaaattagtggtcctcaagcctagctgcacattaaaataagtttagaaactttttttaagcatagtgcccgaatctgatccccagaaattatgattttattggcctaagactgatcttgagttcctgcatcttttaaaaattcccccacataattctaaaaagcarttagttgagactctccaactaaataagcttttgttgaatgtaattaaattgaatttaaccaacagcaaataatattaactctcttattctagccgcatagtctttaagcacagcactaataaataaataaattagtgctaataaataaattagtgctgtgcttaaagactatgctgctagaataagagagttaatttgaaatttattttgaaagctgttttgtttctcattagttatgtggctttatgtatgttatctaatcagtctatgacccctctgtgcaaaaacgggcatactgtgtacctgctcccacatatacaatgttgtgacacaatgcataatctgctataaaaatgtagactctttggaatgtggaagctcatgcagaagaattgcatatgagcaccataataagaataaagatattattgraaagctgtaactatgcatggtttcaaaataaggtggacatttcaaaagaattagcaaccaacactacacacaagattttggtaagagtgataaaagaataatggtttccttcaatggacatttaaaagtgtgtagcaaagtttattaataaaataaagtgcaatgaggatttagaactgggagggtgtggctcctctgttttgtccttgaggaatctgaggtccaggaaacatgacatactgaacagctacccagagctgttcagtaagtggtagagccagaactagaattttcatctcctaactctaaatccagtgttctgcgccctaaactagaaatcaaccaaatttatgcatttgcatcccagaatggaaactaatttttttaactgaaaaatgtgaaattacaaatgaaaagaatgtaaataatgtcatcgaaacagaggctagaactttgtayggagggacttgtaatattttatgggcttcctttctggaatattgcacaaacagcattcataaatagcacatctgggcagagaaagtaagacagacctgatccagccagtgataaatctacttcataggaatattctaggaactcctcgggagccatttctctcctcagccatgagcacactatttatgggcctaatttagtaacttcctaaattacaacctgaagacttgaaggaggtgcctcccacagtgtgtgattcactcccagggagacatagggtccctggatgaatccatggttggctattctgaaccttgtaaggcttctaagggaggaagatgtttatagatttaaaaaaataatgctgcttctcattgtataagaggcagacttacttgatgattaattacttgtgtgatgttttaggaagaattatgaactttatgatcttccaatgattaaaaaatgccctttgaggaactgaacagccacagtaaacacacygtgtatgtataaacatgtttattgcacacactgagggcaatatgtatggatgttaatttatatttatgccttttgagagcatcgggagaacacagtaaattctcactargaagaatgctactctgcagtggaagaaccaaacacttggtaaatggcttgtggatgtttcttgatgtgcagaacctccgttggatggctcctgaggtgttcaygcagtgcactcggtacaccatcaaagcagatgtcttcagctatgctctgtgtctgtgggaaattctcactggcgaaattccattcgctcatctcaagccaggtaagacacactgcaattgaagttttcctgttttacagrgttcactggatttttataacttcaagaaaattttttttcacaaaatgattagtctcagtgagatggcaaaagaggaggtaagcaaacaatcttaaattgttttaaggtgtgtgcccaacccagaaaatttaatgacttacctgtgatttcagaccgagacacacagaaatgcaggtatattttattaaagtttgggacttgatttattgattgttaataaaacaagcaaataactatgatcatgtggcatgtgagagcaaataaggtggacaatgtgatatttattttttgaggtgagattttagaattgcccttttaacatgtatatagggataagaaagtagtaacacagaaataacctgttaaggctgctctctgcttatctcacatcataaaaaagaagatgggttttcctaacgtttttgtattatatgcatatatatatatatggatacattctaaaaatggggcatgcagtgagtctggctttcattgatgatacacattatgctttgctcatgtgtagaaagtgaaggtgaggaatctaatcacaggtaaaatatacacatattttaggtttaaagtaaacttcatttgcatctatctctcaattgcatttggattgctttcatatcttgtcacactagacaaatctccttaaggactttgcatccctaaaacttagcacacttgtaaagtagttgtcaaatgtaatcataagtaattttaaataattatattgtaatctcctaatggccaccctacaacaatatataagaaggataaagtcaaaagagatgttacttaaacatcccttttaacaagttaaaagtcttgaccaagatcaaaatatttatgagtactcatgtacagagaggtagccacatctcatctcatactctattttggagttttttttccccaacctaccatatggtcttttaattacaccctgcatagcagagtgcttttcacaggttatgtgctctgtgcatagtttgttaagcgtaatgatgatgtaattgtcctaatttttctctacatattttctatagttttaaattagacttagcccttattatagtgtggatgtgtggactctattttgagctgtaccaacattgccatttgtaaggtcttgttctgatctctttccttctctccacttcttagagtgtgcatcctgataagattgatggatatacagaaaattgattataattttagatgtactatggtgttttttcgtaagaaagaaatacaactccttttgcttcatcccctgtgtcaatccattaacctggccctgtttattttaccttctaatacatgggtttctctaccacttaccatcatccaccaccatcgtagcccaagccatctttcctttaaaccactgcaatagtctttttaaaaatagggtttatttaggcataatatacctgcagtaaaatttacctttctaggttaacacttcaatgagttttaataaatatatacagctgtataaccacaatggcaatcaagatgtataacatttccatcactccaaaaagttcccagtgcctgtctgggatcaatccacttctcacacctccagcccttggcaaccaatgacctcatttctgtccggataagcttacttatataccaatgycatataaatggaatcatgttgcttcatttatcagtaatttattctttttcactactttgtaatatttcatattatagatgtgccatgatttatttatgcatacagaagttcatgaccatttgagttcttctcattttagggctattaagaataaatctgctcaaataattgaggcttttgtgtggttgtttttgtttccattgaataaatgagtaacagatggattgctacatgttataataagagtttttccaaggtgtctgtaccattatgaatttccaacagtagtcggtgagaatttcagttgtttcacrtccttgccagcactttgagttgtttatttttaaatatatatgtatatattaggcatttgagtgggggtacatggaacatcattgtgatatttacatttcactgatgactagaaatattgacactttatgtgcttgtttgatatccatatttcttctgtgaaatgtttgtttaaatagtctcatcatttagttgtaagagttcttagattatagggattatagggagaagtactttatctgctacatgttttgcaaggattttcctgtaatctgtggcttgcctttttgtattctcagcaatgtctttcaaagagcagatgtttttaatgtcaatgaaatccatcttatgaaaattttaaatcaatttgtatcctatctaaaaatatttttgccttactcaaagccataaaaacttccccctattttttttatagaagtcttacaggtttaggttttatatttataagatctattttgagttcttatttttttaaagtacccagtttgggttgaatttggtattctttggtttattcctttgttttttttaatacagatgtccaattcttttctcataatttttcaaaactactatcctttcttattaaattattttggtacatttttcaaaaatcagttgaccatatatgtatgcacttatttccaactctattctgtttcactgatcatgtgtctacccttaaatcaataccacactatcttactatattatagtgagtcgtgaaattaagtaatgtgaatcctccaactttgttcttctttgttaaaaaggctctggccatctagattttttttgcttttccatataaattttagaatcagcttgtctatattcctataaaaagcttgttggaatttgattcgattgtattgaattattagatcaatttgggaagaatgaacatcttaaccgtgttagtcttctgctcaataaacatggtttatctctatcttcacttaggtcttcttaaatttcatacattacataatttgttatatattttagcatacaaaccttgcatatttttattatacttatctctatctattttgtgtctcttgatatattgtaaatgttactcttaaaaatatcaatgtcctaattggaagtaaaacactcctaagccaatgcaaaacaactgaaatcataacaaacagtctctatggccacggcacaatcaaattagaatttaagattaagaaactcattaaaaatcacacgactacatgaaaattcaaaacctgcttctgaatgaatcctgagtaaaaaaatgaaattaaggcagagatcaagaagttatttgaaaccagtgagaacaaagagacaacataccagaatctctgagatgcagctaaagcagcgttgagataaatttatagcactaaatgcccacctcaaaaagctagaaagatctcaaattgacatcctaacaattacaacaaaaacaactggagaaccaagagaaaacaaccaccaaagctagcagaagaaaagaaataacctacatcagagtgaactgaaggatatagagacacaaaaaacctttcagaaaatcaatgaatccaggaggtggttttttgaaaaaattaataaaatagatacaccgctagctagaccaataaagaagaaaagagaataatcaaataggcataataaaaaatgataaagaggatataattgtgactccacagaaatacaaacaaccaccagagaatactataaacacctctatgcaaataaactagacaatctagaagaaatggataaatacctggatatgtacacccccgcaagactgaaccaggaagaagttgcttgcatgaatagaccaataataagttctgaaattgaggcaataataaatagcctatcaacaaaaaaaagcccaggaccagacggatttacaactgaattctacctgaggtacaaagaggagctggtaccattttttctgaaactattccaaacaattgaaaaggaaggactcctccctaactcatattatgagaccagcatcatcctgacaccaaaacctggcagagatacaacaaaaaaagaaaacttcagaccaatatccctcatgaatattgatgcaaaaattctcaataaaatactggcaaaccaaatccagcggcacatcaaaaagcttagctaccacaatcaagtgggcttcatccccacgatgtaaggctggttcagcatatgcaaatcaataaacgtaattcatcacataaacagaactaaagacagaaacctcatgattatctcaatagattcagaaaaggtctttgatacaattcaacatcccttcatgttaaaaactctcaataaactaggtattgatggaacatagatcaaaataataagagccatttatgacatacccacagcgaatatcatactgaatgggcaaaagctggaagcattccccttgaaaactggcacaagacaaggatgccttctctcattactccattcaacatcgtgttggaagttctggccagaacaatcaggacaagtgaaagaagctaagcatattcaaataggaagagagaaagtcacactgtctctgtttgcagatgacatgattctatgtcaagaagaccacattgtctcagtccaaaaacctattgtctcagtccttaaaaacctattaagctttaagcaatgtcagtaaagtctcaggatacaaatcaatgtgcaaaaatcacaagcattcctatacaccaacaatagacaagaagagaggcaaattgtgaatgaacctctcactcacaattgctacaaagagaaaaaaaaacctaggaatacaactaacaagaaaagtgaaggacctcttcaaggagaactacaaaccactgctcaaagaaataagagaggacacaaacaaatggaaaaacattccatactcatggagagaaagaatcaacatcatgaaaatggccagactgcccaaagtaatttatagatccaatgctattaccattaagtaactattgacgttcttcacagaattagaaaaaaaatttaaattcatatggaaccaaaaaagagcccatatagccaagacaatcctaagcaaaaaaaataaagctggaggcatcatggtacccaacttcaaactgcactacaagactacataaccaaaacatcatggtaytgggaaaaaaaaaaaagacacatagaccaatggaagagaacaaagaactcagaaataagaccacacatttacacatctataaccatctgatctttgacaaacctaacaaaaacaagcaatggggaaccctatttaataaattgtgctgggagaactggctagccatatgcagaaaactgaagctggaccccttccttatatcttatacaaaaattaactccagatggattaaagacttaaatgtaaaacccaaaaccataaaaaccctagaagaaaatctaggcaagaccattcaggacataggcatggacaaagattttatgacaaaaatgtcagaagcaatgtggcaaaagcaaaaattgacaaacgtgatctaaactaaagaacttcttttttttttttctttctttttttttttattatactttaagttttagggtacatgtgcacattgtgcaggttagttacatatgtatacatgtgccatgctggtgcgctgcacccactaactcgtcatctagcattaggtatatctcccratgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacgtgaactcatcattttttatggctgcatagtattccatggtgtatatgttccacattttcttttttttctttttttyttttttttgagayggagtctcgctctgtcgcccaggctggagtgcagtggcgggatctcggctcactgcaagttccgcctcccgggttcatgccattctcctgcctcagcctcccaagtagctgggactacaggcgcccgccactacgcctggctaactttttgtatttttagtagagacggggtttcaccattttagccaggatggtctcgatctcctgacctcgtgatccgcccaccttggcctcccaaagtgctgggactacaggcgtgagccaccgtgcccggccgttccacattttcttaatccagtctatcattgttggacatttgggttggttccaagtctttgctagtgtgaataatgccacaataaacatacgtgtgcatgtgtctttatagcagcatgatttatagtcatttgggtatatacccagtaatgggatggctgggtcaaatggtatttctagttctagatccctgaggaatcgccacactgacttccacaatggtttaactagtttacagtcccaccaacagtgtaaaagtgttcctgtttctccacatcctctccagcacctgttgtttcctgactttgtaatgattgccattctaactggtgtgagatggtatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgaattcattgtagattctggatattagccctttgtcagatgagtaggttgcgaaaattttctcccattttgtaggttgcctgttcactctgatggtagtttcttttgctgtgcagaagctctttattttaattagatcccatttgtcaattttggcttttgttgccattgctttggtnnnnnnnnnnnnnnnnnnnncttgaattgatttttgtataaggtgtaaggaagggatccagtttcagctttctacatatggctagccagttttcccagcaccatttattaaatagggaatcctttccccattgcttgtttttctcagatttgtcaaagatcagatagttgtaggtatgcggcgttaattctgagggctctgttctgttccattgatctatatctctgttttggtaccagtaccatgctgttttggttactgtagccttgtagtatagtttgaagtcaggtaatgtgatgcctccagctttgttcttttggcttaggattgacttggcgatgcgggctcttttttggttccatatgaactttaaagtagttttttccaattctgtgaagaaagtcattggtagcttgatgggaatggcattgaatctgtaaattactttgggcagtatggccattttcacgatattgattcttcctacccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttccagaatctacaatgaactcaaacaaatttacaaggaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgmggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattactgggtgcagcgcaccagcatggcacatgtatacatatgtaactaacctgcacaatgtgcacatgtaccctaaaacttatagtataataaaaaaaaaaaaaaaaaaaaaaagaatgcttgtgatttttgaacattgattttgtatcctgagactttgctgaagttgcttatcagcttaaggagattttgggctgagacaatggggttttctagatatacaatcatgtcgtctgcaaacagggacaattgacttcctcttttcctaattgaataccctttatttccttctcctgcctaattgccctggccagaacttccaacactatgttgaataggagtggtgagagagggcatccctgtcttgtgccggttttcaaagggaatgcttccagtttttgcccattcagtatgatattggctgtgggtttgtcatagatagctcttatcattttgaaatacgtcccatcaatacctaatttattgagagtttttagcatgaagsgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggwtattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaatttggctgtgaatccatctggtcctggactctttttggttggtaaactattgattattgccacaatttcagctcctgttattggtctattcagagatgcaacttcttcctggtttagtcttyggagagtgtatgtgtagaggaatttatccatttcttctagattttccagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaatggttttttgtgtctctgtttccttcagaaaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtcttcgataaaacagactttaaaccaacaaagatcaaaagagacaaagaaggccattacataatggtaaagggatcaattcaacaagaagagctaactatcctaaatatatatgcacccaatacaggagcacccaaattcataaagcaagtcctgagtgacctacaaagagacttagactcccacacattaataatgggagattttaacaccccactgtcaacattagatagatcaacgagacagaaagtcaacaaggatacccaggaattgaactcagctctgcaccaagcggacctaatagacatctacagaactctccacsccaaatcaacagaatatacatttttttcagcacsacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacaagaacaaagacacgacataccagaatctctgggacrcattcaaagcagtgtgtagagggaaatttatagcactaaatgcccacaagagaaagcaggaaagatccaaaattgacaccctaacatcacaatgaaaagaactagaaaagcaagagcaaacacattcaaaagctagcagaaggcaagaaataactaaaatcagagcagaactaaactaaagaacttctgcacagcaaaagaagctatcgtcagagtgagcagacaatctaccaaatagaaaatgtttattatctatctatctgaaaaaggtctaatacccacaatctacaatggacttaaacaaatttacatgaaaaaaaacccattaaaaagtgggcaaaggacatgaacagacatgtctcaaaagaagacatttgtgcggccaacaaacatacaaaaaaacgcccaacatcactgatcattagagaaacgcaratcaaaaccacaatgagacaccatttcatgccagtcagaatggcgattattaataagtcaacaaacaacagatactggcaaggctgtggagaaataggaatgcttttacactgatggtgggtatgtaaattggttcaaccatcatggaagacaatgtggtgattcctcaaaggcctagaaccagacatatcatctgacccagtaatcgcattactgggtatatacccaaaggaatataaatcattctattataaagatacaggcatgcttgtgttcagtgtgcagcactattcacaatagcaaagagatggaatcaacccaaatgcccatcaattatagattggataaggaaaatgtggtacatatacaccatggaatattatgctgccataaaaaggaatgagatcatgtcctttgcagggacatggatgctggaagccattatcctcagaaaactaacacaggaacagaaaaccaaacaccacatgttctcacttataagcgggarctaaacaatgagaacacatggacacagggaggggaacaatgcatactggggcctgttggggaaggcagggggagggagagcaccaggaaaaatagctaatgcatactgtgcttaatacctaggtgacaggttgataggtgcagcaaaccatcatggtacatgtttacttatgtaacaaacctgcacatcctgcacatgtttcccgagaacttaataaaataaaatgaatcaatgtccaattttttgctactattaatatatagaaatataataaattttattgcaatctagtaccccacaaacttactaaatttacttctccatcctagttcccttttttataccttctttgggatttctacataaataattatgtcatctgttaataaagaattttcttccttccttcctttcttttctttctttccttccttccttccttttctttttctttctttctttcctttcttttttcttttcttttcttttcttttcttttcttttcttttctttctttctttctttctttctttctttctttctttctttctttctttctttcttttcttttcttttcttttcttcttttctttgcctttttgaacagtcagggacctccagtacaatgttgaattgaagtggtaagatatatacctcagatttgtctatttctcaaaatgtttcatctgccatcaccctagtgcaaactgccagctttatcatttgaacttctgaaattgtttttgactgttctttcttggtttatttttgttttcttttcctctccaatctctaaacatccactgaaataatattttaaaaacataaacctgatatattaccattgcttaaaattattgtatggcttcccatattcttagcattaaatctcaaaattcttatgtcctgtaaaactctccctgattctgtacctctcacattactaacatcagttcactttctgcactctcagtatgttgcatttcatctgacctctaggcattttcacaagttctgtttcctcagtaaatgcaattaatgatgactaccacaaaaaattactgtgagcattcaatgagattatgtttgtgaccacactttataaattgcaaactctctgtaactgtaaggtgcaagattaggaaaaagtgtaatacraggtcaaggctccttttgattctgtacttcagtggcactctcgttctctaggtggcccatgtagaaacttcaaagtcatccttgactcctctttagtctcgttttatttatttctctctttctttctttttaaaattattttcctattttcagttctacagtttatctctgaaatccatccagttatctccatctccactgctacttccttatttcacatgtcaaatacagcacattatcttaaatagtatcctgccttcagctttgcttatcatcttttttccaccaatcactagatttagctttctaaaaatgcaaatttgaacatagcacttctttgacttaaaattcccagtgtttttcttttgctcttaagataaaaacaaaacatcttaaaacaatcttcaaagccccttatgattatgtccctgcctgcctccccggcctccatctcaccacatgcagccygtcatccagagtcatcccaaccacaggaaactttcatatccccagcatgtgtcctctcacctccatgcctttgtgcacattagtctctttgtcagagacactcttctccacttttcattacagcaactccaatttatttttaggtcttagtctaaatataatttctttccaaaaatctttcttaattctccamtatcaagtgcaatttcctccttatcccaagttaccatttatcattgcatttatcacattttactcacagttttgtaattttctctacttcattagactttgctaattataaactaaatacttaaaaaaggtaaaaatgtccctgagattttagttcatggaccccagaaatagttacccactttagagggagaatattatttaataaaaagttgaaagtcttgcctaagagtatctttgttccaatatcccagatattaaaatgtatagtactttattggaaagagattttgtttatgatagatgctgaatttttcaaagttggacagttaccatgaatcaagaaacaagatgtctaatatcatttcagtggttaggccatctagcatatgttcagcaataaattatgtgaagcatcagattcaatataagctacatattagccatttacaacgaggaacgaatccatgactgcaaagtgagacagcattatcaattatggtagtagcagcattatacaggactcatccttctggatttaacagcatactacttcctgggaaaaatataaacaaagaacaccaatattagcattgactcctacacaagtgatagggatacattcagaaaagcttgaagttagggtctcttttgcatctcacatgttcaaattaacctgtaatctcaggtttaggaaaactgaaaaaccatcacatccaccaccttaaaggtcaaatcaaaaagatcaaatgcccacaggaccatgcagatgctcaaggcagaacagtgtgatgaataagaaatcacgtgctctgactcacgctccagccaaacagcgctgagcaggaacgtaggtatacccacgctgaccatatcaactaattwctttctgctcattaattaagaaatctatacattttttaatgttggcaattaattcagcattttaaagaaaatatgtttcaggctaacaccgtaggggctaaagagaattggcatgtgtcttgcgaccttgtgcaatttatttaacctatctataccttagtttattatttttattcttaattctttcttttatgttattatggatacataataattgtacatatttatggggtacatgtgatgttttgattcaggcataaaatgtgtaatgatcaaaccagaataatagggatatctgacttaagcatttatcatttctttggattagggacattctaattctgttctttagttgttttaaaacatacaataaattattgttaactatagtcactccattatgctactgaatactagatcttattcattttatctaactgtacttttgtatctattaaccatttccactttatctcatcttccccactacccttcccagcctctggtaactatcattctactttctatctccatgagttcatttttatttaagctcccacatatgagcgagaacatgtgatatttgtttttctgtgcctggcttatttcacttcatataatggcttccagttccatccatgttgttgcaaatgataggatttcattctttttatgtctgaataatattccttgtgaatatgtaccacattttctttatccatttatctactgatgtacatttaggctggttcaaaatctttactattgttaattrtgctgcagtaaacatgggagtgcagctatctcttagatatactgatttcttttcttttggatatatacctggcagtgggattgctggataatatggtagtacaattgttagttttttgagaaacctccatgctgttctccatctcagtgactgtacaaattaacattcccaccaacagtgtatgagagttcccctttctttgcatcctcacaagcattcatttattttttaaatggacataataataagacctacttcaaaaggttagagcagtggttgataataataagcactcagtaaatgttaggtattattattattattatctttaggccaccactgagttctttctttctgggccaggaactgtgccatagtaagcagaaaataaagaggaataggtcgctgaccaggccatcaaactactcatagtatagagaatgagtgacagaagcaaaatcagcagagtaagtctcaactagagagaagcacagaggactaaggatgctccctggaagggccttttacccaaactggaggaagtaaaaggatatcagggaaggattcttagaacagatgatacctgaatgcacttttaaaagatgactactagttaaataggtaaactatgaagaagtgaggaagatgatccagcagaaagctgtatcagcaaggtccagaggcctgagaaatccacatatagttcagtagggatgaatcagggaatacaaggacatcagtcaaacaacacagactataaatgtaaaactggaaccagatgttgaaagtccttgtacaagtcagggttctctagagaagcagaacaagtggaatatatctatttatatgtgtaagaggtgatttattgtggtaattgactcatatgattatgaagaccaagaaatcccacaatatgctctccactaaccagagaacccagaaagtcagtgatgtaattcagtgtgagttcaaagtcctgagaatcaggagggtcaccactgtaagttccagactctgaaggcccaaggatctgaagtgctgatatctgaggtcaggagaaggtgcatgtcacagccccagaaaagagagctaattcacccttcctctgcctcctcattctgttggggccctcaaggcattggatgatgcctgcccacattggtgagggtggatcttttacactcagtctatgactcaaatgctaatctcttcaagaagcaccctcacagacacactagaaataacagtttaccagctatctgggtatcccttagcccagtcaagttgacacatttaatgaactatcacaggccttgtgtgtgtcatcaatggaggtcactgcaaagttttaaaaaggaatatagaacaactcttattattattttagaatgcttctcttgtaacaaagcaaaggctggactggagaaattcaaaactggaagcagggaaatcagttcatctagaagaaatatctattacgttaactgaagcagtagctttgaaagagaaaggagatattggtttagggagattttaataggacttctgaatggattgaggtgggagcacaagggaaatgaggaggtcaagaaagacttccaggcttctggcttaaccatcatgataatgatggatacaagaaaaggagcagatttatgagggaaattatcagattaggaggagaaggagccaaggtgtgaagccaaacagatagagaagaaccaggcaagatgaaaaataagcaggcacaacctggcaaataagagctgtcctcaatacattttagagaaagaaatcaacacctgcttcccagatttcatttctctcctgggcttgtctcctctgatacatcatgatcaactaaagaagaaagctgagatgaattaatccatcaatatgtattgtatccattcccatttccttataaccaggtacccagatttgtggatcactttcaaattatagtctgrgcccaaagaagagagtctcttgttttctttttgttttcctgtgtgacgccagctggttcacaaagagatttaactctgtgtcctsggattccttaatgccaggctcttagtagtctaggatatagcagtaatttaagaacatctgccaattttttctaggcaggttttggtgagacttcatattgagactttaactcagagttgcaaactggaagtccaggaaccaaatatggcttgcagacttttttatgtcacatatggtatttaaaaatatgaattaaagtacatttaaagacacagatattcaataggtctcatattggtagccatttgagtttactacccctccttaaatattagatgattatgtccttttccacatattatttggaccctaaagcattctggatataataacttcataggatacaaacacactgatgatgtggactgttctttgacaagcggcaggaaaataggagtgagctaaatttctgaaatcttatgtttattgtgctaatccttatcagtttatcactaaaaggagtagagccaaccaatcaccacgcagatcactggaaagattaaatcagtccaatagatggagatatttctatgaatatagctgatattaacattccaatatttcattacactgacaaagattgcaatgagaacagacaatggaacaaattaatctattcttctgacagtatgtaatgagaatgggatgtggtttaaaaaattaagccattcttagtgcaatctcaagattgcaatctcatggtctctctcagatgctatacactctggtgatacgtcattgaaaagtgtcagtttaacaaagaatgtgtcttagctcttgctgggattgtagaacacatttgctttgtctcaccgcagccctgcccattaaaaacaatgaagtagaatcaattatacttttcagaacacacataaacacaatcaaagttgaaaaattaagatacttctggcaattttatattggtcaaaacttactaacaaaatattgtagcgtattgctctctttttaatctttttaatgtgagtttctaaatttaattttataaaacagaagacagtgaaaggttactttagggattgagaatctaatactaacttatccgtaagtggggtatagataattaaggctgtcatggagagctgcacagtcattctctctgcatagtcatattgcattatgagctgagccttatgaccagtgagataggttgtagccttaaaatttgcagtaactcaatgtaatattttacttggtattcatacccaaagagaacctaaaaaggacctaagttgactggtgttctaaacaaaacagaaaacatacaattatgttttttatatctagctctctaggttcaaaccaaaaagaattggtaagacttttagatgtgcagatgatgataatagcaacaacaacgcagctacacttgttgagagccaacaatgtgcctggagctccatgtatactatctcagttagtcctactaacctgtgggttaagttcttttaggataagacatttgctcaatgtcacatgctagtaagagggcagtcaagacttaaatactcaggttctctgtcttcaaagcccatgtttgccacgattatactctgtcttccctgcttcatcttacatttagcaaaattaatgctcatgaggcaaattggtttaattagtatctcccagagagtttacagcaaagccagactgaaaattagacctccagatttccttggtaaaggtacttcttattatgtcactctgctttaatttattgaagcacctcctcccatatttttgaatgaaagatattatattgattaaatttgccactagatttcagtaatttacctgctcatgttgtcatctagaattaaactaaacattatattcactctacagtgtttcttgatggctaggcattgtgccctattctctaaacataataatgaataagatatttattgctgttaagctatcatcttcattcatttattcaataaatgttactgagtcctatataccagaatttatatgagttccagttaaataacacttttagtgcctatgttttttaattgtttactgttattcaacttctattttagattcagggggtacatgtgcaggttcattggtatattgtgatgctcaggtttgggttatagatctcatcaccaggcagtgagcatagtacccaataggtagtttttcaacttgcccctctctctcccttcctcctctagtagtctgcagtgtctattgttctcatctttatgtccatgtgtacccaaagtttagttcccacttataggtgagaacatgtgttatttggttttctggtcctgcattaattccccttggataatgacctctactgtccacaatagcaaagacatggaatcaacttaggtgcacatcaacagaggattggataaagaaaatgtggtacatacacaccatagaatactatatggccataaaaagaacaaaataatgtccattgcagcaacatggatgtagctggaggccattatcctaagggaaataatgcataccttttgaatacctattaatagccaagtactgtgctaggcacagaagatacaatggtgaaaagacacagtccctgacctcaaggcatttatgatctatatgcacaggcagacaaataaagaggcaattaagtataatacatgttatgatagtacaggttgttatggaagtacataggaagggtacccaggaaaagtcaatcaaagataagagctaaatgacagtagatgttacgaaggaaaaagaggtaggggagaacattccaggcaaaaggaatcgcattttagaattaacaactgaaccataaaatgcagtgaaaaaaactaggcattcacatatttcttatttattcatttaccaattttcattgaaaaaaataacaccagattatttttggtttattatcacttacataaaatagtcagtacattttgacaaatgaatacatgaatgaggttatcacatgttgtgctgaatgcctgttctgtagcttttcactggtctatcacttttgagaaacaacatacacaatctccattcatgtcttttcttttcttgataaagtatcgacaaacaagggagaagttgaatccacaaattgacaccatggttatatagactctgcagctgactcacaatactgggtttaactcttgtttttcaggataatgagagtgcaagctatgctctagaattatgttgtttaatatgaaagccacttaccatgactatttaaatttatattaaataaaattaaacaaattaaaaactcaatttatcagtcacactagccacattttaagtgctctgtaactttatgctatcatatttaacaacatataacttttttttttttttgagacggagtcttgctctgtcgcccaggctggagtgcagtggcacgatctcgactcactgcaacctctgcctcccaggttgaagtgattttcctgcctcgagtagctgggactacaggcgccagccaccacgtccagctaattttttgtgtttttagtagagatgcggtttcaccctgttagccaggatggtctcaatctcctgacctcgtgatctgccgcctcggcctcccaaagtgctgggattacaagaacatttttatcagtgtaaaaagttctattggatactcctactctagatctaggttattatttctactaaactattgataaatatttcaggagactgttgagaaataatagttgctcaataaatagttattaatatttttaaatttagctttattctcctttaatggcaaagtctcattctttaaagtagaaaccaacatttacataaatcctctaacatattttttgtagcaatmaaggtaaaaatttgattaatgggctgacaatctccttcctgaatctgtaataccagaaaatttcccagatgttagtgtagcatggctgcttaggcaagactgacaaaacaatctcaaggtgacaaatttcaatttcatgaccccctcatgttacattgcccactttctggtggaggcactaatgagtagcatcactgccaagagtgcttaaagcaaaggggaggagatgccaagactttgcagaatctactttgaataatgaagaattaaatatcattcatcttaaactgattttccagacacactgccaagaagcaaacaagtaactctatatttttgataccagaatctaaaagaatttcaaagggggatggttggcacctgcatcagagtttaactcattttatgactagtccctccccacccattagactatgcacaactattttaaatgtgctcaccatactggcttatgtacttacagctacaccagctcaacaatatccaaatgatcataaggtaacaaagtrgagttagaagatcagtgattgctgagcaccagtttgtttgcttattgatttacctcatcccagaaataatttaaaaatagtcaagagtggcccagcatggtgcctcacgcctgtaatcccagcactttgggaggccaaggcaggaggatcacgaggtcaggagatcgagaccatcctgctaacacagtgaaatcccatctctactaaaaatacaaaaaaattagctgggggtggtggcatgtgcctgtagtcccagctatttgggaggctgaggcaggagaatcacttgaacccaggaggcagaggctgcagtgagcccagatcatgccactgcactccagcctgggtgacacagtgagactctgtctcgagaaaaaaaaaaaaaaaaagagtaaccagtgaaagtactccaaaatgcctaattttttgtgacacagaagacacatttaataagtagtgacatatttgataagaacacaatctaaacaacaaaaaaaatgagtggctatatttacctctgaaattagtaacatgttttataaaatgagaaaacctaattctggtgcagatgtattgataaccctcacacacatgctgttgagagtataaatttagtacaactgttagaataattgttgtaccgaagtctttaaagtagttatgcctttggcacatcatcttctctcctcaaaatatcataaatgaataatctatgaaatctggcaactcatgttgaaaagatattctttgaagtgtttacacccaaatttggaaaaacctaaaattcggaaatgattaaaaactaaatgcagagtcattaaaatatgttaacataaagtgttaataacatgagaaaatgcttcattgcttagattaatgctttaatatttagaaaaaacaattacataattgtatattgacataaggtcaatgatgtaaagtataagaaatatgtgaaatattttaacaatggtttcttctaaatgataacatttattccttctaattctcttaattttttaaacttctacaaggaagaagtattaatttacaattggcaaaattaggtaatcattcagaataatccataaagtgttgatcaaatcacattgcatataatttcactaggcctactgaaagtgtatggataaacagaatttgatgggagtaaattttggtagagtagaggtagtagttgtggcttatatctcaaaagtcattaagatatagacagatgcttacaataccacaatctaaaagacaggcagcagcaatgtcctggaactttatcctctcactgatgcagagcagtttttgtgaggaatagacagggcatcatgtgttgattacagagtatatttattataatgtgtgctaaagagagcatggattttgaaacaaaagactgcaccaaacattagttatatgtaaaatgtttataaattaaaaactagctccacacataacaacaacaacamcacctactttgcatggtggttaggaggattaaaggagtttatgtagttatctaccatgatgcctgatacaaaatgcattcagtaaaagtagctacaagcttggtttctaagggagtatagaaatcattagttgcagaacaggaaatatttagcaatcaggaatctacagtgaagttctaagaatcacaaaacagtgatgcagactttgagatgagcgatattcagaaatccatgcaggcaggcaacacgacagacttcaatcaatgagtattgttagctaaaataaagatgtgaagtgtccaacagagttttaaaaataataactactttataaatattaaaaattaaaatcccaacaactttgtaaccagtaataggatttaagctttaaaaaaatctactttgctcaagtgatacaggtgctatgagaagtgcaaatttcagtggtattccatgtttactacatacaatataagctctttagcctgggatttatggcattatacagtcttgtttaatctgcctttcaatctttacttcttataatatcatgtacataccctatacttcagacaaacaaaactacttgctccttgcatattccttcactccttataaatgccctgtactatttattgagtctgaaaccaaatgaataaagataagtttgtagtatcaaattatccatcactttctttagaccattgggggaaaaaagcctagaggtctctttgaatgtctgctgatgttgctcagattgatttttaatgcctttktgtgtgtgtgtgtcttcatttgttgcytgaaataaacatgtgaatttcaaaactgacatgaccatttggtttgcagcggctgcggcagcagacatggcttaccaccacatcagacctcccaytggctattccattcccaagcccatatcatctctgctgatacgagggtggaacgcatgtcctgaagtgagtaatttttatttcctcttagaaaatgtgttatggtcaaaatctgtcacaaatagtataactccaaagtctrctttcagtgtgtattttaagactgtcaaggcgggaagactgatttgccttctgctctttagtctctaattgcctcaagaagtctgagtatctcatatttcttagctgctgctttctgattttgaaacgtttctcacaactgattagtaaaagagagaccagggtatgacagatgactcacagtctcatctcagctgcaatttttattaactacgcgtgagccacacttagtcattttctgaagcaagaaatttggcacaagatggatttgtgttggcttttaaacatgaggcaggcctcagaataggtggtcttcagtagcactggctcacgtaggaggcagaagacctgggtcctaatccctctctaactttctgagttgacagtattatgatgtggttaacagcatagacttcgaattcaaatggagtgatcaatgttatggaagggatatttaaacagtaaaataaatttttaaatacggtcataggtctaaaagaatagagagggaatagtcatattatcacagaatgaaattccaaacaatccgcctgcaagaagggattcttaagtgtgcagacgggttatgtctgctttgttctcagagtgtcaccgaggagattgcacaacttctttcctagtaacacagttcagtccagtgtctagtaatccttctgccagtatattttgttgtctattaaaatccttgtgttttgatatcaatcgattccattgctcagagtggagagtattagtttgcattcttcacaatggaggacctcatatgtaaagacctaatggttcttatttttccatcctaaaccatcctagttattgtcctcttaaattataactttgtttctgatccttcctaggcactttatagctcttcaacaagagaataaagtgaggctattatttcaggaaatatctcactcaggagaaataaaataggccccagtccagatgtttgaaaagagaatgcaaattttccattcttttcctaaaggcaaaatccagaccaagtcattacccagtctcatctgtgtacacagaaactcttaagaagaaaaatgaagatcgttttgggatgtggattgagtatctcagaagataacctcttatcctggccattcaacctgatgtgttacatgtttatttgtttagaatcttccatcactaccaaaatgttagctccatgaaagcggtcctttttgtttattttgttcactgctataacactaacatctaaagctggatgcttaagaatgtttgttgagtaaatgaatgaataccagtattgcctatcagtgccttcaatctctgcatctgaattttgatgtccagaaaatttcatcttgaaaattacatcacataaaatagtttaggaaaacattttcttgtatttcagtgtgaacctcagaaaaagtatgtcaagcacctattctagaatttccttctctctgtgggatgtgagctattgagagatgacaacgtgctagcagccctcactcactctcggggcctccttggcctcgtagtccactctggccacacatgaggaactcttcagcccccagctgcaccgtgggaacccctctctgggctggccgaggccggagcccactccctcagcttgcggggaggtgtggagggagaggcgcaggaggtaaccagctggcgctcgggtgccagcatgagttcccagtgggtgcaggccccatacttggagtggccggtgggcgccactccaggcactgaggggcttagcacctgagccagcagctgcagagggtgggccaggtcccgcaacactgctggcccgcccgcaccgtgctcaaattctcaccaggcctcagctgcctccccacacggcagggcttgggacttgcagccctccatgcccgagtccccccccaaccgtgggctcctgcgtggcccgagcctctcctatgggcactgccccctgcttcacggcaccgggtcccaccgaccgcccaaaggctgaggagtgcaggcgcrtgatgcaggactggtgggcagctctgcccacggccctggccaggtatccactaggcaaagccagctgggctcctgtgtggggtggggtcttggagaacttttatgtctatctagagggttgtaaatgcaccaatcagcactctgtgtctagctcagggaccgtaaacacaccaatcagcaccctgtcaaaacggaccaatcagctctctgtaaaatggaccaatcagcaggatgtgggtggggccagataagggaataaaagcagggtgcccaagccagcagcagcagtaagccactctggtcatcttctgtattgtggaagctatgatttttgctcttagcgataagtcttgctgatgttcactctttggtccacgctgtgtttatgagctgtaacactgaccccgaaggtctgcagcttcactcctgaagtcagcaagaccacgaacccaccagaaggaagaaactccggacatatctgaacatctgaaggaacaaactccggacacgccatctttaagaagtgtaacactcactgcgtgggtgtgcggcttcattcttgaagtcagcgagaccaagaacccaccaattctggacacactatgacaaagtttaccatcaaataacaatcaagggaatccctttttctttgatgaagtgtctcttcataattatagataacaggcatgtggaatttctaatatcaatgtaaagataggtcattggcaggttctaaaagcattttttgggtaggatggatgtctcaagcaaagagttgggaaatgacaaacagaaattggaatatggccaaaggatactgttaaaaaaaagaaaggataaaaatcgattgcttagcagaaaagttgtactgttaagaagtgaagtttgtcagcacggagtctttgttctgctgatgagatgaagaggggaagatgaagaaaaagcatattaggaaagcaaagtcttcagctggcttgagatatgtgggtctgccagtcagttgagcctgacttggctctggtaaccacctcaggataatgaagttgagctgcttctgtatgtgactcacttgagtctttcttaattgtccagtaaggtcttcatcatgttagcaagctgagtggcaaagaaaagggaacagtgggctgtttttcattctttccttcaacaattatttgttgagttcctactgtatacctcctaggataggggaaagggattcaatagagatgtaaactcttaaatggagtttaagacctgctagttatatggagattgattgaataaacattttaatgattctatagttaactgccaaggttaagaaagacaaaactctgtgagactatatactaaaacaatactactcgcaagttgggggacaaagacagaatgcaggttagtgaaggcttcccaaaaagagtaacacttgagctgaggccataaacagtagttttctgaaagaaggcggcttggtgagaaagaaaaacagtctaagcaaccagaacataygaaaattcattaggagaacagatacaagggaaagactagtagcagttgcaacattgtagccatggagaggttaaatctctgtatcaggcattatttgaaacaagttcatctttagatggaggacactaacatcatgctattctggtcattactttctaggttatsaactgtgcttctcattttttcttgcatatctgtctttacttcattccttgaatttgaagcacagtattttctccaggatgtcttcttagtcaaaactcataaactagaacattgaggagagtaagaagaatagtctattgaagatgggagaaggttggaaaacagtaagaggtagaaaaaagcctgatactagatagtgacagattttggaaactggaacaggaaatttggacgtgaaattatggcaattatatttttttctctaaaggagtgaaaagataaaagtaattttttaggaagttcatctgagtttgatacaaaggatttatttacttaaaaaaattgtagttcctacagtaaggcaaacactgaattatcttgtaatgctcattggaatagctaagcattgattcttaatatgtgggctgcaaactatgtattccagattaccctggaaagtttgttgaaatgaagattctggggccctaatctaagtttactgaattaaaatctctcagatggagcctgaaactccacaatttaacaagcgccccaggtgatttgtgcccaacaaagataaaaaatgaatgggttgaaactcaagcaaaagacaatgaagttggagcagccagctggactgctgtttgagtaatccagttgattacaacacacagactacartggttaccatggagattcaagggcaagggtaaacctgagaactatttcaaaggaaacatcataaagaggtaaaagactggatttcagaaatggaagagagaaaagagaccaggagaactaggattgctgcctcctgagagtcagttagtgaccaagagtactcattaggcctctagatatcagggatattcttggcagtgagagcagagagaacaaagctaaaggtgctgaagtaaggtgacagcgctttaaagaagaagaaaaaaaaaaaggaaaaagaaagatagctaccaagaaaaaaagtgacctggtctacaaagatgaagaaactgtcgattagggtggaataaacttatcatgcaagaagttggcatagatactcgtctcaccttaaaggtgctttaaaaataaagtggggtcaggcaaggcagataggtggcatagcagttaagctcaagcagagataatgaacagaaataccagaggaattaggattaaaagcaataaagtcttgaatattggcgagaaaagatgaagaagagaggtaagaagtttaggaattttcaaaataagaaacttaagttatttcctagcaaytctgaataggaagggaaacaaaagaggcggggtatgtaggcaatatttatgttgttctaatcttataaggtttataaagcttatttattattattattctaccaaatgcagatataaagatgtatagacctagacaggtgtagagataggagaagaggaagtttgtttcccttttaacatttttgttcccctactaaaaaatgtaaaatattataatattctaaattgtgaaggtatgcttcaaatattttttacagtggtctcaataattaaattatttgaatatatctatatttttcaaataagyatggctttgaatgagacatgtttgttctgttactgtttttaaatttaatatttatattcacatttaattccagtgtataaggaggagttctcactccaaacaacagtggcatgcgaaacccaagagatcagaccttgaaagctatgcactaataggttatttagttttcaaaatcttaaattaataacaattggcaataaagctcattaaaattccttttgttcaggatccattgtgtcgatcttcaagccctgttcttctaaaatgattgaagctgagatctccacctagtggatatataggattttgcagatctttatgggaacagccaactatccctggaaatccttaatttttttctcttagagaaataacaagttttaaagacttctacttaaatctrggatgattgtcaacaggacaattgcaaatgtatgaaacataccaatatgcatatcagttacactacagttaacaaagctgaatttttattttcatactataattaggaaaacagatcaaacacaaatatgaatatataattatccatgtagaaagcaatattgtaataccactaattgagatatgtataataatttacatgaaataaacatcaaatgtaaatctgctcaaatactcttcttatgtagtttttcatttgtttaaggcttttttttttcaatgtttgcttgcttttgcaagacttggcaaaacttttcttacttgttttttcattccttagagaagcatactcagttaattgtgtcagacgtatcctatgactccatctttgatttttgtcatatattcaactctggttttattttattgataacaaagagttactgaggacgttgttgtcctccaaaatgatccacttctaatgcatgcaaaggctagtgggtgtttgtcctcttgaagaaagctaaagtagaaaaggattattatttgagttattttgttcactttattctgtttctaaaggtgatgtagtagcatattcagcagatggtggatacagtacaggttttggagcagagttttcagcttcatttattctgctaggaactaaaaacacctcattttctgcctcaaaactgtcttttaaccctggtaagaaggaaagcgcttcatgtgtctccactgtcattgcgccttctttatgtgcactatctttatctggttgaatattttgaacttctctaaaattatgtacattactgttaacttcaggatctacttcactgcaaagtattctattttgggtttcatgggaacttgtgatacttaaatctttagctgtaatggtctcctcggcagagcttgcatcatgtaatatatatttttcacttgttccattttcccaagtttgctgcctttcttttgtgatgccttttaaggtcatttgtgagatctgagttaacatactagaatctgtcttgctttcatcaagcatatttttctcttctttccctactatttttatctctagtgcttcagtgccgtcatttctgggcaatgcatttgtgctgtcaattcctttttcgctactattggttaggtgccaaacggcttgactactaacaggagaagtactgatatccttgggaagttctattctattttggtatggaattgaatttgtcttcataaatgataggttgttcttggattgtgtttggggaatgagagaggaatcataagtttctgtttttgaaagttttttttctacatcattttcttccttatccataatacaattttccacaatttgatgtgrtatttggggttttgtcattaatgttttttctttattttcaagctgtgcatgacttgaattttgctctctgtgttgtaagscttcattttggtctaaagtgtattccttgttgtagctgtcagtcttgtgagcatctaaaagttgtgtttgattcctcggggacaaagaaaactgatttaactcactggtctttgatacattctgtcccatgtgctcagtggactccgttgtcccttggtcagtagccctcctggaatgttggaatggtaaaacatcacttcctgtattttcccaagtagttgctaaataactaagcacttttgattcaagctgagttgcatcttccatttgctcagttgagaattgagaatgtgagtgcctgtgctcagcatcagtgggtgtaggttggggcaattttgatgtgtttccatcaggaatgtggccagctgagtaacagctgctttctatagagctctggttgactacacgcaagttgttagcactgagcaggggggcacgtttagtgtttcgttgataatatggggtctgctttgagtcatgtttcagaggcagcctctttgaagtgagtctaacatagttgctactctcygactgttgaagaaaatctgcagaacacacagtatttattttggcttctgtctcagaagttttggataatttcttaggaggcaacaatacctgcttgcrttgctttgggagacttgacaaggatttttctggatggactctgacttttctaaaaggatgtaaatttaattttaagttttgtcctttaattttccctttgaggtcagactgaggggttctcttccttttcagaacccatgaattagtaaaccatttttctcctttgtttctctccccagtgttgctaaattttttaacatccaacttagtcagttggttactttgatttttctgtcgtttccaaggggttgatattttgggtgacatcatcgacctatttatttctactaaatcaggatcatggaagataaccctctttggggaatatgctttcttggtttttgttgataatcctgataaatctatgttgtcctcactcataagaaatttttctattgcactgttaatttggatttgctctttcycaggctttgagtgttgtctacgatttggcttcttttctttcatgtaatcttcaaattgctcacagggcacatatttacagataagagaattgtttggctgaaaatacctaggtttgctstgttttaacagtccacaaggatcatcatattttgatctatttttttgtacgatattttgtacatagtgttcctcaggctcacaaggcttggatgatgagcttgtaataaaatgtctttgcctrtgagggtgtaagccrttgtcttctttttctaytggaggctgccatgattcatttgttaaacgcttctcaagactttctyctgccaaggctgaagcggktgttgcatatcttcttctaaatatgtcactgctgatatctgtggaacaataaatgcaagaatttagcacttagcagagttttattaccccaaccaaacagatgcgtagaaaccttatgaaaagtataaaactgactcctctgataattgcagttcttcactatttcctaatttgtaaccaaacctacaaaggacatttgtcagtcccatatgttttgcaatgacactctttatggtcacactgcagtcagttgcgatgctgacttaaaagttgtggagttagaaatataaatgttatttatagtcatatatctttagttgttggttaggttagctttaaatatgaatagtatgtaaatcctttgtaaatggctatagtaattttttcctgaattcatttcccatttgcaacttaaatattgggcagaacatgggtgcaatattgagtaatgttcaggtttcagataatcaataataagataataatttgacaatgaaagggaaatacttgcaatactattgactcaatgaaagcagagaccatatctgttttatttcccataacttaataaaatgttcattaaatatttgttaaataaataggtattttgaaatatagccaggtttgtgtggcagcagtctttacctgggacttttaaaatggtacagattaatataatatttaatcttattaatcttataacttcttctgctagcttcttttaaatgtctgcctgcaaattcctcttcatgttacaatctttcatttactaaaggaaaatagtacatgatgaaccattcagaaaggaagcttcctttgactgtttggggacagaccatatctacagccctataggcacatgtggaagaaggaaacttgtactggcttcttcttaatgtctgcctctaatctccttttacacattaaataatattaatgacaaaaataatagtaataccattaattgagcacatgctaagagctaggcattgtgctcataatgtacgttcatcatctcttttaatattcacaagagacrtgatccattggacagatcctactgtcttataacttttacagatgaaggaatgagctttaaagaagttgaatgctttcccgtagtcacacatcagctaagtgttgaaaccaagaattgaacccaagtctatctgacattaaacgaccctattgtcttaaccacaatgcatctaaaatttaaaattatttattagtatactttctattgtttcatgaaattttttcatccagaggaagaagttttttattccatgagaaaaaaggaaatcttaactgcaaaacatcttaaccgcaaaaaatcctaacagcactattgctatttaaaaggctatttttttttttcatttttaacattgttaggtgttaggcctcaaaattaacttttagtagacaggagatgtactctcagctcctaagggtggggatactccatctccaattttccccaagaggtaaactaagttccagactagcatctaattccaatctaagatctgccgtcaacattctgggtgaccttggagaagctgcttgttcgctgtgtattggaaggttggactagatgggagctttatgtaagtaaacaaattatgttggggaaagaatctgtagcctttgtcagagtctcagagagttctgtgactcaaagataaacattaagractattagtctagatctaaagtmctctctacactggaaagtctataattctttttccaagtcagaaggcataatcagagtggcaatttttctttaccgatttctgttctggagcagatgtgaccttggctgttttctcctcaaatacctgccctctctagttctggtacaatgcctggcatagagcagaatttctggtatttcttaaaagtattcatgttaatctgacaaaccagtgttctcagtgtgaaaacaacagactgggttttaaatggttaaaagagcacatccccttcagttataggagtttcccacagagaagttcaggcattggacaaagttaaaagatgaaatgaaagatctgcctaaggtatgattctaatgaaagggtaagtgcttatttctttataaaataaagccagtctgacctggtttctatggcatatgtttctttcctcagccatccctctgttgtgtgaaatcatcaacccccagacactggtaagaactggagtgtgggaatgcaatggaataaactcacatcctaccttataacatacgtgaaataacatatggttttattcttatccagtcgccccaaaatgcatccttagggccagacccctgtggtaagaatttcttgatacagcacctctgtcattcatactcttagagaaagctctgcttgttgtgaaccaattcaaataaatgacaggaacctctttacagagcagctgtcaacattttcactgctgagcctgaatgcgtagccttactattcaggaagaaaaaggaagacgtttaattcattgccttcacctaaatattgacatcgcccatgtacagtgggtagatgtcacggccagattcacttggctcccagtgtgggacaatgaattaagtcctgactttccctggactgggaagttatcatccctgacagctcagcaagcaaagtacgtttcttgacatcattcctgaaatgaatcactagcattagagggcccattcttctaacatgtcatgctctgggaaggttgcttactgcagaattggcattagagctcgaaggatgttggaataaaagctgatactagctatcccatagatcttaacagcactattgctatttaaaaggctacttttttctttttttaacattgttaggtgttgggcctcaaaatttacttttagcagtcaggagatgcactgtcagctcctaaaagtaagaacacttcatctccacctcagcccacacacacacacacacacacacacacacacacacacacacagtatttttagaaaaggaatagactagtgctatagtgatttttatagtatttcctgttgaggaaattaaaggagggaggctccctccttcaaaaagaattaaacggagtgggatyttctaaaacaagacaaactcaccttctgttcttattatatggtgttgcagagtttgaggctggacttctccaggctcaagattccatagcttttgaactttccttggattatatgttgtaagtaagcctgcttcattaaaagctstcatatttccaggaggctctgaacattccgaatgcagcaatctaccatcctggcaaaataaagtgctgcctaccccacggtctttctttttcaggtttmtaaatgatcygtcaagggttgcagactcagaggccgatgttrcttgatggctattttcctgtaaaagtggcatttcttttctggaccccacartggacatgacctttatctcgttttcctgagttaagtggcagttgcagtatcccttagtgtggtaatttcttgcctcatgagcacacaggggttcatcgaaggttctgcaacaaaggttttctgatgtgtgttcatttgctttgccttggtggagtttccagttaaatacaactaaacctaggcaagtgagaccaacagctcctatgacaaatagagagaccattaaaagataacatcttgggaagaaacacataaatcatcaaatgtaaaaaccacaaatataaaggttaatggcttgaaagatatcagaatgggtaggaagtccttcaccatttggaaaaatatcagtccagacagaggctaccattgacattgttctgctttccaatttggatctttatacctattaaaaattataagaaacaacaccatctggaatctctttggtagaaaaaaaggctgtttcatgaactgaaactcatttaagataaaacagttcctgcagtaacattattttttcggtctacgtcacctccttttatgaactctcataatagagtgaatgacttctaatctcagactgcctggtactgtcatttcatgttctatgtagtttgtcctctgaataaaattgcaagatccagtgtttctcaaacccatgtgccgactctaacctgtttctatttcactttttcctgtcttgacaaatggcatcctcaaccacctaaatgttcaaaccaatgtccctgagtcatatcctcattatctgtctatcacaatgatttcccttgttttttcacccttatgaggtgtattattctgtttattcattcatatgcttgttcgcagactgtcctcctctgctacaactgagcactgtgaggcaacacatccttttaktcctgttcaacattctatccccagtgtccacaactctgagacaaaggaggcagaaatatttattaaatattcttaaatcaacagaagggattctgtttatgaattctgataatgaaatcattggtgatctaatcttataaattctcaagatgtgattaggaagatatggtgtcagtacagattgaataaagagatctgtgccctaaacccacatctgcctgaggacagtgcccttttctggaaataaagacagcattccagattctttgactggctacaccatgtctagttttatccactggagacaatattaatgaaaacatatttttaaaacttaaatgaaaagggagggtatcaggtcatrattgtttcttttttttctgttaaagatgaagagcaaacatggagaatagcagtttctggtaaaatcctcataccattgtatagtttaccatatcttgaactcttaaatctatttkaattcatttgccaacaatacactcttggaaagtgctataacatattgaagcaatctctattaaaggcacatttttaaagttgtagcaaaattatgtaaataataatccttttattgacagatagattctagagtttgaattatcccaaacaaggattttggttttaaaatgttaaagaatatattaaaaaattaaaaattagaaccactctttaactcatatgggtaagaaaactcaagattcaaagctatattctgacacttttcttgggtattttctaattcctctaacacttattttttttctcctttcacaaatgaggataactaatactacccagggattaaataatatatgtgacatgtttaatacagtgctttgattcagtgaatgttcattgtgatttgtgattattattactgagctaccattgtttaggttttgcattgctctattggttcctggaagactcacctgtcaggaacaaaaaaatccaaaaaataaatcattatgatgatattttaaatgactagtgcagttagtagaccaaataatgaaggaacaaaagggctaagttttctttaagacaagaatcagccactgaaatgagagtaaacataatttgattataggatacagtttctcctctaattgtgtctgaatggcagggacccactcactcccctgctcttgatactaggtatatatctgtatcccattaccagtcaggtatggtcactttccattagtgcagaaagcaaaagcagcaaatgaagcttgtaggcaggcggartgtgctattaagaagacgtttgaattttctttgccatgggcattgtttctatttttaaaaagtgttctaacaatctayctgtgttggcaagagaaaaagggaaaattaatgataagttcttattgaaacattagaaacacattacagcttcataaaaactttttrtctaccagttcatagtgtaagtgtcaagatattagtgtttgatgccaaataaccatttattagttttaaatttacaaatatagctatttatgttctttggaatttttatgacttagatatagctgaagaagaaaatggtctcataggcaaaattatagttctaagtgtttttcccacaatctagaagtatagataactcaccacacgtgtgcttcagaaagagtggaatcttaatggagcaaattaacatcaaaaatcagagtctttttaaagaagaatctcttctcaaagcactacaatttaacaattatttgatgaaagatatattagtatgataattcacaccaaaacttaacatatatgtaatcatatttataatttatcagaatttattcatgtatattaagctcccagtcattttgacaaaacttttggaatcttctagaatttgtattcatctcaatactaataaagaactgttaatgtagctaaatatatttctgaatacatatttctgaaaacagatgtaaaagtaactaaaagatactaaaaattgctctattataatatttccaaaacgatgtcctctagaacacaaattcaatgaaatcctctatgaaaaaaagggatcatggccaaataagttcaagaaatgctccatatcacaccttcttcttagaaatttatagtgcttattagaaaatgaaaggttacgagaagtgctgcagtgagtatacctgtttcactttgcttaacttagtaccttctaaacctatgtgaaccccaccatctattgcctatgcgtgcatctgtgtgtttttattgggatatctattaattatccaccagtgctagtattctaagaagcacatttaagggaaacctctctgctgccctatcacttatgtcttttatggtaaattatttcttagcacatacaattactgacatagttacatggtttttaaaagaatttattttcctaacatttgaatttccttccaagtgagttggattactgctgatggtagttccattgtctatacctgatgctggtctccatctattctgattaaaagtgtaattgtcaggaagtaaaaatacaatcaattaattcactagataactgttacagaataatgatttatagcacatatttaaaatacgtcagtcttggatgccatttgttggtctctggtctctctctctttctctccccaccccctcatcaccatggttacccacaggtgcagaggatttcaccatgcactgagagcatagaggaaaacacacacatcgagctagataacttaagaaatctcatgcatctttggtcttcaactaatgacactaagtgtcattttatattattcatccagtgagatgtaatgatagctgatgcatagtttcataaattttaaattacaaaaaatatataaagaattgcatattatcctccccttagttggtctggggaagtatgggccaagtttacatagagttggacaaacagaaatcttagaagaattcaaaaccacccaacaggaggaaaaccaaggcacagagaagttagataatgcatccaaagtcacacagctaatagcagagccaggattcaaacctaggtaatccaactacagagctcatttatttaactactatgccatacaaacactgcagactaagatatatgagattgccataatagcatctcttcgtccatctgtgaaagccctctgactcttactatacaccatggagaagcayacaaatgtaagtgccttgaggaaagagtctatgtcccatcagtttttaaatatctatctcctagtgtcataacaaatgcactagtactctttggtgaaaggatgattgatgaaatatagatattattcctgtrttatacacaaggaaactaaagtctaaatagcaggttaacctgttcaaggtcaccaatgctatttataccagggctggagcccttgaattctggtccagggccctttcctctatgttagacagcttccctgaaacaggaaattcttgcaacctgtgccaaatcagctaatatcctcccacatctactggcaacctctcctttccatagccctggcaaccaagtgtctgagataagcatcacttagcatgctgcaaaaatatggacaagagaagagaaaagaggagggcacacttctccccggcatacctgcgaagccaaggacagtcagcagggccacatctggtcctgggaggaggggacttctgtcctttagaaccagagtgaagttgggagctttggaatcacagttggtctcagacagcctcagcacactctgtgcagctgccacagctgcggtagatggctggcaatttaggtccttggcattcctgagcgtgtgagcagaagacttaatgtagtttcttaaaaaccgagcaaggggatggagatcacaagtgcagctccactggttcttatctaarctcagaaggattaactgcttcagtggagtaaacacatccggcatgtgggctaacctatttcrggaaaggtccacttcctgtagttgaggcaggggccggaaggcatctttcccaatgtaggaaataaaattgttggataaatccagatacctgagactgtggagattcstgcctccgaaagaactgtctgtgagattagtaatctgattcccatccagctggagccgggtcaggccgcttgtgtttcggaaccaagaccctygtagggtgcggagagcattattgctcagcaccagtacctgcaggctgtgaagcttgctgaaggtgtgatcagtgagcgaagagctggatatttggttgtgctccagcaacaaggtccgcaacatcgtaagsccatgcagggcatcttcctgaacatcctcgataccatttctgcttagggagagcagggcaagattaaacaagagagacaggtttgtgctctcaatagaggagagatatccatcggtgatgattaaaaccctcgtggtcataggggctgctgtggggaaaaaagcacagactagatgcagggtacacatgagtgggagggagggggtatggtggagagcagagaatcaatatcctctgagcaatcttatcacctgggtaaaaacaataaacaatacaaaaaatgaaaatgattttctgatttccaaatttgaggggaagctggctatatatcaaaatgatggatttttatattctttgctgctgtgacatgtttgtttgagaaacataaacccatctgttactttagatgtcaaagttaattcattgtttcggattatcttcatcgatgttattttgaaggtgtcttttcaggccctccctccgaggctatgtactgacctgatctagccctgcagatccaggacagaatcaactaagagctgagcctgtgtctgacccccatagtcagtgttccatagcaatgtgtatttatgctgtgaagtcaatcatcttttctcccaaaagtaaaggtgcgagttgggatggggagagtgagaaggagcattgatttctgctttctagccccaggctaaaagttggcaacttggtaaggatatatattcaatccagacaacccaagtacctgtcagtggggttctcattatagtctgggccatcttggcctcctgtctaatatctgttccctccaatgaagtccatcatgtgatgacaggtggtactcagggcttccaactgttaaatcccttcaccataatcacctcagagctatcactgctctgtcattasaaatcaaagcattttaactcaataaagaagtattataatcaggagtcattgtaacacatctttatcatgctaacattgttttgactgcaaatgacagtgtcataaggatagaggagtccattgtcactgggaggtctataggtgatattagaatagtcaaccccagggaagcaaatcacaaatcccttaggaaattcagactgcatcgcggaaacaaagagattaaaaaatacgtaaaagacaaaagattctcagagtgccttcttttggaagaactgttctcatccctgcagcacaagcaagcttaaatcctggtgattttttcagcatttatgattgattatttggattctattaattctggccagttcggcattttgtttctctcatcattgttttagatatgggatgaaggaggtttgttttcatgggtccccagtcctttagggatttactgactctgaatgagcaggctattatttctgtcaattacttcttgtctaggtctagacagaaaccccactcacaattcatccattttattctctgtatttatgaaatctaacttcacaaatatggtgttctgtaaatgagaagggggatatagagatgcaacaatgtagatgagaaatatttgtttcttacagacatcaactgtctctgatcaggaaaaataaatgtagtgaagtcaagaaatccattttagatggtgagagtttagtgttaaagcattttcaatactgattagaaacgatatacacatcaactatccatgaaaacctctctgtcctgtcaaggatggtgacaacatctacctcctaattatcagagtcgtgggatattagaaatggaagaaattatcctcttccactctgtcgtaactcaagcttgtttatggaaattttccattggcagagcttatagcttgtttatctcttcttggatatcaggatgtaaatcacattctcctcaaatttgttaataaggtgtcttattaaattgttgacttaagcaagcaatatgtaatgaatacaggcagtgtatcttgttagcatttctacagctcatttaccaccaataaaaaaagaccagactttcaaaatgagacgcactttgataataatctgtttcactggtacatcacttaatcttactaatgctgaacaattgcagttcaggtttctgattcattgatatttcttccagctggtggtagrgttcaaatctgcacaaagtatgtacaaagatattaaagtgatatatttgttaagtgtgtagctggataaaatggtgatattcttttgcaatagcaaaataactcagttacctytgaaggtctttaartagttttgattgagaccatcaggaacaggaaaataaaatattgccagtctctttagtcattgtatgaagtgtactcattaaagggttacctcttaagctgagcccagagaacagtcagtacaatgaaaggtatggcaaccaattttccaggtacactgagcactgctttttagagttattagttttattacctactatataggttagctggtgacagagggttacatctttggtgcacaccacacatgactcagggcaagctgccaccaaccgcaacatgatggcaaagagtaccagccatccacctgaaaggaaagtagagggcaatgtatatcataatgttggcattcactgtccattatttctgtacatacaggtcatgaggcattttggtaatttctactgttcaatgagcatcttggtgttctcttaagatgccaggtaaataactacattccttaatttgcatagaatttaaactgaaatgttaaagcatttgactataaattcagagagctcacatccagggcatatttattagtattttgaaaaaattaagttactttgcaaaacaatgtatagtttgtagtgctttcaccaaacattatcttacttagttcttttaattctgcaacccaattggagactaaagaaacagctcaggatggttagcaaaccatcctaaatcacatagcgggtaggtatttaaccaagtcttttaactttcaatccagtgtttcttctagtatgcaaagctaatctcagacactgagtcttacatgattacaactaaattcttactccttatagatttaaatgccacacctagggagtgagtatgatgtcaagattaagctcacaagctctacttagctttgaattcagctctgtttttactgactatattatcttagaaaaaaatatttctttttattttttgctttttcatgtgtaaaatagaaataataaatgtctacagtacagagtattataagagttaaatgggtactctaagtgtttagtaaatgttaaactttacctttattttaaagctttctcaaccccccagtgaaatatttaacatcatttgaattttatgttcaaaaaagacaattcatttataatatcttccctggttgattaaaaaaaaaaaaacaaggagcaaattataataaaaccctctacctatataataagatagtttgagaacaaaataaaatgtagaaaaaacataaaatgattaattctatcatttgttcaacaagcatttgtagatcaccttctgcatgctaggcactgctcacagtactgggcatagagcaggggctgacaagcacctgcccttgtgaagtgtactttctataaaaggatataaacaataaacaaataatataaaatatgtattaagtcatatggtgataaatgctctagaataaataaaacaagaaaaggagaagatcgcattgactcgagggctctaaatatggcaaacaaggaaaatctctctgataaaacaacatttgaacaataagctggagaaggtgaaggcattagtgtgtcatggtggagaggatccaatgcaaagttctcaagggcatgaggaggttggtgtgatgaccagagtggagtgtgtaagaggaagagtagggcacagaatcataggagcaggttgttgtataccttagagatgaatgcaaagacatagcgttttaacccaaataacatgggaagtaattggaggctatagtgagtggcattacttggtctgatgtctatttttaaagatcattttaactactgagttgggaactacttttagataagcaaagaacataagtagcaaaaataggaggcaattgtagtaatacaaggaagggatgatgtggtgtagagaaggatgagaggtaagcatattccagatgattttttatcataatgatgcaatttaatttaacaaatttgagctcatttaacctgtctgatggaatgtgctaggtgtctaagagtaaataaaccattgtatcaaagaactttctagctagtgatagacatgtaaatacctatctataacacaaggagaaacgaagtaaatctaaatgcaagtgaataattactttgtggaataacttggatgctttaagaaggatgtagctcttgagttgggccttgcagagtacagtgaatttccatgggcagagaataagcattaggtaattccagtctgagaaaacagtaagaacaatgccctgcatggggcagcagatctaatctcagttcatttattttagtcctacctggccggttagtcggcctcatggatgtgtggttcaggggcaaaccagagattgaggtagaatttacacacagactccagggctttttccaggatctcctctcattctctactgcgtatttgtgataagcaggattctaacatgacctgcaagattcctgtcccctggtgtacatgccatgtagaataccctgtccttcagtgtgggcagaacctgtgaatatgatgagatattactcccatgattatgtttcatcatatgactaaaggaagattatcccaagtgggtctgacctaactgggtgagcccttcaaaagcagaataagttttacagctggtcacagagtggaagtcaggcatgtgcccttgccggttaggaaaaaagcaaatagccatgttgtgaactgcctatttggcaagcagctgtaggcatcctctagaatttgagagtcatttctgggcaacagatggcaagaaaacagacatgtgtcatacaaccacaaagaaatcagtactgccaacaaccaatgcgcttaaaagaggccttgagcctcagatgagaatcacagtgcctgctgactccttgatttcagcctagtgaaactctgagcaaaggacccggctaatctatactggactcctgaccagtggaaactgagataaaaaatgaacattgttttaaatcactaggtttatggtaatttgttataaaacaataactaatacactccagttgccctgaattctgtcctctgttccttcaaacaagcaaaccatcagaattttaattgtttcctaaaatgcagaagtggtctaccctcaggctaaatgctataaagagagagagagagagagagagagagagagagagagagagagagagaggtgggaaatatactagttcctttcttctaagtgactcactcccctccaggatctacttgcttttattaactttccagtgccttcaggtagctgtcatttacattttgtccagagtttctcgttgttttctgtaggagggttgatctaatataagctacttgatcattcagatactgaatggtagtatcaatataatttgctggtatataagagtaaagtatgatagagtagtcaaacatcatcactttttttgtgtgtgttttttgttttttgctttttttttttttgcctctgcaagcagaaggatggagtttccatttactgaaatgggaaaggctataaatataattaattgcatgtatgagtttagagttcaggagaaagtactgggctagagataataatctggaagttgttttttaaagacataagactgaattaactcctcaacaaattaattttaaagggtaaagagactcaaagactgagtcttggggcaataaaaagcttaaagataaggaggagagatgaaaccaaaagaggagactaagaagaagccaatgagcgcagaaaaaaataaaataagaaaatggtgtcctcaaagccaattgaaaaacatgtttcagggacaaaggaattgttgcttatatttaatgctatgccaagtgaaatgaccactgagatgtaaccattgaatttagcaatgagatctttgtaaccttgacaagggcagtttcagcagtgttgtaggagaaagcttgattaggatggattgcaaatgggagaaggggaattagagaccgcaaatttggataactctagaacaattttgctgtaaagtaaacagcaatggaacagtagcttgaaggaggacgttaagggttttattttgctgtttgtttttaagataggagaatgtatagtatgtctgtatgctggtggagattaaacaatacagaaggaacatgaacgatgcaaaaaaaaatggatgagagaattattgctggagcacacaagtgaaggagttggcctgagaatcaggcaaatttcatccacagaaacaaaagtgagggcaaattatgtaggtcataggtgagtaggtcaatgtagtagtgggagctagaggtttaggagagaggaaaaggtacaaaatagccatccgaagtgtgagagagtgaatggactagaaatatgtaataggctctctgaatagtactgacggtccatgggagattagagggtcaagattttgaagtgagaccaggcagaatggattcaataaagtttaggattctttcagtactgtaccaaatgcaagatgaagcaagggagttgaggatgtgtggaagggagtgatagttggaagtgaatctaatgataaatgtaaatgaaatataaggtaaagggaaagtgagtgacagcgaaaagatgatgaagtgagcaaaaaaacaagtagggaaaaagataggcagatgggtaggtaggtagaaagaagagcatctactttaggacatatttggaactgctcgtaataaaaagctcttgttttattttgttttgttttaagtggtaaaatggcttccaagtaccagtgtgatcaaagcttgttggagtcaggtttctagaggaagtgaggtagagagaaagggacagctcagagagttgtctgataaagattgagaggttaaagagcatggaggggtggaggcattggtcatgacagggtctagggtataactaaggggctgagtgactaaaggagtttggaggacaagctcattggagaagagtaggcaaaggaacccagaggtcaggctattttaatgatcatttgcatggataataaaagtacaaagagtagtgttagagagtatgaagtaagccagtttttaaaatccccaaagaatgagggggtgtggctagactctggtggtatagcctgacaagctggtggtgtttagaggagaaaccatttggaagtagcagtgacagcaaggaagacacagggttttgctcactccactgctcccactgctcccactgcccccaccaacctagagatacaaggagtatgtgagaggaaacagcttataagggaagcagtgttctcaggggtgggctagatagtaagggagaaattgttctactaagaatctaaattatttggttactgaacctgaatgttaaattgggctctccacctcctggcagtgaaagtttcaaaaaaggagaaatgatagggtgtatagttttaggatctgacaaaagaagacaattttctcagaagaggccaacattttctaaaattccaagaatttttccaataatcatttttatatcccttgcaactggaacaaagcttgaaatatatttggaataaacttttttttaaccaaactcgtctgacacagaggttcataatgggcaatatttttaatggcactgtctgaaggtaaaaagcttaccttaaaccctaaagtaaggcatagtcctgaggtttctatcatcatcttagttttgaatctgagatgatcttttcaaaagtgaagttcattataaatctagccttagcagttctttttatacacagtgtgcagtgtattacaaggcactgagatagttaatagtttttagtattcactattattctttcattttgaagaggaaacctgccatttaaaaacatgcaaagctaattaaagcttttccactatttcattatctgaatgtagttgcaaattctgacttaaaactcttatcagagggagactcaacatctctccatgaacagcaaatgaacattcaattaacacttcaataaaagtgtattttaaataaaaatatactttattgttaatctcattctttacaaatgctaatacccaattttaacatccaaagagagtctccttccttttattcttaagggaaaaaagttcttttttctatttacagggaagacccgaattttctgaagttgtcatgaagttagaagagtgtctctgcaacattgaggtaaaagctttagcttctgaaatatgtccataaaaaagccctgcatatccaaggctgtcagggaatgtagatgagctggtgcttatgaaaagttactgtgaggacccataactccatccatatttgccctattcatkaaattcctatggtggagcagaattagctgtatctacagggacaaaggcaaagtcagagtgaattcgagaccttccaacaaataatagggcaggcaaatggacacagtcatgctcagcttaaaaattgataagtaaaaattggaaagtataacaaatacattagaaggtaattatttaatcaatttttatgcaaaaattcttcatacagagatttgtaagccattgttcatttacattcaatgcgaaaagaaaaattatcaataaaatatgttcataaattagttggaatgcattgctttcacaccacatatatgttgcttaatgtgatatatgttggtaatcaggctaatggaattttcttgccttattaaagctgtttgctttaagtttytytacaattgccttaattttytacacacctggtcaagagatagcatttcaaaataatcgagggagctaaaacatgcmcactacttgaaaaataatatattytcaaatggaaataagtgttactggtggaggaagacatacatcacacatagaggatcatatatgcatttgcatatgcagggaaggggcaacaatagagagaaatagcatcaacctgagattgcmccactaagtctcaaagtggaaccatcaagaaaagcaggattttttttctaaaaaaaaaaaaaaaaaaaaaaaaaactcamctaagagtcattggacctagtctattggaaaaggatttgcagttacagcctgcagtgagkggctctgtctcatgactctttgctggaatttctaaagaaaacttttgtgtaaaaagaagcttcagtgtttagacctaagatcctctttcccttctcttattcagtactgggacttacagaaagtggggagaagtagtcatatatttggtggggcttcagcagcccctgtggacaaaagcatctgccagaagccttgggtattaagagacaccttcaagacttgaatttaaaatatcctctcattttgaaacttagggtttgagtgagtttgcttcgagcctaatgggatagatatatctggaggtggattccagaaaaaaggaatccaccatgataggatctacaaacatgataggatctactaaactagcttgtcttattgtaatatattgatcaagcctcttatttatactctctccccaagggagaagatgaatgggctatatgctgacagagtttgctggactgagttgcactaattaacagatgagagtcagcctaaagaggcttgacttgcgcagtttcataagaccttatcctctctattcttcaacttttcagtcaacggtttagatcaaggccaagagggagctactcatcccatgtgcagatataawcaagttaagagggacagaaagtatttgaaagcaggaccctagatcttggaggatgaagtaacaggacatgtctaacaagaataattttaacaggaatacatataaatataatgtcctgcagcagagccaaagaaaaaataataaaagtatcaaatggtggagacctggcttaggagcatcatgaatgctagtggataataagctcattgggagttaaaatataaagtgactgtcttgctgcaaaataaaagatatgattagtcttgttctgaaatggcaaagtggtrtccagttgtgtctgtgagccttttaaaggaataattaaaactgggatacacattttagaagagagagatttgagtggtgaataagctgaaaatcacgtaacatgaaaaccggttgaaggagctaatgatgcttatcacagaaaagagataattagggtgagtccaacaggtttttgtttgtttgtttgtttttgagagagagtctcgctctgtctccaggctggagtgcagtggcgcaatctcagctcactgcaacctctgcctcccaggttcaagcgattctcctgcctcagcctccccagtagctgggactacaggtgcgtgccaccactcccagctaatttttgtatttttattagagacggggtttcaccatgttgaccagatggtgtcgatctgttgaccaggatggtgtcgatctcttgacctcatgatccgctcacctcaggctcccaaagtgctgggattacaggygtgagccaccacacccagccaagtccaacaggtgttttaaacatctgaaaaactatcacatggtaaagggagtggcctgttcaatatgggaaaagacttgccacacattaaagcatttttcrtcttataaaattgatgtattcttggaaaagtgtgtaaattcattttacatgaagggaataatttcatgtaaagggaataattttagctatgatttaaaggaactctgccataaatcttattgccatagtgaagaatgtgaagaatcttttgatcattgaataataaccttctaaatatattttatgaatctgagttgggcctactgtgtttttagaaagatgagcataaatttaacaggccagctctcagcacagaactgggtcaaaaaagtaaattaagctaggcagatgttgccactagactttttcctgaaaggaaaagccaggagcaagctgagtgaatagaaattaaaatatgggaaaccttggartagaaagttaaatccatattttatgttatgtcttcacacctgttggaagtattaaacaattgaaattgcccctcctccactcagctgatgtctcctgcatcaagtaacagcagtgggtctctctcaccttcttcttcttctgattgcctggtgaaccggggaggacctggccggagtcatgtggcagcattaagaagtcgtttcgaattggaatatgctctaaatgcaaggtcctatgctgctttgtcccaaaggtgagtggtaatataagcaaatctcacagtaaagtcttatttcagaatcttatcaagacagtcaactgatttgattactattaacagggtttgattaccccctgaaaaactttgaaagaggagttttcagcccatttttcttaygttatgactaaaaattagaaattttattatctgttagcctaggtcctctagttgcaagtaacaggcattaacctagcttaagtaagacacgtctatttcagagcaacaaaagggatttattaaaagtattctgaagctattttatggcatccaagcaagaattcctgtgtggaaaccaggaaacagctttgaggatctgagcaacagaagttcagcgttctaagaattaccatatgacccagaaattccattcctaggaatataccctaaaattggaaataggtacttaaacaaatacttgtattcaaatgtttatagagcaatatttataataaccaaaaggtggaaacaacccaaaagtccatcaaccaatgaacagattgataaaacaggttgtcacaacaaaataccatatactgggtacataaaacagcagaaatgtatttccgcagtctgaaagctggaagtccaagatcaggttcagcatggttgaggttctggtgcgggttctcttcctgttttctagaaatccacctttttttctctgtccttataaggcagggagagctctagtgtccctttatcttcttataagggcaccaactctactggatcagggctttacatttatgacttcatttaaccttaattatctccttaaaggccttctctccaatttagtcacrtgggaggctagggtttcaacatatgaatttgaggagggtcacactccagtccatagcaataggtaaatctataaaaacaaaaagcaaatgggtgcttctaggggatagggaggagggagaaattgggagtaaatgcttaattgtctcccagttttatttggggctgatgaaaagattttggaattaaaatggtggttgtaaaactgtgaatgtactaaataccactgagttgctagttttaaaatggttatttctatgctatgtgaactttacctcgatgaaaacagaagcaaaaacaaaaagattaagcaaaaaggtaagtcagaaaaaagagaaaaagaaatcaacattctttcatagctagctctgccattcacatgccccagttcccaatagatagtctctttgtctctcagcttaaatgttaagtttcaaagagaaatatatctgtcatataatgctataataattccgtataataacccatcccagaattcagggatatacaatcataatcatttatttcttgctcacttgtttgtgggctcattttggatgagcttgactctgaactacagattgcgttcaggtctattccttgggtctatcaacctccttggacacccacatagaaaaatgtactacctggggtatattcttctcacagacaaaggctagtaactcaagaggacaagcccaaatttacatgcacatttaaagcctttgctcaagttgtatcctctgacaacattccattggcaagtttcacagctgacttcaacatcaataggaagaaaaaatatacttgatttttagtgggaagaattgcaaagccatatggcaaaaggcatgggtaactggagtgggaatggggtcatagttcattaatataaatacggttgtcaggggcccctgttctagatggggagcaaagaaggcagtcactgtgagcttcatagataccctgaagagtgcatactttccaacccatggaagaccagaaaagactagtttaaaatctttctccgtccacgtgagcaccaaagcatttgcacacggcccagttacacatgcacactcacacccacacctgcatatacatacacactcatacactccattatcagagtaaaggttcttaagtgggaaaagattatctggagttagcaagggtttctatacaatctacaaattgcaattgttgcttttttagctgtagttattatattcctgatctgataaaggagttgcagctgcagctatgaagagatgggactctgattcgtgaagtctttaatctataaaatgtcatgaaattaagtattagtaggtttgattgataaccacacaaactggacaccattttttattggattttagtctcttgtataatttcaaaaggacccataggccaagactacattagatttggtcacatcatcatcttccagttctatcttctgttcttattctctacttgtgtcttttaaagctatttctctgaacagccagattttgatatttctaaagcacagtcacctgaggtttgtccacttgagacagaggttaagaggatgagctgtggaatcagacagatgtgaagttaaatcttggctttgccatgtactagctcaatgaccttgtcaagttatttaaatctcacatgtaaaatactgataataataccagatcttagagttgttttaaggagaggtactattgtcatagcagtgacagtacttgattgaaagatgccagcagaaccaagcaaagaatataggtccaaaaatgtaggcaagtcacagaatttacaatacacggagagctacacagaataggaggcacagcagcagtcccagttaggcaaatgaagggtggaggggacagagcttctctagccttcaagaatctagagatgtataccactactaatttttcaaaaaacctacatgctgggtgaaaaaacccatcagcttttttgagatgctccttttgatattctcataaagtgttttatagccttctggcccttcctgactgttatggaactctgataagggtgtatctgtctgctaggtgcaagtttctcttaacagcatggcatttccctgaggatttgctgtgagcgtgcattcaaggtcagtttgttagtaccattcctccgagtaagctcaatccttgcactacttaaaatcaactctaggaatcggtaaagcgtttagctaagttttaaaatgtgtcaaaatagaaattatgtatgttctattcattactgkatccttagtatctatctagcagtatgattggcataaagtcagtaagaaatatttgttgggcagataaagaataaaaaattggataaattggctcaataaacaggaattatttttcacttggtgtgtaatcagtgaatgagccttaactattttctcttttctttccatttaaatacctgtcactattgaacatcctgggcactattttaaacactttaaatagtcatctaattcagccttaggaagtaggtattccaatttttatagatgaggaaactgaggctcatagaaaaggtaagcaactttcccaagttaatggagagtaagtaagcaaagctggaattctcactcaggactctcctgtgctttctgagtttctctggcataggagatgcatgttccagaagcttgaaatattttgccaatacttgtatttgctggacttccagtttctcctggaagtcaatctgtgaataacttcgrctatttctcccaagcctgccttttcagcttgtgtatatgaaggcagaggaagtgagaacagcgatcaataggtgtttaaagtcagagagcccaaggatataaaaattgatggactaagtacaggagggccatgagtttaacagcttgtgagacagtggttctcaactttggctgcacattagaatcatctgggaagcttttacaagtaccagtgcccaggaccaattaaaccaaaacccatggggttggcacccaggcatcagaatgctttaaagttycccaggtgattccaatatacatccaagtataagaaacatgctgaaagagaatgatacgatgctaacctgccagtcattctgtaagaaggggatgcagctaatgagagaggaaagagaaagccaaggtgaaataccatctgtgaccaaaggggaccattttgatgacttattacgtgcatcatccctgccaaaattccttacaatgtaccactaacttctgatctttggatttcctaattaattcaagttacagagttaaaatgtaattttttagtatagcattatgattttgaaaaatcagtacaaggtttttcctatagtccctactaatgtatggatgtggggacacctcaacactgtcttgagaaatgatgcatttacttttcaatttttggtcatgaagttcacagatgataggtttgagttttgtaatgcttgattttatggrgtttttggttgtttgtatatttgtttctaattattattattctttataaataaatttagaggtgcaaaattgtgtcagagattttctccacagataataggaattccctaattcctatcaaaaccataacttgataaaatctgagattgagaaaggcactcttgaagttctgcctcttttaaaatattttgtgcctctagatatatttggaaaactaagcatgtggcagttgctcctcccacagggtatgaaatcccatcttgtacatggattacatcatgtaaatttagaaatgacaaactgatacacaacctttcagatgtgaaaaccaattagtgtttatgtggggctgggctctaagaatagaatgatttgacctagttagctgtccagaagaagaaaaccagggatccagagtttggaactgtaaaacagatacatttgggattaatttttcacactacaaaagggtccatcaaaggtttctttaaatagcttgcctagtgcacttagaatggaatgcagtttataaaagttgaatataacttataaaattttaatttactcaaagtttttctgggttacaacaattgtgtaagatgatagcaccatgacactgatgttcctakgaagaatgaagaagggagagcagcaaggggaccgtgtccatttgcttcagtatagcagatgtttaccagataacagtggccatgtctcctcctcatcaccccaggtcaaatactcccctctttcatctaccacctctcttgcactcttttttgtactaaaattttcaaatattcccttttcttccaatctttctatcctctctccatccctaacttcttgtcaactcaccacaatcagcaatttcagcaccttgctcatgaccactgtaaatgttctcaaacattgcttcctctttccatgggtcttcttgttgtttctacaatcccatggcttcaactcacaccacatacatgcacacacacacacacacatacacatgcacacacacacatctacacacacatacattcctccacacacacaattgaaccccagatcatttattcagccttgacctctctgcttcctagcgtttgcaacatctttaacttctctcctgttccagcttcctcatgctctaacccacctactaccatcataatttttattatgtagaactccaattctaattatattatttgcattaaaaccttcaataattctccattgcttctaaaattaagtgaattccggagtccaattgattcaggagtccgaaatcctcagtgatacacgttttcatcatacgttccagtggttctaaacagagagtgatactgtcgctctctctcttctcagatgcatcctaggctttttgaactgtgggaggcttttttgtttgtttgtttgtttgtttttgtattcccaaggactaaagagatgctattaccatttagtgagctgggaccagaatgttgaggtttctccaatgttttgggcaatctcaaaaaacaaaaaattatcttacacaaaatgacaatagcattcttggagaggaaaactacagacaaactagaagttccactagttcccataaacaccccatgtttatcctaccatcaacctatcactgtatcttaacagtttttttaaccttgacatcccccttatcttgtcaaaatattaaccagccttcagtaattatctcaatcagcgtaatcactatgtcatgaagaagtattttctgggggctaccccatctcgattcatgcctcactaaagaccacagcactctgtgccacgttataattcatgttattttttcttatgtgtcttattccctattagatcataaatatgttaaaaacagaaattctcttcttttttgttttgttcaggtgcctacaatatctcatttattatttaattgcatgtggtgaatattaaatatttttatttataataaactaggaaaattattagttaggctgtaaataccaggctttgtatttctgcaatttaagtgagtaaaactctggcattcagatttttttgactcctacattcctgtcaagttcaaatatattctcatccaaaaataatgaactactagatattccactacttttccagtcttccccccgactattagcacactaaatgtcaatatatttcttttttaattactaaaaggatagaatataggtgactaagatgtgtgaggagaaaagtgactaccacattcattccctgtgtgttttttaaaaaaaattttaatatttaaaacttctataacaaaaggtaatgttccttcaaaggtagatttcatgtgcagagcattaatatgacgcttattttagcatgaaataaaagcaaaacataatattctgataaatacaccaattattgactcattcattttatattctattaatgtgaatcttcattagagaaatgaataaataaacaagcaaaccaacagaacaatggacagaaacatcccaggaatgcaggtgcgtgcacactgggttacaagggacaaccagcatgcatttcccttgaactcagggtctttacttttcctgcaaatgggaccatgtctgattatttattatgratgaacactttacctagaatttttccttggctcaagcaatcctcctgcctgagcctcctgagtagctgggactacaggcatgcgccaccatgcccagttaatttttaatttttatttttgtagaaacagagttttactatgttgcccaggctggtctcctaaggttaaatgattcagcttcctaaagtgctgagattataaatatgagccactgcaccaggccccacaataacttttattaaagtatgttgttgtaattgttctattttattattaattattgtcaatctctcattgtgcctaatttataagttaaattttatcataggaatataggtataagaaaatattataytgtatattggattcagtaatatctccagtttcaggcatccactgggggtcttggaatatatccctggtagataagaggggagggggctactacaatttttatactcagcttgtatttcccaccaaaaaaatgagattttgattatagatatttaagcctataggtcaatatgaaaagatctgacatctttataatattgagttccccttaccatgaatgtagtacatttttgcatttatttagatgttctttaatatcttttagtaagagtttacaattttctttatggggttcttatataccttttgtgtgataaatagttacatccattgtgactgctgaaatcgtttggactaattgcaaacatattattttattctgtctagtattttttctcaccctatctttctatcttttttcctttcctttgattatttgaatatgagctatatttctattctttggtgagtaccccagaagctttaatatattatttaaaataactaattatatttttaatatgtttgtcttattcttaaatgaaagatcttagaccattttaattaaaatcattctctcctgacctctataatacctctttattttaatttccagtattttatcttcatcaagattttataaattccataatgatttcattgttttatacaactatgttttatttaggcttacctcatgtttaatgtttcattgtttgttatggttacatttcaaatctttcttctagtatcatttttcttttccataaatgcacctttaaaaattatttaagccttgggaggccgaggcgggcggatcacgaggtcaggagatcgagaccatcccggctaaaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtaagctgagatcccgccactgcactccagcctgggcgacagagcgagactccgtctcaaaaaaaaaaaaaaaaaaaaaaaaaaaaaaaaaaaaaaaaaaaaaaaaaaaaaaaattatttaagcctcactctgttggaagtaaacaaatgaaaaacacttatcttccctcttttttaagatatttagtagatagaggattttaattgttcagttacttttttccctgcaccttcagggggaaaatgctattccatgttttactttctttgttgctgttaaaatttcatctatgaatctaattgttatttcttttgtttttaatctgccttttaaaactgcttttaraagtcttctttatctttggtatcctacagtttaattatgttgtgtatagatataaatttatgtttatttattttacttgtgatatattatgtttccagaatttgaaaattgacatctttcataaactctggataatcctcagctgttgtctcttctaacatttctttattacttcttctttagtatctctttctggaattctagttggatattttttaaagtttctcactctattttccacatttctcaatctctttttaaaaaatatttcccaccctttactttctctatcctgctttctgggtaattttttcagatctgtcttccaattcacttattctctcagaagctggatttaatgtgttgtttactttgttcattgcatttctaattcaatttatttctaatttatattccagttctagaagttgcatgtcatttacaattttacaggagagtttaaaaaaagctgtagacctgctccatacttttcttcttttatttcttcaaacgaattttatctggagacattaatacctcaagaccaaccaaaacttcaacttggagggttttttttgttttgtgtttgtttgtttgtttgtttgtttgtttgttttttgagactggctctgtcacccaggctagagtgcagtggcacaatctcagttctctgcaacctctgcctcctgggttcatgccattctcctgcctcagcctcccgagtagctgggattacaggcacgcactaccacgcccgggtaatttttgtacttttttagtagagacggggtttcaccatgttggtcaggctggttgtgtattcctgaccttgtgatctgtccacctcggcctcccaaagtgctgggattacaagcatgagccaccgcatccggccaacttggagtttttcatagaacacgtgtagtaataattctgctttaaactagcttgtatgtgggctggcagatgagacttctgagggttatatatatatatatacattttctttttctcactttacctggagccaggaataatgtaagatatttatcctctgcatatctttatgtagagtgaattttattttttctgatttacctaatctggatgttgccctttgaagattttggctttatacaggtgtttcttatctgaccctccaccttgcttggacccatgatgtatctctaccatataatctattaaaattcatgctataggtcaacaagagtcagtatgagaacttcatagcacttatatttacttggagtgataatcttagaaaatcgttttcttttatattcatacccatagtagattgtaaacatcatgcaggcataaaatgtctctccttttgctgctgtttctccagtacttagaacagtgcccggtacatggtaggtgccaaacacctatttgtgatgtacatgaacataatgacttcccacaaacatgatgccattgaattcaacaatcttgtgaagtatgcctcatggtttctattttttagataaaacagaaactcaaataatgtaagcaatgcatataactatttagtagaaaaaatggtagttcataatttaatttgggcctgtccggtagtgttttcattacatcatgctatctctggagacttaactttgccaacatgtttgccaacaccagaacgttatgtcaagtttgggctttgaagagaatcagcagggagctatccagagtactgaactacctcgcacttaaactgccagatctagtggaacatacttccctctgtctatggccaatagcctttgattggagggaaatttcccttctcactctaactctgatagtagccactttgcctcagcttatgcctcctgaagaaacactataaatcacctgcctgtgctgatacagacccaaactgaacacaactccacagctgctgcctcgttcacaggcgtgccgtggactccctctgtatcttcttcaaaacagcctctcccaaacagcctcactctctgaccacatttgtaaaagtagcgacaaccaatcagagcacataaaaggatgaacttcttccttctaggaacttaactgaagtgacacttgtggactagctttgaggatagctctacttcagcatgatttctttatggaactgagtacactgtaaaattaggctcttcttttcacttcctcattaaacgtactctccactgtggtagccaaatgcagtcaatgaatgaaaaaaacaacaacaatcttttagctgacatttgtgggcaacaattgactttctggtgatgaaagtccaagagtttttcagggccagaaatgaagaaaaagaccactctttctcatgcataaatacaatagggaatcagcatcttttagctaattctacttagaaataattttaatatttataaatttaataaaaccaaaaagggtctttggctttctaacttatattttacttattcaaagaatgctgatttgaaatatgatatctatagaatttacaaaagactgtagtgcttattggaacattatattagtatctaaccctcacttcagcagtgtcttctgagcttgtaggaagagttgtctttcttactcagtgacactgttgacttaagttctatggatcttgtatgtataatgaggagaacaagatgttgcttgcctaaatctagggacaagaccatttttttttaggatagctatcatctctgagacgtaaaatttttatgacatgcacttcctgaacgtcagttatcaagctcattaagggcctgcagtggcaaaatataaaaggcaaaggagagaagctagaatctaagcaagtgccacgatgcctatcagttgccttttatctctttctttttaagctcataacttcttgaaatgcccataggttttactaattaacaaaatcagaaaatctcctaatgttgtggtggtatggggctgaaaagggaaatatataactatgcatgttgatgtgacagtgtgaaagtgtttggtatacctcattatgttcctgaatgccatcttatatagatgggaaaattaaagaaagtggggagtggtctttcacaaagttaaaactatctccatgaagatccaaacaataaacacagccatttactatatttacataacacctcttcaccgcatccctaggtgcatacccagacagcactatagtgaaatatacaagcaattcccttatgcacacatatacacgaaaagtgaaaggagggctataaattgattgctagtgccctctgcattgcatgcttctggtatcttacaaatcaccagaattggacatagtctgtgatgaaaggtgatagggctctatgttaagaactccttttcggctgatgtggactaaagtaaccatgttagctgcttgtttttagctgccttgctctctaacgccatctagcagtcagttgccaaaccacgagtgaggcctcctccagccctcctgaatgctgtactaaggatagaggcttggagacttcacgccgaacaaaggtgtgcagcctcaaagttgaggagcatgtgaaaaatgtcaatcttttccttcacttttaaaaccacccttagtttgaaacagcctttcgccatgaaaaatgtaaaagaaagaacatcaaacaaaatattctgttcaaaagaggaggtgatgaaaatggaaaattaataaaagtcaagatatgagaagagccctacgtgtgtaaaattgrcacctttaaaaaaaatttaagtacctggatttattgtcacacataaaagatttgcatgaaaagagtgagcgagtgacatatttaggttacaacatatccacctgagagagagaatgagatgcagctctcaccgtggctattctgatgctgtaatttcgtgttcttttctatccgtcagcagtgcttgttagcgacctaaaatgcactccctcctaacccaaagggcgagccagagtgcatttccctcttcaagcgttttgtaatactaattaactaattcccagccacatgaagagaacctgcgaagattcgccggaggcaaactgctaaataaatggtgacagatttctcagttttcaattagatgaaatgacatattgggacaacgaatggcctgactttctagtgatgagagttctatgaggttttcattcctgaaaatgaagagaaaccctctccattcatacasaaaggagggcccgggcccactcttaagcacatcaaagcacacagatcccgcctttggcagttgcgtgtgtgtacaactgaaagtaagacttggcccaaaaatgctgcttttgagactgcttctgctgtcctgaaatatctgacaggacaagcacagggaccaaagagaacaaccggcctaattaaatctatacaggcagcactgtgttctgttcatcctccctgactccagctctggcctcgccctgctccctcctgactccagtatttgtgttgcgaagctgaatctcttgctagcatggcaactgttgctatgttcgcagcaataagaagtgggtgatgctggtgtctctgtaatgattcagatacaagagcaatgatttctaaatagatttctgaagcagctcttacaatggctctgaacagtttaacaggtttaattcctcatggattgttttttctttttttcacctttaacatcttccatgtggactatatctaaacctcatataatgcaaaaatggcatcgttcttccttttgcttactcgtatttgaagcaggaattttcttgtaaaaaaacacattaaaccagttgtcatttctcattatctccttggaacctatgagatggagtttttcttgatatttagttaatggcaactaacgaaatctgaaaaaatactggacccaggaagaaaataactcctgaattaaccaaagtggaatgaaaatcttcaccattaatatttgtgatattagctgaacattttttattaatgtgcagatgttttaaaggcctcatctgcaaacgagtacaaaaaatttactagtggatatatgtttgccaccctgacttctctttcaaagagaaagtaaaaaaatgaaatcactttttgtttttttggccttcatcagtctcttatttgccagcccagccagtgttaactatgccactaagtgtcaccagatgctaacacagcccgggtcctagggggatatgatgtagataatattgccatgtgcactgatggcaatacagacctggccaaaggataaaaagagaagacacgttacatgttttgatctgtgacatagaacagaaatgtgtattcaaacatagacacttagtatgttctagacgctattgtgcattttttgtatgcctgtcgtagcacagacttattacaactcttctacagctaagagttatttatcagtattctacaaatgagaaactgaagcacagaaagtataaatggcctgcccaaggctttgtaactagtaaacagcagggccaagatttgagccgagatcagcctgattccaaagcccatgatttttttactacttgctgagctgctatagtgtgagayaagagagctgctctcatactaatcagttgtgtgacatgagcaaatccctttctgccctgggttttaggattatcatctataatgaggcatttgaattggatgcttgctattcaagctgtgactcacagaccagcagctctggcatcacctaggagcttgttagaaatgtacaatctcaggccccacaccggacctgccgaatctgcattttaacaagattttaacaggcgacttgcaaatatacagtaaccaatctctggggaccttttagttttagtgtactgtatttagaatgtcaccttgctcttatctctttctagatttttttccttctccaaggttgttttactgctccctatgagcattcctaatctcattcttacacttgatggaaagattcactgtcttctcggaaaagatttatctatcttaattcatttaccactttctacttggtatcatgtctctgttgaataagtttcttgagggggagagccattcatattaaataatttcatatctgtaataccaattgacaaggttcattaaactaaagaaaatatattgaaaggaatgttgaacaaattattatcttaatttagttacaaatattacatagtgtgctgatcgcaagatccctgtattattcattacaaatatttcaaggcaagcacaatccaagttctttaaatataggtccaggaaaatttgcaaatatcacacatgatgagcagtttttaaatttcttcaccccccccccatctttttaacacaaaaatacataaaggattcaattaagaccaagttcaatcccaatgtctcctcctgtaggaagttgtcctaaataccctcaactagttacccatcatgtttgctgttactatattctgtacagatcccatcagagaatagaaacattattgtaattattgatgtctttgtatgtcaattgccatacacacacacatgcgcacgcacttacacacagagtaagcttcttgaagccaggaactgtgtctttcatttttgcattgttcatatttatcacaatgcttggcatatagtgtgatggatatatgtgtattgaatgaatgaatgaatgactcaatcaatacaaatctttctggccccaaagtctcttttttgctttaatgtacttcttgttctccttcacattaggatggttcactgacaccaacaacatggagatgcacagttctatggtgagaatttcaaagaacttgttttagccatgttggtattccctactaatatggtactttagtgtactatggcatgagctaccgtcatccaggaacatgggctctgagacttaggaacttaagtacctttgaaattacaaaggctgaaaattgaagcagcgtttgtattttttcctctctggttagtcaggtgttcattcaacaaacatttgcagagtccctatattgtgctgggagtttgccaggaaccaaagatgctgaaaagcaaacatagtataatatttctacctttaagtagtttgtatggaaaatagaccccaaatgtattataatgcaatgtgattgtatacaatgacgggcacacgactctagtgtattctaacacagacggaggcattactaagaaaaaggagaggcaggcatgtggatagcttcttgcaaaaggtggccttgccaaagagatgcagaaatacctaatgtaaatgatgagttaatgggtgcagcacaccaacatggcacatgtatacatatgtaacaaacctgcaccttgtgcacatgtaccctagaacttaaagtataataaaaatagtaataataatagccatcataagtgtaaccatactgagttcttattttgtaccagataacaggctatggtactttaaatgtgttatctcatttaatcttcataaaaataaagaaggtattatgattttttcaatttcacagatgagaaaaaataaagtccccaaaatacaagtggcaaatgcctgatgtaggacttaaacctggccagagtagttctagaactggtgaatctggacaccaaactccacaaaagacagagagaaaagggttaaaaaatagcccacaggccaggaggcagactgcattcagaggataagtagcgaatcagtctgccagagcggtagcatgggagactgcacacaaactgagaaaaccaacagcaagctataggtcagagcccaacccggggcatatgtctggtagaagggaggctcaggaggaagggtgctttgctgataacataagtgggagttagtgtgctatactgggaaagagcttgcatcttgaagccagaggtatgtgttctaatcccacctctgcctttaagaacagtgtaaacttgggcctcagtaactaaaatagggaccataatattaccttgtctggtttttacagggtctgcagaaaattcatataaaacacttaatatcatccctgagaaacttatgttgttttgttttaaactaaagataaatgtccctatttcacagttctacccacggatggataaacccctttctgagggtgagaaatgaaagcctgtgtctatctgaaattcgggatccttattcagacactttcttcttctttttatcacttattctctttgagatagtagagcactcctttttcctcattaaatagcagctttacccataaatttctcacagcttttccttacttatttacactacttgattgtcaaatttgacagtgttgaccattcctcagtcaagttgccatttggaataacttaaaggtttctggatgttttctacccagcagctatttatgacaatgacagaaatcaggaaaatgacatttgagggtttcaatttttctctataatccctgaaaataaagcgatagtcaattgtgaatgtggctgctgaatgctagagtactacataacaatagaaaagatttaagatgcttgagaactaacaaatctaaatttattggttttacacaaatgaatgattttcattttattttaaaaattgtcctttattgtttagggcaagataaatcgtatactcttttcttcaataatattttatcagattaacatagaggacaatgaattatgaaattatgaaataaataaaattgaggacaaagcaccaatattaaaatgttgattgttgtttttgtcatgtcatatatgttaaggaatagagtgttgtgtttgattttgaaaggtacctatgaactgctttctggttttgagtgatctgaatttctttttttttttttttttttttttttttttgagacagggtctcactttgttacccagtacagttgtgcgattatggctcactgcagcctcaacttccccaggctcaggtgattttccctcctcagctccccaagtagctggaactacaggcatacgccactgcacttggctaatttttgtattttttgtagagacagggtttcaccaagtcacccaggctggtcttgaattcctgaattcaagcgatctgcttgctttccaaggtgtgagcctatgcgcccagcttgaatttcaatgtcacagattttctattgcttgtgtattctttgggtattttatttcttttgtaaaaggtagacagttctgagtttaaacatgacttagagatgtttaactacatttcttaccccctgatttttacttcctgagatcagtagtagagagggcaatcagttctcaccttttaaaaagatctgaggccaggtgcagtggctcacgcctgtaatcccagcactttcggaggccgaggcgggcagatcacgaggtcaggagatcgagaccatcctggctaacatggtgaagccccrtctctactaaaaatacaaaaaatattagccgggcatggtgcctggcgcctgtagtcccagctactcaggaggctgaggcaggagaatggcttgaacccgggaggtggagcttgcagagagccgacatcgcgccactgcactctagcctgggtgacagagtgagactccgtctcaaaaaagaataaaatgagaaaaaaattattgagagattgtcaaatctcttgaatttttaaaaaattattgctcattaaattaaacagcaccttgtctataatttgttcaaaactaccaactaccagatctatgtgttatactttgttaaataaacttccgtttctctttgggaaagacatatataggatcttgaacagtatataaagtttaattaaatatggctagcattgaaaagttcatggaattaatcaactagctcacaaatgtgtgttgatttccctctaggtacacagcactgtgtctgcccctacccagagaggcccagtattttgatagctagtcttgtattcttgtataaagagttttagcaaactgaatatgctttttttcttttttgagacgaagtctcactcttgtcccccaggctggagtacaatggtgcgatcttggctcactgcaacctctgcctcccaggttcaagtgattctcctgcctcagcctcccaagtagctggaattacaggcgtctgccaccatgcccagctaatgtttgtatctttagtagaaacagagtttcaccatgttggccaggctggtctggaactcctggtgatcacctcaggtgatccatccgccttggcctcccaaagtgctgggattacaggcgtgagctaccgtgcccggcctatttttttttttttccgagatggaatttcgctcttattgcccaggctggagtgcaatggtgcgatctcggctcaccacaacctctgcctcccgggttcaagcaattctcgtgcctcaggctcccgagtagctgggactacaggcacacgtcactacaccctgctaatttttgtatttttagtagagatagggttttgccatgttggcctcgaactcctggtctcgaactcctgacctcaagtaattcactcttattttctttatttaaagaattaacaatatattacttacaggtggaaaacacaaatgtatgtgtcattttccctattacgctagcctcttcactgatctaattccattggatatgcatttatctatcatttattaagcagctcttatrtattgaatcatgtagtaaatattggacacccaatgatggattagagatctcttcagtcctgggggaattcacagtttaagggaggaggtcagagaaacacacaggaagataagtactgagccatgtgtaggaagccctgtgagcctgrgaagagtcaaggtaggcttcccaaaagccatcccgtttcacttgagtttggcagagttaaccaagcagagaaaggaagaaagagtgtactaggaaagggaagcaacagggacaaaggcaggaaagtgggaacctgcacagtacatttgggaacagcaaagggttgagtgtgggtagagcagaagctatagatgaggatctaaagtcaatagaagtagaaataaaagaacatggagtcaagtaagttcagtacccaaggaaaatcggaaggaagagggcarctttccttcatgcagcttcccttccagtcactgagacctcagactcttctcttcattcaggcagtgagcatgaaaagatctggatgggactggatatagcagccaccagtctttattgaaatagccctggggcaygactcgaacctgtgagggaccataaagggscatgatttctgcagctgtgtttactgtcagtgattgtacagactcaaacatggagctagggataatatggtaatctagatgagacatgagtgacatagacacagtagagctccaccttgaacccaagattggcccctagaactgtgcaaaacaggcaacactgcagggtggctcatggcactcaactattcctgcactgatgacattcctgtrctgatgacatcacccacatgatcatctgtttataagtctgtctctttaaatggtgaggaaagagaaataaaggtgtaaaaatccagccatcataacaaaaacaccaaaagaaagaaattaacttacccaaaggtctcacagcttgtagtttgtgaatctctacattaaaaggtggatgatgaatctgagacctactgagttaactgtccagcatctcagccatatgccttattcctctttatatgcatctccactcccacaccaccccctcctggcttcatcctttagtgcctggaataacgcctggcacatggtagttactcatcagaagtccactgagtgaaagaacaaacacctaccactgacgggttgctatttataccattctgtcttcactgttgggagcttcatactgtattcttcaaaatgggcaccccctgcagcatgcctcactctacaaggaaaacttctctgttaacaagccttatgatggggtcactatgtgatcacctaaagctggccttttctgtccctcatccgggtaaatggctcaccgtggaaaactatagacgacttttgccctttcactaacattcctcttgataagacacttaaagaggaaaatagtcttgactctttaaagttgatgccagtttggggctgttaacaaagtcaagggattctgttgttagaatcaacctagcacacagcttgctcagtcgatactgtttcactggcctgagattacagcagaggtaggtgcctaagatgaggaaatggttgtggagaaagagtccgaatgacccagaggtccacgtgtgctttcctagttcgtttattcagctgatatttattgagaaattataccgggatgtggaaatttactgagtccctgtcctttcattattttaatccagtgcactaggtgttcttatcagagtgagtccatgaaatgttggggatgcaggggcactggtagtaggagttgagaacctgatgatgactgtctttgcaatgttccctcagaagaaaaggtttgtgcagaaggcacatcccacttcagactcctgcacatctgcagagaactttgcattctcactgcaagaggagttcctcttcctttcatttttcttctctttgtcttcctttttttctctatgccaaacctaagcaaatctgcttcatccagaggcagctggcgctactatgtgggagtgttaaatgtttaacatcttgtcacttgcgtaactgatggagtcatcctttttgtttcagagtttcatgtttaggggttgaaaagctagattgatgagcattaccagagagaaatattttttggaaagtaagtgaagctgatgacacattactttacagtttagtgaawttcagcaaatctaattctattatcctgtcaaagtttcacaaaaaggagacctgaaagcatattttagatgaatctttaaagatttcaagaagccacaaccgcatctgcaaagctcagatgcatctggtgctgacagacctttgtttttctatagactaaggggagtaaataatcttccaaaaactaattaagtaaagttatctttggttgtacagtgcctgcctctctctcccttgaaaaggttgtcagccagtaaacgataactgcgtttttcaattcaaaggctattcgaagtttgcatagccaaatttacccaggcacaccaaaatagaagcttcctttatgaatcatagagtcttgtaatgcagattttatagagcatttaaagccagatcatttatgtccttgtttattttcacaatcaagtataagatacggtctaataaatacattctgaccaaaatgctaggagcaattgttttaaagcgttttcacacaattctatgtatttgtcagaggcttacaagctgacaagctgaaagcgctttgtgatgcttttggcaatttgtgtgattgtgtatacacttgcacagaagttccttatcgagaggaagcatttaagtaaaaaggggagcattaatgaaaaggtccattttaatagaaattgctgttgttctctactatctaacaattattcacttaagaagaaaagtcttgatagaatttattgagaacctactatgtactagtacacatattattaatataatatccccaattatttgctaggtagatattatctccattttgaagatgggaaaactggtcaaaacaggaaacatcttctgagatagtaaggggggaagctgggattgactccagtctatctaatcccaaagccatgtgtgctctttttaggacaccataagaaattctgtttggaactcatgataaaaaacaagatcaagactgtggtaaaaatgtgaaggggtattgtgggttgaattgtatcccccaaaaagatatgttgaagtctcagaccctggtacctcaaaatgtgaccctatttggaaacagggttgttgcagatgtgagaagttcataggagtttatactggagtagggtgggcccttaattcaagatgacttgtgtctttataagaagagcacaaagacacgcagaagaatggcatgtgaagatgatggaggcagggactgaagtgctctacctagaagccaaggaatataaggatcgtagccctcaccagaaactaggacatgggcacagaattttcctcagaatattccttcagaaagaaccaaccttgccaacaccttgactctggacttttaacctgcataacagtgaaagaatacatttctgttgtttgaagccttcaggtgtttggaactttcttatggcagccctaggaaatgaatacagaggatgacataacttcatagagcttaggaagaaaacaaactccagactgaatgttaggtcagtgcccttcctgagggtcatagtcatgttatttttccttcatcatttgggactatgcggaaaacccacacctaacccagtatgagacttgaaagacattttttggtgctttgtcagaaaataaatatatggttaaccaaagttaaggtgaaattctaacgttttatcatgccaatacatatagaaatgatactaggaaagggtgtgctatttgactgaagtttctctgatggttgctgttggcaaccagttttacaagaggcacaagtctaattagggcagaagtcaggaagagattgcaagtaattgaggtcagacataactcagggtgggcaggtggctgacatccgatgtagtcaaactaaggggatcatggtttgaggtgggcagacacaacaggtgagggatggagactgaacactgatggaaataactaaaagctgaatctggcaatgacattcaagtaggtcaaaaaataagtatgataaaagctaagggaaatctgaggtttttctcttcagaagcctagtcttcctaaattggctatttctttagactggagatcattagttattwaaaggactatacttacacctrccaacctaatgccccatagtgccagtttacctcctggctgccttcaaggttctgatrtctgactcagttgagaagaagggacttgcctttgcagaaaatgtaaatggagagagtagtactgatgtctttaggagcctcactagaggggaaggaaaggacaatcaacttactggtgaagccatcttctgtggatctttgagttggaactaggctgagaatgtaggtctgaagtgcaaatcatccctgttcttattgataataactctggtatttcaaaatttttaaaaatatggtcatttatttctgttctgaaatttcccattagccaggaaaaaaaattttgactaatgttgaagactactcaatgaatgttgctatccatttgtttgttcactcatctgctcaatcactatttacttggatggggaagggattcataatttctagatatgttgctaaatgatgaaaataaaggaaaaataagacatggtttctgacttaagatgagaatagttgagtcaggaaggcaatatcaaatccgtacaatacaaggcatgaggtgtcacagtaaagagatgaagtccttttactgtggggcttagtatgtgagaaaaactgtgagaaagaagttcattgtgtgtagagcctgcctatatgaggcagggagcaatagaggatgaggctggagaaatagacccaggcctgctgcttgagacctggaccgtgggaccttgctactatgggccatgggacctcaacagtaagtggcatggtcagccacgtttaaaaagaaggacatttccacagcttggttgaggatggcttgtatattccccatcactaattccagcattatttctccagtagtaataatgaatgtgccctcatatagccacatttccccaacccttattataacaagttaaggcagcttacttctgggatttttcagtgttggaatattctacatagatgaaatgcccttattgccagttcacaaaaatgatatcaacaattgttaactacatgatagacagtattttctccagcaacctctctacagaagtctaaaagaaatatttacagtcatgctcccatgagcatcattatgagaaaacactgatagcaattcaaaaaaataaaaacagaaacattcttgtccccagctctgttgatggggattatttaattcagcttttcccccacccctattttggtagatgctgttcattattatgtattacacaaatcattctcaacacctgtgggcactttctatatgcaacatatcttgtaggggtaactctttaaaaaaaaaggttaataacattaatccaattttacagatggggacaaaagacaactggtttattatattctgtcaggtcagatagtaaatcaatgcctcattaacgttcattagaattttcactccatccaatttcaaactaagcttcttcttccctaaggaacttaattagtatcaaaaattttctggcattagctcctcactgattcatatgtcaaaccttcaaacacttacttgagcaaggtactgtgctggtggtaccaggctggacaggaaatggtaaatgggtcaactgagccagcatgtagaaagcatttagaatcagagcaggagtagcctttaataataattgttagtaataatggtatttatggagaactccacatgtgggggctgtgtgctaagcattatgtataatctgctatgtccaactcacagtggcaacctcaattaggttctatttcattgatgaggaagctgaggcttagaaagtgtcttgtgtaaagagtacgactggtaaaccgaaaaaggatttgaaactaagacatcttagttcatcgtctcaatcacaaagccagtggctctcaaaattgaaaatgcaccagaatcacctggaagattttttaaggcaaaaactgctgggcccactaccagagtttctgattcagcaggtstgatgtagagtgaaacatttgaatttctaaccagttcccaggggaggctgatgtcccaggcatcacactttgagaaccactgctctagctagtacttaaagtaacaatctttgactgtggtcagcatacggtgggaagtcattcaaagtttttgagcaagcgatgacctcgccagaatagcacttttaggagattaatagggcagccgtgtgcaggttactagaggacagatggtggaccaggaggttcccaggtaagtcaagaagaagcaaagaaatgataayagatgttgagaaatattggcccagtggagtagatggagagggtttgctgatcaatggaggaaaaaagagttgtcagatgtgacagtctgcttttcagtctggatggctagaagaatcattaggtcattaacagaaattgaaaggagttcttcttttatatttattttcatctcctatttccacatagcctcttactgttcactcctttcattgtttttatttatgagatttccacagcattttcgttcttcttctttacctaaagggaccaatgtatctaaagggcagttatagactcttggttgcttctgagatgcttttcttacctcaaggatctctgattctcccacctcaatatgccttctttttagggtggctctatggttcccactgcttacagatctcagtggattctactaatcgtgacgaagcttatggttcccgtgtttcacctgatgcctgcctggggagcacactgtcagtgcagaggcttcataatgcatcgctaatagtgttttcaaaacaatatctgttttttaagctcaaaattattatattagtgttttgaacacatattttgcttttatataatttatttccataagtaaagggtgtgtttttaaaacaacatttacaaatatggattatttaaggagtatttagtcttcaatttaaaacaaattaccttactttattttttattttattttattttttttcccttttttttttttttttttttattatactctaagttttagggtacatgtgcacattgtgcaggttagttacatatgtatacatgtgccatgctggtgcgctgcacccactaatgtgtcatctagcattaggtatatctcccaatgctatcccttccccctcccccgaccccaccacagtccccagagtgtgatattccccttcctgtgtccatgtgatctcattgttcaattcccacctatgagtgagaatatgcggtgtttggttttttgttcttgtgatagtttactgagaatgatggtttccaatttcatccatgtccctacaaaggatatgaactcatcatattttatggctgcatagtattccatggtgtatatgtgccacattttcttaatccagtctatcattgttggacatttgggttggttctaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccttactttaaaagtgtaatttttgaattgatttttaaactaaaatcataagaaagccagaatagagataaaaacttctaagaatcttttttataaagtaaatagtcttacaaaataaccccacagaatatatctttaaaagaaaattacattttatacatgaaatttttctaatgtgaggacaagtacctataatgaagatatgttatagtcaagccaaagctttaagtttataatgtgtgtcattcagaggtgaagggaagattgaatagtccacagggtccctgtggcagtgtgggtgtcctatctgtgggagcacagatccaccttctctgctctggatgccctgactggacagcatgttcttacagctatttctcctttggatactgccattttctctgtgggatcttgcccaagctcatttatgtatttaattttttatttccataagtttttggggaacaggtggtatttggttgcatgagtaagttctttaatggtgatttgtgagattttggagcacccatcacctgagcagtatatgctgaacccaatttgtagtcttttatcccataccccctttccaccctttccccctgattccacaaagtccatagtgtcattcttatgcatgtgcatcctcatataccttgattataaatgataattcagtttttcaaaaaattgactcaactggaatcttgagtgtgaaattttaagatatggcatttaaatacacgtacagaattgaagtgacctcgcttccgacttttctgaagaatttgagactacttcgcgtgagttccaccacctttcttcctcagcccctccagtctctctgtgactccatggattctcctctcttctccttggatggagaaatcgaccttctcatttctgaggcccatccatccatctgtttccctgttacctcttctgcctctggctctttttccctcagtccttgcttgtctcttttgaccttttccttcctccctttccaaaatttttggcaaaacaccaaaatttttgtctcacaacttcaaaaaaaaaatgggaaaaatcaatccttctttaaatattaactgtatggtctgcttccatttttaagacactgagaacaaaagagaaggaagggaggcctggggcatactatgtggtatttgggacttggtctatgtggcggtgataaagaaaacagtcccctttgagttgcaacatgtgggttgcagctggggtgggtgtaacagggctaagaagccccttatgaaatttagatctggaaggtacatatggagctggctcatcttggggaggattgcttggagctttaatttgcacagttgtgaatagtggtgacatgggagcagaggtgaagggaagattgaatagtccacagggtccctgtggcagtgtaggggtcctatctgtgggagcacagatccaccttctctgctctggttgccctgactggacagagtgttcttacagctatttctcctttgggcaacagcttcaacttcagaatatttttagataatgtcctctctccatcaccacagaagtttgtagagctgaaattaggatatatttggaggttgtgtattgtagttataaggagcatgtgctcccagtaggactggctgggttcacattgtggcactgccattttctctgtgcgatcttgcccaagctcattaacttctttctagttgctctttgcttcctaatctataaaacaggcataataatgatacttacttcatggttattatgaggattaaatgaaacaaactatgtaagtcacttaaaacaatacctggcacatagttactgttcaataaatgttaactattttatgaaatatgtattctaatgcaataaatccttaccttatctctctcacacacacacacatgtaaacgcattatgtatgtgtgtatgtgtatatatatatatacacctatatatacatatatgcagtcaaaattaaatgctactatttccataaagcctttttctgcgttcctttatttagcaaatgattggtaaagacgcactatattcctagcatggaggtcacagtgatcagcaagacagccctagtcgctattctcgcagagttggtgaacaagccatttcagcaaagcgtgataaatttatgataagaagggcacagggtctcataaatgaatacatgaatgaataaatgggtgagtgaatgtttcttgctatttctactgaaatgttaagtgttttgatccctgagaataagtcagaatttctttaaagcctgtgctggtctattcataatgccatttctgctatgaatcataactactcaaaagcccagagtgattctggggctgcatccaactgttgttaatcttctaaacaggtaactgagatccaggtagagtaaaaaaaattcagatgagggagatatatcaacatcccttccagtgatagatgacagacagtaattactatctgccttatcacttttccaattctctcatgctgattcgctggccagggattgttctttttaaaaaaaatctggttcaggcactattggaaacttaatatagcaggtgaagcattcagacccttgatgaatcagggccagacacaaatacaaggttatagactcaggggcttcaaagagagacatttaggacagatctgctcttggagctgctgcttgtacttgctaagagccagaatccaaaggatgcagctgccgcaaatgtgcataaataaaggcagtgagttcctagcattcctatgggaacctgcagcagctcagattacccgttccctagacaggatttcctttcagcttggtgtctcatattaaaaggtagaccaaggagtacacttccagaatggtgcttggggaatacttgtagtacgagttgcatgactaattctccccacgcagtatagaagacctactcctgagggtattatacatttaaaaagtagcatgaaaaagagagaatctgtctttttcctgcatattcccaaaatgtaagtagctgtttttctggtccctaaggtgtatgtgtgtgtgtgtgtgtgagagagagagagaaagagaaagagagaaatgccccaggaagcaatcccagaataacatgattcattttctgattggaatattgatcatttgattcaaatctggattaaaactggtgtatttcttaggttgaaaatctgtagtctttttaccttagcccctggctttatggaaactttacctgtagaaggaattcaagattaaactgtgaacacataaaatccagcactgcgtgatccaaagcttcagtaggttcatgatcagaagcctacacttctaactccaagcccaactgcccactggaaattgaagaatccaaaytactaatgagaggggaaaccccatgcattcactacagcagatcacaaggtttctgtaatacagccatgttgtggagcagaaaagcagtgagcttcagtataggttctgtctgattcctctcttccctcttacaggccaggtgacctgaggcaagttgcctgaccaatttgccctcagtttcttcaagaaaacaatatatataataataccgataccacacagttgctgggaagattaaataaggaattgtatgtgaaataaattttctaacacctatgatttcaaaaaacacatctatagacattatctcacttgatacctcatagtggatttctaaagacatgtatcatcaaattttgagcatgatatttgtgtttttctatacacatatctaagagaacaagcaattttttttcctttattgtgtttgtgtattcaaacatacttggctgatgtataagatttttcttttttttaattttcttttgaaatgcccaaaagcaacaacaagaaagagagaaagagaaagagactcacttaaaaaaaaggcctcaaagttataggctatgcctggccattagctgcttatagtaatttcggtgaatatttagacttcagctctgccctcttcatgagtctagctttgcagaggttgagctcctactgtatgccaggccctgagagttggcagtgtctggtctggtatgcagtaggtgatcaatacctatttgttggtaattgctaatacaactttgaggttttctttggtcttggggaaacagtgccctgtggcatgtggttttctttttttaaaattatacttaagttctgggatacatgtgcagaacgtgcaggtttgttacataggtatacatgtgccatggtggtttgctgcacccattaatctgtcatctacattaaacatttctcctaatgctatccctcccctttccccccacccccgacaggccccagtgtgtgatattccactccctgtgcccatatggagaacaaggcaattccatcaagccacaattccaaaggcatgactgaatgtggagttgttgctttcaccaaaaattgtttttgcaaagcattgacatttgtcaagagcctaactgtggccagccacaaacacagtccagtagtatttgtggcagtgcccacaaaggctccagtgaattcttctttgtgaaaagtctttaaaacacagagtaaccatgtagcaattaccatcagaagtatttagaggcattctgaagagtctgttgggaattttaacagcctgatctctgccccattcagatggttatggtaacatgcaaagtgaatagctctgtgggcctgccagaaacagagggggcttggcccattagatagcaaagtgcaagtcttctgcacctgacactgtgcggactccagggctgctgtggagtttcactggctgtggccacagctagagtatgtagggccaactggtgactaactgtggaatctccacacaacttctccctattaaaaaattgcacaggaaaatgcattaggaaaaagtcacataaatctcttctggaatgatgctcataaaagatttgtcatttttcttggttctaagagcaatgggcatactttaatctaatgtattcattcacttagcaaatacccaaagcttttacttttaggttctggagatacagcagcaaatagcaaataaaacacagaaaataatctcttccctcgtggaggttttattctaatgtgagaagagtgacaggcaactttttaaaaaagtaaaaaaaaaaaaagaaaaagaaaggaagtaaaggggctgcctcatgaagggggacaggccactggtaggacttggagatttactatgattgagatgcatgccactgcaggggtttgggcagagaggtaacatcattaggattgtttctaaaaggattgctctggctgaggtactttggggctggaaagagaggtagccaattaatttgcttttttatacctactttctatgcattcaattatatagtaagtattttacttagcatgggctatgagctggacactggggaaagagacaaagaatgaaagatgagattcttcagtgtgataaaaaacatactaaagagggcacttaaccaagtattggggagagagaagctgaggcctgaaagataagtagcattattcagtggaagaggggaaggaaagaatgcagcaggcataaatgagaataagaataataacaataataaggtagctaatactgagcacctcctgtgtgttagggattcttctaagcgctttgcgtgtataccatctcatataattctcacaaatacctacatgtgtgataagtattgttattgtcctcatggtacaaaaaaggaatgtgaggcacaggaaggtaaaaaattttgcttaaggacagcagctaggaagtagaggtgcccagactgaaaactagctcagtctgattcacaccctgagtccctgaccacttggccaactgcatagaacattgaatctgagagatgaggctgaagaaatgaccaggagctcagttcaaccaaatttatttttaaaataagtgttgcaagtaaactctgtgcccaaatgccaaggctacagagataagtaacaaagcatggctcctagtctgaaggagtgtgcttctggtgtgccacatatcaaagcttaataaataaccaatataaatatgaccatggaggcctggatgtgcasaaggccacagagaacttcttacagcatccacagtcatggtcttgtcaatacagaagccgggagcagcagttggcccagcaggaaatgtcaaaacctgggttgccccaggattcaaagaggcatcacagcacatcacaccagagtggggtaagaacccccacattactggcaagagaagaggttttcaatgagarcaaggcaccccagctacataatatcattttgttattcagggtctgacrgcaaagaatacacagaggaggagaggaaagctttggtgttgtgtgatgaggcaaagggtcccagaggtttggtatacattcgcttaaaacaaaacaaaaaaaacagtgcttgtaattttgtaacctccttagggtatttcaaatggtttgtgaagatcaatgttctgcatgttcaaagagtttagggagttttaaaaccttcccatgcagactggcttgtcataaagaacaaaggaacatggaatttcttgcagggatgtgaattcacacaaaggagcccagagatctaaaatcaacaaagatggcctttgaactttcctcaatccaaaaggggaaaagaatatgtattgctctgtgggctccaatctagttgctgcttttatcttccatcaataaaattggttttgtgatttttatttatgtaactacccagtggccattgagtataaagtagtgattaaaagcttgggctcagatggacctgagttcaaattcaagttctacggttcttataacctgtgactttggccaagttagttgagctctccaagtctcaaatttctcagctataggatgaaaataagaatatcatcttcttcattaggttgcaatgaaggtgacgtgagaatgcaayttctacatgtctaatatgtggtaaacactaaataaatataaattggatatttttttctgttttccattagctcatgcattttagtctttaacattcctctcctaggagaagctatgaaaatctaagatgaatggagatcctacattcactgagatatcattgtttggcccaaagggagaaggcagcttaggagagcaacacgtataggacttatctgacactctaaagaagagattggtaaactacagctcatgggtaaatccaactscctgcttgtttctgtaaagttttattggaatacagccacactcatttgtttacatattatctatgtctgtgtttgcactgaaacagcagagttgagtagttgcaagagaccatatggtccacaaagcctaaaatatttactgtctggtcctttacaggaaaagtttgctgatccctgcctgctctaaaagcataaaaatctatatttgttcaagtcacgtagccccaaaactgtatacattggaaatccatctcctagtggaaaaatatgaaggctaccttcaggtcactgtaaacagttttactagcccgtgccaggtgctgtgtgaagtgccaggcacacggagactcataaggctcatccttgagcagtggctaaagaaatgaaaggaggttcaccaatgaccacaaactttgttaaaaagaatcagagtaaacagacaaagataaacatgaataaaattgcagaggaggaaacatcattcattcattcaatcaatcatttctttaatccatayttactgagaaacaaggcatagtagaaaataggaaacacaagattagatggagtggtaaatgacaaaaacaagtctgccgtaaggagactctgagaaatgcattcagcagagctaaaaagcagatgtgggatttataaggcatgagcaaaaaaggagaaccagaaagccactatggtggatagggaggggagacagggcagacagggacaagatgaagttccagaaggaggtagaggccaggtcatgagggctttrtcagccaggacagggtgttagggtgttgatctacatgtgttgggcagccactgagggattggaatcagggaggtgacataatctgattagcattttaaaaatttcaccattgttactgttttatctcttcccttcccttcatgaatgatttagtccaaaaccattggacagggctgagtaaggtggacttccccaatggatatggagcagaatgtcagagtccaagtaaggtgtggagaatgtctatgtggtggatgggagtggtgggtggcactgcctggcagagggtgtcagaacaaaagtgggagaaggaaagggtttccacaggaggttggggctgcccggccaaggtggtagtgcttaagtatggtaaataaggtagtcacgtgggagagtaccctgrcagaggagatcagaatcgaagcccaggaagaacgttatgtatgagaagggtggagagaatagtggctcaagtaaggccagagcccaagaatggtaagcaggacatcctacagagtagtgccactgtggttccatgcaggctaagaaggacatgggcacaggaaagtgcctggtggaaggaagttggagcataagggtggtgaagaaggtgtacgtgtgggcaggcagcccagtgcaaggggctggagcctgagcagggtgaggagggcatggcatagggacatagtacagtgctgagtgctggatccccaggtaagtgaggagcggacccacttggggcaggcaggtggggaataggcgggtaggtgtcagaacacatgagagtgaggaagccttctgcatgggtgtgggatattggagcccccgtgggtaaaggaggatatttgtgtgtgtgttggagtggggaaagggtacaacagcaatgggagatttgtacattcagggacaatgatcaaataagtaaatatatttaggataatgggagctaggtttctcactgtcagagaatggtgtgaatatggagagaatgaaaactagagtcaactctgttggttggtttggaactggagatgttgctggaaacttatgctttgacagagcaaagtcttaatgtgtttacacacctatgtatgctcatgcatatgctctagctgtttctgctaaatgaaagcacctgggaggagcggcacttcaactgcaggaacacacctggcaccttgatcctcatttccaaatactattatttaccaaaaggaaacaaggcacttgaagaaatgacagactttaaggctgacacaaggaaggtacaaaacaagaaaataagcctgaaacatcttgcaccagaaaggagaragatacaaagaaagatggtgacataacaaaggaatacattgaaggcaccccaggtggtcaactatgagttaatttgagtataaaataaatgatgacagtgacatcaataawattgtaactataagttcatatagatataaataaatgatagaagtaaataaaatttggctgagatgcagaatatttatatagtctcaaaatacctcctcacaaaatacttattaattacaaagagaaaaagagtaattttatagtgtrgaagcctatcagacatcactcaatcaagtaatcaaaattaacaacacaataatgggacaaatcaaaatgtgatgggacacaatgaaagaaacaacatcccttctgtgatactgccctccaaagatgcataatttgaatctaatcattaggaaacctctgataaaaccaaattgaaggacattttgcaaaattactggcttgtcatcctcaaaaatgtcayggttaggaaattcaagtagagatggagagaccatttcagacagaaagaaaataaagaaacatgacaattcagtgctgcatgtgattctgaattagattcttttgctataaaaagygttattgagataattggcaaaacttgaatggcgtctgagagtagatggaagaatcaaatgattgtattgtggttatgtaggaggatgtctttattttggaaatacactaaagtatttgggagatgatgggcattagattgtcaacttatctcaaatgcttcagaagaataaacactgtataattgtggcaacttttctttatgtttaagatagtttttaaatgaraagtttttttaagaaagttcatatattcacttcagccatttgattccaaagtctttgcacatgcccctgctttgctctctccctggatgaccccaccccttgtgaaccagggcttgttcttcattttctctgcttagggagagtgtccttagagcatgtcctttctcctgtgttgaagtttacctgtacatgcctatgggtttttttccttgttttgaggcagggtcttaatctgtcacccagsctggagaacagtggtaggatcacagctcactgcaacctctacctcctggcctcaagagatcctactgccttggcctcccaaagtgctgggattacaagcatgagccactgtgccagccgttaggtgtctacgtttctatttaccccagagggtagggtctatatccatcacactcatgtctgtattcctaatatatagcacagctcctggcattgtgcttgataaaaagccatggaaaaaggaagagagatagggatatagccataactttgagaatcacttctagagccaacaggtttaagttgagaaagacttaataactgcctggcttaggtttgaattacaactgggttatcttgggtaagacatagtctctctgagccttggtttcctcatatataaaatgrgttgttaggtggggcaaattttgtaagttttgtaaagtatcgagtagagtccctggcgcttagcaggtatgaaacaattttgttttcccactgtccttaaaaataaaaataaaaatcatcaaatagaactagaagatcagaattctaggttatagtcttgatttcactacaaccttgctatatgaactgggataggttatttcaattctcaaggcctcagtttccttcttggtaagatggtaggtgggaaaatgaggaagtgaggagtgggccttatcactgtcatgctaccaagaactcaaaaagtttttttttttttttcctggatgatagtatagaaggtgagggatatgaaagattttgctatagagtatgttcctcagttttagcagtcaaggcatgcaaagtctgcctcttaatggtttgctcagctgactcatttatacctgcttaaattagtaggtaaattgagaggtggtagtgttgttaggttactgttgagcctattaataatttatgagccatcaaggaattaatacacactttaagttctcactgcatttttccttattcataattctttgcctaattgctttttcctttaaaaatgggggaagctgagaccttggatatttgcctaatggctcaagcagaaccatgacctggttgccaagtctttcagttcttttatagcctggggacatttgccattgaaagaaaactgatgggtttgatattcctgaaagagatattttgcactaacctctggccccattaaatgctttggcacttgcccattctctgtaatgggagcaataaatttgtttcaatttaggacattgtcaagtaggaaatattgacaaaaacaaaataatgctttgaaaacagccaggatgaaaccatgaataaataaacatattgaacttaactgataaattagcaaatggccattcataagagtctgactggaccatttcaaagttaggccaagtaaattcctgtctctaatagaaatatcatcttactctttaggccagaggaaaggtgggctaagaggaaaggtgggctgcatgggaagacactgcaaagcatagaaaggcatttaccccgtctgacagatctgttttaaatagatctgttttcagctaaatgccaaaaggatgagccagatgactctagtagccttttctatggcaagagatttattatcctagtgtaaacacctttattaggcatttcagcaagctgtttctccaccttttctttgtattagttccttagattggggcaaataactgaaattctgtttaagtattattgtatgtgtttccttttgagtataagagataacttctaagttagagatattcctcttgaagaaggggataagtgtgcatatggcattgatccttgtgctaatattatcacataggtaacattgttatgacagacggcaataaaccacaaaacatgtttgcaaacttgtgaggccttaaatggtgttgccttattaaaaatccaaatggctaaatcatccagagtacaggtagcctgagggcattgttagctgcataaaaactaattggaccaatttgaatggaagaaaatgttgcctgaagtctttaatcacactgataacctaatggttttctgctcaacatagcccaggctgtgtttaggaagatgaatccatgcatgcagcttaaaaaattttacacaagatcagagggttgagaggaataataaatttctcatttagaaagtttagtgcrtgtgtatctcatgttttagcatcatagcaaggtaacagcaagcaattgttggataaaggaaagtatcatttttttaaagatgaagcaaacatgagaaagctgattctgattttgctctgattataagggatgtttctctaagaagaatttagcgttcatctttatgtgcaaataatccaaaaccctttaacttattatcagctctgtaattcaatgagctcctgaaatggtaactgaacaatagtttgacacgtgctattattatttttttctttttttctttttattttattattattatactttaagttttagggtacatgtgcacaatgtgcaggttagttacatatgcatacatgtgccatgctggtgtgctgcacccaataactcgtcatttagcattaggtatatctcctaatgctatccctcccccctcgccccaccccacagcagtccccagagtgtgatgttcccctccctgtgtccatgtgtccaaaacagcatggtactggtaccaaaacagagatatagatcaatggaacagaacagagccctcagaaataatgctgcatatctacaactatctgatctttgacaaacctgagaaaaacaagcaatggggaaaagattccctatttaataaatggtgctgggaaaactggctagccatatgtagaaagctgaaactggatcccttcctcacacctgatacaaaaattaattcaagatggattaaagacttaaacgctagacctaaaaccataaaagccctagaataaaacytaggcattaccattcaggacataggcatgggcaaggacttcatgtccaaaacaccaaaagcaatggcaacaaaagccaaaattgacaaatgggatctaattaaactaaagagcttctgcacagcaaaagaaagtaccgtcagagtgaacaggcaacctacaaaatgggagaaaattttcgcaacctactcatctgacaaagggctaatatccagaatctacaatgaactcaaatttacaagaaaaaaacaaacatccccatcaaaaagtgggcaaaggacatgaacagacacttctcaaaagaagacatttatgcagccaaaaaacacatgaaaaaatgctcaccatcactggccatcagagaaatgcaaatcaaaaccacaatgacataccatctcacaccagttagaatggcgatcattaaaatgtcaggaaacatcaggtgctggagaggatgtggagaaataggaacacttttacactgttggtgggactgtaaactagttaaaccattgtggaagtcagtgtggtgattcctcagggatctagaactagaaataccatttgacccagccatcctattactgggtatatacccaaaggactataaatcatgctgctataaagacacatgcacacatatgtttattgtggcactattcacaatagcaaagacttggaaccaacccaaatgtccaacaatgatagactggattamgaaaatgtggcacatatacaccatggaatactatgcagccataaaaaatgatgagttcatgtcctttgtagggacatggatgaaattggaaatcatcattctcagtaaactatcacaaggacaaaaaaccaaacaccgcatgttctcactcataggtgggaattgaacaatgagaagacatgtgctattattaaatggagtgtgttttagtagaaagagtatggaatgaaagtctgaaaaacttttgttcaagttcagtttctgcctctggctagctctgtgagtttctgcaagtcattcgaactttctgagcctgactttgcatccccaaaacgccrgtgaaattaattccttcccagacaccccacaggggttttataaaaatgttacaagctaatcgatagaaaagtatatgaaagctataaagccttctgcaagtataagcaattattattattatatcatagtagaacgtaatgttctgggtctctttatttaaaacaattctctgtaattgttttaatttcactcaactttcaagccatgtaaaatagtatacgtctgttataattcaccaaatcaaagttcccaagtttgcaaaagccacgctcagaagaatgtgattttaaaaaawtgattccttttggactgcatacccatctgaagtcttctttggaatgcaattcagtcagaagcaattgtggcactagcaaatattctgagaattcatgaaatcccaaagccaaaaccatgattcattgctccaataccaaaaacatttggcaggctgtagtttggaagccacaacactgtctgtttttaaggctctaaatggggccatttggattcattatgacactgcctggtcccaccacactagagagatggcaccagaatctcccagtctcttcagacattatttttcgtatttcttcttgggacttgcttaacaatatatctctttggattaaattacatagagttttaggagtatctcctctatcttgtaagcattgcaacatgaatattctacaratttcttttatataagaattcttgtttagcagttctggatttcctagtgccagccttatacaacctgtcattcaaatccttaacgatgggtttatgtgaaagtggtttctctacagtttcctctgcttcatcttaaatggaaatgtagttcctcctttgaaatggagcactaaatgcaatggttccttcaggcatatagcacgtttcagttaccatttcaaatgaaatgtatttagacaaaagctactaacagcacactgagtagcagtggtaacgtatagccagatatgctgtggcatgtatgtaaaaatcasgcattcagccctggccaaatgttggacacgtcagataaggaagctaaaaatctcctgcctaaatgaggactgtgtaatttcactctgcctttccaacatgccaaagctagcttctcaaagtctgcatgattcatgaatgccttataaagaatcatagaattctgtggctcacacctgtaatccaagcactttgggaggtcgaggtgggtggatcaacaggagttcgacaccagcctgaccaacatgatgaagccccatctctactaaaaatacaaaaaattagccaggcatggtggcacatgcctgtaatcccagctactcttatgctgacacacaagaattgtttgagtgtgggaggtgaagattgcagtgagccgagattgcaccactgcaatccagcctgggtgactgagagggaccgtgtctcaaatcaaacaaacaaaaaaagaatcacagaatgtaagaaatggaggaatctgggacgtcacttgtcacatcttgtgacctccaggtaggttcctggatccctctacagcacctggagccaagaggtgcttcagtccttagcttacagacttccagggatggaacagtatcccctactagaacaattcaatctatttttggacagttctaatcttaggaaatgcagcattttgttttaattattgttgatgtctaaggttcaacttaactctgtgggaatgtcatctatatgaaataccttcaccatttgaagactgtgtcwgttgtygatattcagtcagtcacaattgaatctaaccactcgtcatctggaacagatctccccttcttacttacaaagcagtcaggagtaattctgtccaacactctgctagaatccagctgtatgttctagcctattgatttccccttattatttatcttcatcaaaaaaataataaagtaaatctagaatgattttcttttcttaakgtatccatggtagctcctagtaatcagtgtttttctaagagtgcagaaaacttctgtttaaatcattcctttctgaagctttgcctataatgtacattaactcactagcctagtttgtaggctgtcttactcctgctttggggagttgagtctatatttgcatatattatcttctagcacttttcccattcttcttagctcttctgtcattagttttaaatgccctggttcatgtctttacctagggtgcattaattcattcacagacaatgtgaccatttgcaaacaggctagtttgttctgacaagccatggcctaaatggcatgcacactccaaaatacagtttacatattgtggatttgagtgtgaactggtctaattggcagatgttcactaggacatctatacccctaaagcatgaattaattagtaaaaatattttttaaaaatttgtttctgttcttaattttaataaattattcatatcctaatgcacctttataaaaacggtgactgatgatcatttttatatttatgtatacatcatggagctaatttgaattagcactaaaataatatatactaatataacatggtagtatgcaaaaactaacctaaagactatgttattctcttttcataaaataaaatttcattttacatccacaaaattacccatataggaactaataattcatatatatggctatctatgatatatatcatcatctttttagcataaagaagactacctagttgaccagcaatgttgaaatacttgcaaaattgagtgctttccttacctgtcattagcttgcatttacttttgttgaattcctgaggcagctgcatcactgtattttcactgaccacaatttcagcaaatagaggtcctgatgaatcttctaaatccgggcatctgtgaaatgcttgctgaagtctggatgcacatgggtggaaacagctagttccattgatcaggktctggtttcttctgttttgtttgacctggcatgggtagcttccatctgtctgtcatcctagaacagcatctggagccagcctatgtggtatctcttgggcaaaaaggttaagtcgtttgacatggattgcatttagcaactgaacaaacagagcagcttggatatgagcttttattcagaagaaaccagatagccattttggtgataaaatatttatttcctattatcttgtgttgccaagactactttgtatagtacatttcttaaaaggagatagagttctaaagaagttaggtatattaataagggaaattgtattttgaaaaatgtcttgagtgatattctattgccatatttattgttgattgagaamacattatgtcccatttaagccaatactttgtcttcttcttaagtattgctttcttctaaaaaacaacatctctactctatagcttaaggaagtgaggccaaagatgcagtcatttttaaggcaggtagaaagaattaatcagtgtgaactgatgttagctttcaggaaaawctgatgtctccaaatgaacattttgtaataatttaattttatttaatttaacatacatacttttattttaagtatttgcagagtactggctaacccctgtggggaatctaaagatgtcagacataatctctgacctccaggagctatctgtgtaatgaggttcactagcatacaaatacagataattctaccctaaggcagattctgatgggtactgtgatagaattatcacgttctagaggggtatggaagaggaagaggttagtgctgactgggagttttcaagagggcttcaaggaagatgccaactttgagttggacctttattgagtgcttactaaatttcagcaatgttcaaagtgctttaaatttattaactcttttaattctcatgattaactttataagctaagtcttgttataattcccattttatagttgtatcactgaggtatggaatagttaaataacttgccaagatagtaagtgatggtgtcaggattcaaattcaaggagtctggcactaaaatgctcattcttaaccgtagcactatactgcttcctgccagggataaataggcatattcaagcagttgagagtgctcagccatagtcatagagaaaagaaaattgaggaatgtttgcaaaattcagttttttagtctggcttgaacttgggtaaaaaaatagttgaggaattgtagaatacaagacacagagacccaagtagggctatagaggacttggtatatcggcttggggaattgcaggggaatgctgtggtaaggcttttattataataagaccctttggggggagtattgaatgactgggggrtagaatgtcatttaaggatctattaattctattaaatgctccaaaaactcttttttaagcttctcttatgtaccaggcactgttctgagtgttgaagatatagcagggaacaagagaaacaattccccaccctcattgtgtggaaagaatatggagggtgtataagtaaacagataaataaacaagataattttctatagttctgaaagaaggaaataaggcgatgtgatgtgatagagagtggccatgggcagaggaatagtcactcagaatggtggtcaggatctattcttggctcctctgccattcaggcctgaactgaggcctaaattgcagaggaggcagtcatagatgaaggcagggcaagtgttcagcaaaaggggatttgcgtttattaagaagagcattgcaagcagcgttaacaaatgcagaagctctgaattgggaaagagcttggagggttcaagagacagaaagaatgccaaaaagaagaagcatttagcaaaagatgtggagaagggtatgggttgaagtttgagaagtaggaaggaccagaaccttayaggtagagcatttgtattttattccaaatgaactgggaagcaattgaaaagttttaagtaggtgaatgatgtaatctgtttatattttgaaaagatcaccctagataatatacaaagaatggactatatagagacagaagtgaaagcaggaagatcaattagatggcaaactgcaaaagcccaaagaggaaaagattcgtctaggccttgaggctggagagagatggatagtttaggattatattttggaggcagagctaaaakgacttgaattgagtgagaaatgtgagggaaagaagctattaccaaggaggactccaataattttggcycaaggtaactgaacgatgtaatactggtaactgaaatggaaagaactggcttgggtgctgggagaattaagagttcttctacagtcatggtgaagttctggggggaactagggtagttgctttragaatgacaaatgatgaatggatgctagagagattatagatatacaattaactgactgatgtagttagatgctaggatgaagattttgataaattcaggttttgagtcagatgaactgggaaggaagtgaccccatttaccaaatcggcaaaagagaaggaggagtttgaraaaggagaaggatcaatacagagtaggaatcattaggaaattcatatttgatagtagataaacacatcagctttggaatctaaaagatgaggatttgaatcctggatgagctgttagcaaacctgcatgacaagttacttaattgttccagtgtcagttttgttatctataaaataaggaaatgatattatattatatgtaaagcgatatatataaaaacagaaaagaatcatgcaatgaatattatcactatatcttattatcataaaaataatataataataatacttcttgggatgtgttttatttatattattactaagataataatgttcttgttttagttctttttagtaaggattacaagcacaaactggaaattatttatgttcttttcctattttncaggtaaataaactgaggctcagaaaggatggcatacccaaggttataccgctagaaattgtaacctatgcttaagagccaggactcacacttggatatgacttaaaccaaataattctgaactcttccccarctagttactgttaagataaaagctgctttgtatcactttgccatttctctgggatctatgttgagtggaaaaattctgtgtttataaaaatgttattatcagatcaccatactgtgaaactgtgttttattaattttccagtgctggacaatattcctctcaaggtctgtctttggaggagatgaaaagaagtcttcaatacacacccattgacaaatatggtaagtaggcagattctttaggtttgttargaaaactacccctaggaaggtgatgtctatttgacaaaaagggagaaarcattgcatattgtaatatccaaaatgacagatgctttaaaaatataaaagtataaaatttgattttatatgtcttttataactcatttacctttaaggttaataatgtctgtgtgagcatgtgtgagtgtgcatgagtgtgtaagtatatgtgtgattatgtgtgagtgcctgtatgtgtttgtgtacatagaaaaaagtacaactctttttttwaaaaaaaaaaaaactccttcctctcatgatattccraatactttgtcaacattttattaagtccgttgcttctaagccccacattaagtgtgtgtgggtagggagaggaaaaacaagagatgaattttcacaattacctaatatgttgggagagctgttcccctttagccaagcactcaagggtaaaatgcaaatccagccattccttcaaacagctggagaggcagtgaggggacagtttgatgggaaccattttacacaggacttcttcagaaagaattaataaagctctttgaaataattaacaaagtttttttcaggcctctggaagccagaggatggacaattgcctttatcatcagctgcgatatcaatgtgttagggctgggatgtccttttaccaacctttaagcctgagaggcactaygtttaattggaattttagcacaatgggcccatttatccattgcaacttcctttgactatttgaaggactgaaaaagtatctgtcagttaaagagatcagatttattataagagctgggtttgggaaagaataaattagatgaagtgagcctgggtagggggcaatagacctgggagaccctcggctttgggatcctcaccaattcacctcatctgcagagactcattacctaaggcattagaaaccttttaagaaacaaagaaaaatgtatgttctgaatagatgcanacaaactatttgggcacatttaaaaaagggaaattttgtgcttctgactcccaatacatntctagaatgcagatgagtgctttttatcatcagttttacaacataattggccagtccagtaacagatccttttgagggggaaaaygcactccaagtgtcacatcctcacatttttttaatagacataatatcttttcttcaaacctttacagatgtawcttcataaacacaaaacatagggcatcctttgaaacatttgctttgaccagaagtcttcccttttgtggtaaggtttcaagatgaagcatttctttaacttaatttgtttcttaaagaagaattcccccaagatggagaagtaagagaaatgtgatgtaataatgcaaaatttgggttttcctatgcatacctgtctcagggatgaaagaaaacatgragggtgtttggatggagtgagagtacctataaacaaagaagatacattcgatatctcccattaggagcatcacatcatacaagaaagaacgctttaattgccctttattctatttcataaactgatcgcaatataacaacaattttatgagcttcttctccccctgctttgccgccaaagagcagagctcgaaaatggagataaaatgaaacacatagctgttttctctgtacttgagaccttttaccttaaagtaacaaaacattcagacttggttcagtcttttcctaaaacctatggtcaaatttcagttgagttcttcttaaactgagtgggtccacaatctgacacatctgttcttaccttctggcaataatgacatcaataataaatgctagcctcaatgccttactgattttgctgatcattcctgagggtagagcccacccaccctttggggacatatgtccacaatcaaatttccattggagtcctgtggggcaagaggcactggaacatcacaggccagtaaaattgcatgtggtatgttagaaagctgattayggtcataaaagtattacaagcttatggaagcatctacctatgcctgaaatgaagtctcatttttagcctggatacagtaaatattttgctgtagaaggtagattttgttttagtctacacagaatttagatctgctgatatgtatcctactgcccctcatctcatcctcccccatcataaccttcctcacatctgaccagagccagtcccaaaagaggtgagtgagagagaccagttgacaggagtatcactatcagtggcattttctcttaagagagtttatgtgctacctaagatattttgacaagagacctttcttatgaaaataaatatttcgatccaactgcatactgctagatgtcttaatgaaaatgtagatgactgggttggttatgaaaactcrgctatcaaaggggagcaaaagcagcaatagctattgacaaatgtgctcactttcatgaagcaatgaatggctttcttgcttcagagtgaaaagaaaactgcttccctgtacatagctctgtggttctcttggacagtggcctgatcctgagccactagtttaattctctggacacatccaaggctattgcttcaaagggcatcaaatgccactggtatttagacctaagaattttatgtacctttaaaatttgggctaccagggagaagaaacaaacaaagccatctggtttgagaaagaaaggctctttccttttccttttctttttctttttccctttttttttttttttttttttytttttttgagatggagtcttgctctgttgctaggctggagtgcggtggtgcgatctcggctcactgcaacctctgcttctcgggttcaagtgattctcctgcctcagcctcctgagtagctgagactacaggcacatgccaccacacccggctattttttgtattttagtagagatggggtttcaccatattgaccaggatggtctcgatctcccgacctcatgattcgctctctgggccatcccaaagtgctgggattacaggcatgagccactgcgcctggactctttcctttttctttaccttcctttttatagccatcttttgtttagcattcactggtatcagacagtgctaattgtcttaggtgcattgccaaccttatgaataagtgctattgtttctcccatttacagatgaacacaccgaggcatagaaaggttaagttgacaaaagtcacagagtcagcaagtagtggaatccgtgcttaaacccagatttgcctgacgtgaaagcctgtgcttttagccaccctgacatgccatctgcctgagctgtacccctctttactccaaacccaaaatgccacctggccagcttgggtccaaattagacattagtcattcatatttgcctggtctcagctctctgttttcattrtaaatgttgcttgtgctttgcaactactcaccagcaaccgttgtccagattgtctgttcacatgatctggaagacctgcctggttcaggctggttataaaaaattgggggatgtactgaaagactagtaagtaacaactgaacttcttttctgatgcaggctatgtatccgatcccatgagctcaatgcattttcattcttgccgaaatagtagcagctttgaggacagcagctgacagcattcggcgtatacctaaggagagttttyyccccgaactgacagcaacgattccaaccacggcaagctggcttccaactataacattttactctcaaaggtctccttaaattgggcttgtttttacttgtcctatttaattccccactattagcaggctttggatttgtgcctaaggaataatatgcaaaagaaccaagacagaatgtatatgaagaattgtttttaattttgtaaattaaaaaaaaatttagatcgttacttggaaatggagcctaagtctgtggtggacagataataattatgttttcctgggctgaattatgtagacttgtgtttgacagctatgggtttatttcttagaacattgttcattttcttttctcattatgttacttctagtgttcacctctgtgattaaagattctttggtgaaatagaaaattgatttatgagtgtattttatttcaacaagacttccactaagtatattttttttccagccatattggtaaaaacagtagcaacttttaggtcaagaagcttgcaaaaatatagcactaatttagtcccctttccatgtcatgccaagtgctccatgatctacttaggtaacctgttgctctcagaacaagaggtcgtagatgtatcgggtcagttgtgaaaccagcctatgcatgcaaacctgccatttttttatactagagttttgcacaatgtggtgggagaatacctaaggtgcctactgccttcgagaaatgagaaatctgccctccatactggttcctagttggaagacaggaatggttctatgagacaaaatagtttttccattgaaagacagatgggaaaaaacagggaggaaacgataaaaattgaaggataattgtgtgttttgattttggcaagataaataaggttagcaaaggaatcttggatatcctctaaatcaaggttcctcaaccttggcactgttgacatttgttgagagggtggggggctgtcctatgcattgtaggatgtttagcagctttgtggtctctacccgccagatgccagtaacatcccctatgatagttaattttatgtgtcaacttgactggaccatgggatgcccagatatgtggttaaacattctttctgggtgtgtctgggtgttttcttaagagattaccatttgaaccagtagactgagaaaggcagatagcccttcccagtgtgagtagcatcatcttatctattgaaggcctgaatagagcaaaaaggtgcaggaagggaggatttgctctctgcctgactgcttgagctggagcatccatcttctcctttccttggtgctcctggttctcaggatttcagactcaggttggaatgtatactattggttctctagctctcaggcgtttgaactctaccactggctatgctggatctcccgtttgtagagagccgatcatgggacttcccagcctccgtaatttcatatatctatatctatatctgattggttctcttcctaacagagaaccctaatgcacacactcccaagttatgacaatcaaaagtgtcttcagacatttctacatatgccatgggggacaaaattgccccaagttgagacccacttctctaaattcaaagaggataaccacaggcctaaagagcaaacaaggaatttagagcctgactctggctggctgcatttaggcatacgtgctttctcctcctcctgaagtaatgtggattcatatataaatggaattggataattggatagtagaagtgctgattgctcccttagatatctgtggcaagctcctctctcctccacttcccccttgccagttagaaattatgtttctagagggcaatttctatcagaacaggaacaccacctttaaaatccctttgagcctctttttatgacttatggttgcaaagtcacaaatcctagcatgctctgattagcttgtggatagcccagtgtaggttcagagacagaaattaaaagcaacttggtacttccaactagatttatcctcttttagcctccagctttttccatttccctacccaattattctggagtcgcaggtactctatcccaccaatcagattcccaaaggactttataataagcaggaccgaagaacctgaagtgactgctcaggcataaacccttctggcaaagacagagaaggagaaaaagaagctgattaaagaacacctgtctccatagctttccccctattcctttgctctagctactctaggaaatgaaccagcacttagcctgggatactttggggcttaatcctttcatgagttgagttgaaagaaataccttagagagtttttttcaaaagatagttttaaccaaaagaatcacagtatacataatgccaaatgtgtgtatagtcagggctgtggacagtgctggggtaactctggctggctgcattgaggcatacctgcttaggtaaccccagccaggtgctctcccaggtcatatccagagggaggattgtttgcttctgaaatgcccctcttttagaaagagattttctagaacagattcgtcaagatctctttctttgcttcctctaattagccacctcttctcttcacactgcatttcctgatgttgctgcttccctctggctcttgtcttgtcaaatatctgcaaataatgagactaatgtgtcttgattcctgagaaggagaaccttttcgcagattacaacctgtagctcacaaacccttttcattactgcacccttaatggggcccagggatcatctcagagcttgtatcaagaccatgggttttatgaggtttttttcttccttgctgaaaaatgtcgcactaattgctttctttttctttcagaaaaaatgaacttctaagattatgtttttgcatgcttagcacattaaatttctttctacgtgcatgcagcactgagctcrctccgaagatgttcaattaactgtaattgtaagccaaattatagcagcaccaggaaagagttattccaacagagtgattatttgggttaaattatttccaaagctgacatttccctaggaaagagaaaaaatgggtgcttgtggtgggagaaatggctaatgctagacagtccatctaaaatgaagtgtctgatttctctctctgtttctttctctgtctctctctctttttttatttttcctttccctttcctccctccttccctattttatttatttgttctccctttctttaacaataagcagtggctttggagtcactcagacctgtcatagtagttgtgtgaccttgggcaagtcactcaaccactctgagctccagtttattatctgtaaggtgattgtaataaaatgtatctttttggcccggtgtggtggcaatctcagtactttaggaggccgaggcaggcagattacttgagcccaagagtttgagaccagccagagcaacatggtaaaaccctgtatctactaaaattacattaaaaaaaattagctggatgtggtcgtgcacacctgtggtaccagctactcaggaagctgaggtaggagaatcacctgagcctgggaggtcaaggctgtgattgtatgactgctctccaacctagatgacagagtgagaccctgtctcaaaaacaaacaaacaaacaaacaaacaaaaatttatcttgtagatttgctgtaagggtttcaaatgatgtaaagtatgtactatggttcccaaaacgccatagcaattttctttcttttttttttgagttggagtctcgctctgtcacctgggctggagtgtagtggcgcaatctcagctcactgcaacctccacctcccggactcaatcaatcctccagcctcagcctccctagtagctgggactacaggcatgcaccaccacacccagctaatttttgtattttttgtagagacaggattttgccatgttgcccaggccggtcttgaattcctgggctcaagagatctgcctgccttggcctcccaaagtgctgggactacaggcccaagccaccagacctgaccagcatatgttgttgtttgtgttattgttatatgaccatgcatccaaagaactatattataaaaggagagcatgaaaatagtgaagatttttttctccattgtaaaaataactatcaatgtccctaaaaacctcatctttgcaaacagcaagttggagagcctacacctctgaggcagtttgagccaagatccagcagaccttagacagcaatgccttgtttatcctaaaattaaattagaagacaaatcaaatcctttcagccaaatacaagaaccagaaaggattccccaagcaagggggatgctaagtgaaaatagaaagagtatacacttgttgagcactattatgtggcaaaaatggtttaaaattacttaaaatatagtatttggcctaattttctgcatagccctgggaagaggggattattattattattattattattcaagtggggaatcagagaaggaaagtaatgaatccaatctcgcatagagtagaggcaggtttcaaacaacttttttcttgcactcatgtccatgatttgttcattacacaatacagcctccactgtgagggaggaaaagatagaaaaatagcacatactcacaatccagaattgcgataaaaatgaacaactctgcagttctacagtcctgaggaaaatttggaaactatcacaggagaagtttcaggagccagaaaaaccttttcctgattgctacagcttattattgcaaagtaaaaccaaaaaaataataatcattattttccctgttgtaattatggaagagaaggggctggaataatcttaaggctcaaaaaaaaatgcattgttattttctaggcagaaagaaccaaaaatgattgacagaaacaagactctcaccatgataagcaagaacaaaaaagttataagggcaaagcacagcaattagggaagccaaggagtttcacattttcctttcctcattagcacactgggtagggaaattgaggagagagggtgtagccattaccagtaggatttgaataccttattttttcctagttttgttttgcttgcagttactcaagcatgcagactgaagagctccccctgatcaatttgcttccatatttcaagagccacaggggcaaagatgagccatttgacatgtgcaatcccttcactgggtatcagctcaagactcagctgcagcaataacagactgtggtccaagactgtcagctcaattagcaccatatgcaaaacatgatggagaagcaaagttcctctctctccttggacatcctacttttgtgaggctaactagaaataaaaagagcaggggttgcacatttctcctcaggccagagatccaaggcggcacagcagctgacccagtgccagggtgctaattaaattaggcttcttgaattaaaacactgccacgggggccaggccctgctgatgaggacatgtctccaaagcactcccagcctagctttatgtttaattagtgagataaaaagaatattatctcaagtatctgtcttttaaccaatgggctcatacgcagaaaaaagttatctttaccatctttaaagaaggtttttaagcgcactaatttcactgacctccatctcttcttttatctcaactaatcagggaagggtaagattgaagcaggaccatgatatgcaataaaaataatttgaatgtaggtttgcccttcagttttttacttataataatccatggtctgcttaacaccacttcaaaaattagtccacagtgaagaatatcaggcttgtctttaagactattttttttcctttcctgaaactcaaaatcatctgaggaataagaattaatgttaatattgagggtaccttgaggtgatcagaataaaagtgaatgaacgccagatgacacatgtttgccctatacagttatggaactataaaaggtggaatagcatagagcagttcttaaaatttagcctgcagcaggatttgtagagggctcattaaaacacaggttgctgggcccaccgccagcattgtggaatcagaagctctggactggggcccaagaaattgtatttctaacaagttcccaaaagatgctgatgctgcttgtcctggaaccatacttgcaaagcatgtgcatagttgtcaagggcatgagctttacagttgggcttgagtgaatgtctggctccccccatcactgtgtgacctgtgcaaacatgggcaagttacttcatttctctcacctcagattcctcatctgtaaaatggagagaatcattcttacctcagagagaggattaagtgaaataatgcatgaaaatcacttatcacagggtcaggcacatgataaatgttccata

SEQ ID NO: 12279 - DNA, 166690 bp, Homo sapiens
  misc_feature (1)...(166690): n = A,T,C or G, or insertion/deletion polymorphism (see Tables 1-2)
atgtggaaaaaaaaaaatcaataagccaagtctaaaaatcactccgaaagaaggaattgtgtcctgaagggcaatagatggctttggtatttgaaatgtgctagctacttactgctgagcaccagttttatgccaggcactttagactcattatggtatcttcagttgtgttggttaggatattggttaggttgctgtgaaaggaaggtccaaaataaccatgaccaaagtaagatagaagcttattcctctgtcatgtaaaagtctgggtatgtggtccatggctgctatgacaacacataatcatcaaggtttcagaggctttctgttttgttgtcctgccaatttctatctcagctcccaccattacagctccatgacatctgcattcctgatagttggaaagggcagtagatagcatggcccagaatcactaagagtgaccaacattcaaaggtaggaggattagattcccctcctggtaagggagtgacaaggtcacaatgctgaagagcaggtgggtaggaatatacattaaccagctaataaagcaagttctctgtgaatgccattttttcatctaccagtatccacagaacaaatactttttaaaagtacgtatttccttctccattctaaaaggatttaagggatacgtgttagagtagaaatgccagtaaaatgaaatagtactcagagattttggttgtcagcatgttggaaatgcccagtgaacggtagccatagccaactgggttctatttgtggatctgcttctcacaagctgtgtgaatttgagcagatcactgagcttctttagacctgactttcctcaccagtaaaatgagaaggataatatcaataatttctaaggtcctttccagcactaaaacctacatgaagactgagtactctttctcttatttcctgctatcatgattggccgagttattgtcaactactaagcaattaatcgtctagtctattaagtgcaaacgacaactgttaaggagcaactaagaatagttaaaactgtgagagcaaaggctctaatcaaatgtttctgaacatatgctcatgggcttacttgagaatagcacttattcattgtttgcattaaaatctcatgtgatgaaatattagagattgcacaaattttgttgtatccataatagtcaataaaagtattatacaatgtagctttactatgaaagtagaatacatttatttcacagctatgtaaagtagatatttttaaaaagtacctcatcaagctttgatgttcagcttttctaactcctgcttccttaaaattcaatactggaatcgttttggttcccaccccacccctgacccgctcagaactatcccagtaaccaccctccacccacccccacatatacacatacacacagccaagctgctttggatgctcctgctctgcactctagaagtccctcttgcttctttctgtgttggtacttgttacactgtattgtcattgtctgtcatttcctcacctacagtctcctcaagctgtgatcatctcgagaacagaagacaactctaccaccaggggttagagtgaagcgtggacatactaggtgctcaatgaattcttgataaatgactacggttcctttgttccccttaggagatgttgaaatgaatacaagccatgttctatcttatgtcaagttcccaaattcttcaaatatccataatttcacataagccaattcttatgttggtgtgcatagttggagtttgttttgaatgtgcccaatgcagaggtgaaagcggaaagagaagcaactagtattaagcagccactttacatattttttccaataactttaaaaatcatcatcttcatagcaacctataaggtaagtactattatttctattaaatacaaactgaggctcagagagaaaaaggaacttgccagggatcatgcagctcctgaataacagaggtggaattcatctgactctaatactacacagcactccacagggaggagctgggctaggggtgtgggtggagactcactctcatgctctgaaacctctgttttaaaattgacctatcccctacatttatgcttactaaccctgaattttagctctttacatgtaggttcagcaacaagtgctccccaccataactaatacctctattcttcaccattcattatttgagccatggagtttacatggatgctattgttaagttgttctcattaagagagaaacagggcgggacaggggaggagtgtggcaaatcaaatcctcaggtcagatcaacaagatgaacaaagaaacacaggtgcccttataactgaggtgcacaatgagcttgtaatgcctttgtgtgaagatttgggacttttaaagaaaaataacattgtccttaatacaggaattgcctttccaaggaagaaagtaagtttccatgctcttactgattgctttgttacatgaagttgactattctagagccacaatatgactagtaattgtaaaattgtagattttacacgtttacaaatttgggcaaaatgatcacagatactatttatggtttgtattgggaaggaatataaattaataatttgctttggagatttttaacataattcccaaacacttactttaaaatagttaatactatcctgataatattttaactatgtacatatatgtatacagtcatataaatacatgagtaagcctaaaaaatttttcaactgatgagaaacttttttttcctattacatggttcttaattctatgatgaggtactattttgataaaatttttcatgtaagtggtattaccttaatatatttgattcctagacctttcttagattacttctgaaatatcaataagataaacagaaattataaaattggagttttatttttaaagtctctctgtggagtttttcaattgtttttgaaagagctaataaatccagagaatagattaaatcattaaatataataaataaaatgtacaatacagtcctatgtatgccagattttttattttgaagaattcatagctgagctgactttggaaaagttaaaactgaaagaattaataatctttgtatgtcttgtgtctggatttaacttctgttttagtaatatgagcatatgtaaatgctacatgggtttcttttaaatagggacagctttccactatgaattgtgacaggtcacacatttacacaaccttttagtgttaaataacaatatgtttatatatcaatataaggaacacgtactaaaatctttatattagagtgtgacaaagaacttaaaatttttttaatttgtaatcatttttaccagggactgttcttaatgctttctgtatattaacttctttaatcctcagaacaaaccccatgaagacagttctaatattatgcctatcttacagatgagaaaactgaggcacaaagagattaagtacgttacccagcatcacagagttactaagtggtagagttgtgaatcaaaccaagacaggcttttacccaccacactaaacagccaaattagattccctggagaggtgatttcagtaataagatggttataaagagcaaaacttgctacagggttctgtctaaatcattaaaaacaataatgtgcatcaagtttttgtacatatgcctaccagtgttaggctacgtgctttaaatgatcccttgcacttaatcctcacaaccacactatgatatgtttatctagctgtgtaaatttgggcaacttatttaacttccctatttaagcctcagtttcctcatcagctgacgtggggaggatattctagagtgattagcacagtgtctagtacaaagtaaagtcttaaaaaatgtcagctattaatatcattactgtttttaggctttagaaggatcaagcaacttgttcaagatgacatatcttgaagaggaaagagctaagatttgaacttaggtttcatcaataccctaactacagtggttaagactatattctttactatgctaaactgcactgaatttttgcctgctggcctttgccacaatgctttgctcattgtagttattttgataataattagagatagtgatacactaaaactaatgttttattttaattctaaaataataaacatttactactgatttttaaaaaaaacacaggcaaaagggaaatatgaatcatgcatcatcccaccttccaaaataaccagttaccctttcaaaaaacaggatcattctgaagatacaattttatgaactgcttttctcactttgaaatatattgtgaacaacttttcatgttgatattcatcaactgtatcattcctaatgtctccagaatattccattgtatgatcagtcttctttattgactgatctgaaaaatcagtcaacaaagatgttcacaatatcaagttgactgatagaaaagttataaataatattgataatttttccatatttcaaagaatgccccagcaaaaatcatagacccaaatctttgaacatgttaatgattatttacttaaaataaatttataaaagtggaactactggatcaatggatttgaattagcagaattttgagttggtatatccccaactgctcagcagcaaaattcctttgtattatataaccaaagaagattgtaggaaaaaagcttttatagccatcagtgattgttcaattttaaggctgcactaagaaacttgaattgcatgagatggtccatggaaagtacatagcgcttggcatagtgtcaataacatagctattattataatgaaaccatcatcaaatttgttccatttgtcatcccaaatctttttactacctaggattcctctttagtttatttgggcctatttgaagttctgaatcttgcccaagtcttaaaaacagggaaaacttgagaatgctgacaattgtgaggtaaagcaataggctaggggtcgggagaacttttataatttttcctcctgattcttttgtaatctggggcaggtcttccctggacctcagagccttcacctataaagagacactggataagatgacctctttaatatttccattctaactcttgatactaagcttaccttagcccaataatttttactgatacctgtatttcctgtattttgaatcaaggtagattttctttaggcaatagtggccattctcaacaattcaactgttagtttctgagccctaggagtagaattttatgaaggtcaaggagggccaaacaagccactttcccatttttaatgatcatcccattacctaccactgaactaatgttgtgttattcaaacatctagcgtggtttaaaaggccacagagtaatggaagggccagtaactatttttacgtgaaatcatagctcacaaaggacttcggcattttgtttgggtcaattgtttccatttctcactttactttggacatatcttagacaccaaacagccaaacatgacttgaaggatctacttaaggtgtctacattccctgccaaagacaagccaccttctccatgctcctctccccaaagggtaagatttattctaagggttctgaattcgtcacatttataaaccccgtgggtccggcacagcaattaacattggtccaaacggtgtcagtgaactttagctgcaaagaaactacctcatttaaaatttaagcagaccacagggagtagcattggaggaaagagaggagattttctccttcaacattttgagcatactggaatgccaaccccctaggtaggtgccagggccaccacaggaacctgactcgcaggagtcgtcctccgtctctacgcgaagcgccccctcgaggtgggcagggggtggcggcggcgacggtggcggagccgcagagcgagctagagagcgagagcggtgagactctgcggacgtcttcccgcccgccgcgctccgccccacccagcctccgcagcctcgggccggatcgcccggcggggaagatgcgcctcaagaaccaggtagaagcgcctcggcgcaggccccgcacccccgactctgcccgccctctgttacggacacccgctgggccacgtggtcgcgactggcttctcccagcggccagcctggccaccccgactcccagggagggggagagggcccttgcaagaggatcctgcccccgcgctgcccagacctgagggctcctggcgaccccacccgcagcccatctggcggctctggccccgcaggtcagggtcacacccctgccggcctcctgagacttcccggccccaggggagagagctgaaacttgggttgacgcgcgccccctccccagcgacaggcgaccccgcagcagccccgcgccactcctctctgcgcctttccgtagttgtcctcgaggtggctttgttgaacgtcctggtggcgccaaaaagtccaggcagcttcgggcgatcagggtcccgaggcgctgggcgcgcggacttggatcctcagggggcccctctgtgtgactttcgctaattgtctcacrgggagggcagcaccctyccctatctttcctctattacaccccgctgtggacctgggacttgggtatttctagacgagattgggaaggcgcgtgtgttacactaagcagtgctcatgtttagctgaggaagaaggagcctcaagtgttcgtagggtgtacctgtgtatgttgtaattgttgyctctctttgggctgggggctgttatacatgtaggatttagtaaacacaggtcttgaagtcttgaacctgcaggagactcatttgtttctacaaggagagaacctcccctcccccaacatatgttaagggacttgaggagaccacagggaaaccgaagggagggacttctagaaaacaattccaggtttgggggaaaatgagtcatattgattcccaagctgttagccaataccactcaagggtaataattttcataaaatcttcccactggggacttaaatacagggctccacaacacagtttgttgagagctctctggtgcctttaagcctatccatgccccttacctaaatgctttaatttagtagagctccttgagaagctgcctcacattatcctcctgcatttgtgcgcctagcttttaatattttataatacttgcaaattgacactgaacaagctttaacctccatcatttcagaataagtttgatgttttaagtgagatgtgaatggaactccattcatgagggaagtagtctgtgtgaagtgttttgtaaatgtgagtgggttgagtttaaaacactgaataaaattaacgtaacaaggaatcaaaaggttcaatccagatgtttgcctccttgcttcttcaataaagtgacagtacaatgctgcatgacaccacttgcttccttaataaagtgacartacaatgctgcgcggcacctctcctttcagtttttaggtagggtagactgtggcactgtggcttatggggtcaaccatgagcaagtggatggctggattccttccattcattttttaaagcactaacaaaatccttggggccgatggggttgtgacccacccacctatacagaggattttcctcctctactaactactctagaaatacatgagggatttacatgcaggtttttagttgaagaactaaagtaatcctctttagttatcattagtattagcctctgaaacctttacttgcttgctaagataaggtacttgggtgtgggttgtaatagaggtggagttgtgagttagagctggtggccttactaattcctctacttactgtgtgctttgggttgacagaaaactccttagcatttgtgtaagtgcaatatagtttagcatgagagattttaaattagatrttcttggttccggtctgacctcaccactcagtagttatgtgacttgcataattaattttttggtccttcctgccacttttttcgccatagatacatggggttaataccaacctcgtaaagttgacatgagaattaatattatatatgtacagtgcctgccatatgggcattcagtaaatactgctattatcaaccaaacataaacagtagctattaccaccattgctactacatctgcttaaaaatggctccttgtagttggggagggagatttggctacaaagggacaggagggagctcactggggtgactgaaatatgctttatcttgattggggtgttggttacaaaggtatatccatttgtcaaaactcatcagagtgaacctttatgatctgtgcatttgattttatgtgcattatatatcaataaagttcatgcttaaaattaacatccagatgtgttaagtacatgcctttgggaggcctaattctgcataatagcataccttcttcgtaagtttatcctgagccacaggaaagttagagaaggtgctttaatttttcaggttgatgtcaggagtgatggtccatggaaaaaagtgattgtcttgtgccaagattatatttaatttggtactagttttcattagtagcttaaaaaaaattgaaatgttttatttgagcagtactgctcatttgcataatatgataatggatattataatatccatccattattcacagttgctgaaaaatcatagtgattttgcatcccttttcctgctttcaataaattctatgcattgttttagctaagtgaaatatgtaaagtgtgtttagcacagtaccaggcacatggtaaatactgatacatgctagctgttagtttttaagttgatatattcaaattcatcttttttatagggcagaatcaacactatatagattataatatcaatctatcgtaaatatgctgttaaaagtttttgaggtagaaacaagccaaaaattattaataaaatgttgtaaaactgaaatctcacttatctaaacttagtagtcatgaactttttacaacattatgtcttgggaatataggcaaatctgtgagggaagcaaaaacttttctcaaaagcaaacatatatccacaaagagtatgctaactcatttacttagaggcaagctcctctcatattccctcaagcctttttatttttacttcagacatagttctaacatgtttagttccttagtttctcagcctatagtagtttagaagccttgctagatacaagtttcaagaaatattagctgaatgtaaggggcgaatgaattataaagataagacatgagaaatcagtcttattcttgggccaaagtaaaacttgaattagagtactgaatagtattgctgatttattggacattttaatttttattctttaaaaaagttaaattgtatattctctctaaaaagtggggcagtatataatgatgtattttagaaacatttccatctgataggattagattacaaacttaggcttgttaagggcaagcttcagttatctggatatcttacttaatgtggaatgacttattcactcatggtactgcataaatgaggcatctatcaacttgtgatttttttattgggaactggatttttaaaatctatttcatcttttgatagaacaatatgatgagatgaatcatacatagagtattagtttgctagggctgccatgacaaatatcacagactgggaggcttaaacaacaaaaatttattttctcacagttctggaggctagaagttcaagatgaaggtgttagcaaggttgttattctgagatctgtctccttggcttgtaaaatggctgtcttgtctatctcttcatatgttctttgctctgtttacggcctaatctcttctttaagaataccagtcctgttggattagggcccactcacatgacctccttttaccttaattacttttttaaaggccctatatgaaaatacagtcacatcctgagatactgggggttagcacttcaacatatgaatttgaagggacttaatttagccagtaacacatggttttagtaaaaagctgtattgattctttcaaaataattcagcatgcagaatatgaaacaggtgagattttaattcttgttttagaacagttcaatttggatttacatgtgagaaaccccaaaatactcatcatgtaccaacacacacacatacagatacacctacacatacacaccccacactttttgtgtgtaaagctgattataactgaagctgagttagggtcattgtccaagctgagtttaatctgtgataaggtccactagcaatgtctttcattgatcaaaaaagacagctgtgcagtagcttcctaatctttctagttttatagtatcttaggtgatggaagcagaaggtttgactttctcagaagaaaccatttaccactttgatactttcatacccccttgtcatttgagctctttgaccctctggtatctctgaaacaaaataattatactaatcccttgatgcatcttttccacatattcaaaccatgaatttatggaccaaaatttgccacacaagcacctttgttcactcaaatcagagtctggcaatagtttactcagaggaacctaaactgcctactacacagtttattctcctcactagtttgaagttcatctctgttccacatgttcatgcatcagagtatgatattttatccaaagaaaagaaaaaactgctaaacttatgttgtgcaaaaatgactcccaaaaaccctatgtgtgttactgttactaccagtttgtgctaatttgcacagcctctgaacaactggcaaagtggctagtgttgacattgcaactgctacggagttcccagttgctgtaggaatttttaaattttattagtataataacagagtttacagttattcacagtatgttaattgcaaacgcttattatctatagtaccagcttgatacttgatcttatgtttcttttaatagaaatactgcagcttttacttttcattgtaatgaaggttaatcatcactatgaattttcacctatgagcaacaattttgcaacaagttatagttggggtgagtctattatatttaaaatataacaccaaaatagcttctttttgtacttttaatacttccattgacaaacaattgctcatgtctctgagcctcctacaaccatttcagatgactgatggatgattggtttttgttttttatgttttgtgtttttgagacggtcttgctctgtcacccaaactggagtgtagtggcatggtcacagttcactgtagccttgaccttctgggctcaagcaatccttcaacctcagcctcctgagtagctggaactacaggttcacgccaccaagcctagctaatttttgcatttttttgtagagacagggtctctctatgttgcccaggctattctcaaactcctggcctcaagtgatcctcccacctcagcctctcaaagtgctgggattataggcaagattgattgatagattcagtgaatgtttattgagtgtctggtatggacctggcccagttgtagctgtttaggatgtatcagtgaacaaaactcagctatccctgtcagcaaaggaacaagagaaagtagacattaaaaataaccataatcaagaagtgcgtcatagagcacgttagacagttataaatgctatgtgggaaaaaaaatagagtaagataaagagggataaggattccagtggaggattgcagtcttgaatacagtaggcctcactggtaagtgatatttgaacaaaacttgatgaagatgaagaagttttagttgtgtggctatctgggggttataagcagagggaacagccagggcaaaggccatatggcaggagtatacctagaggggttcaagttacagcaaggaggtcagtgtggcttgagaggagtgagcaaggaggaaaactattgtaaattgagttataagttttatatactgagtaaatgttgacgtaaatattgtctaccagtaagtagatgcttagcatagtgattctctccaaatgcttgttgaatgtttctttggcaaatgaatttgtgcttataagaactggttctgaagtgcaatagaaaatggacttctgctaattctgctgctggcagaagttagattaggatctggaaaagggaggaaggcaggaaaacaacctggtagatgctgatgtgtaggtgtctgagtcctgcccaacyattgtcactcccatcttgccaggggaattaatttttcacttatttaatactgaaaattcccttttctgtttgatttttgtcctcatgattggaacttttaaccagaaagaataaattccagtgtaaagaatatactagatttaaaagtgtgagatctgtcaaccttagaagactcataccatagattggtattattcttttttgtttatttcttataggatagaccttataattattatatttgtgtattttgtttacagtttacaaagtatttttacatatattaatattattaatttgatcctcacagcaaatctatgtgagaggtggacagccattattaagttttgggctgagtatctttcatttgcccttgagatgttactctctacccttttcccaatcctttctgtggccttagggctgaccttcatagcttcatcaacaagctcccttgcactcttgcttctggaaggattcagccaatacggagcacttacaggatatctcagacagaagaaaagtgagtttggaatatttacttctccagctccctcccttccaggttactggctagcagtggctagcagtggctgcgtggaggccacatcacctatccaatctacagctacagctttctctctctctatgggttctctcaagatctagggctgggtctccactgtttctatcttcaatgacttatcttcattaaatcctgcgcaatttccctttttgaatatgccttctgtttcctgttgagaccctgaccaagacaccactttaaaaacgacagtcttggagaagttggatgacttgcccaataatagatatccagtaaatgacaagaatagggacttaaatcctggttttgtgacttcaaagcatgatcaatttgttttgttttttttttgttttgtttttgtttttgtttttgtttttgtttgagacagagtctcgctctttctcccaggctggagtgcagtgccgcgatcttggctcactgcgagctccgcctcctgggcttacaccatgctccttcctcagcctcccgagtagctgggactacaggcgcccgccaccacacccagctaattttttgtatttttagtagagacggggtttcaccgtgttagccaggatggtcttgatctcctgacctcgtgatccacccgcctcggcctcccaaagtgctgggattacaggcgtgagcaacagctgcccaacatgaaaatgcttnnnnnnnnnnnnnnnnnnnnacaggcgtgagccaccatgcctaacaatcaattttaaatataccacaaaggaacttatcccaactggtggatagtgttgaaaaaatctttctactttgaccttcaaaattctatataggccaggcacggtgcctcacgcctgtaatcccagcactttgggacgatcaacaagttatttattgagcaaatgacttagtatgaggctccttcaacgaaaacctttacaggaaaagttttgaagttgtgctgacttgagttaaaatttcagagaggtagggtggagatgggagtaaggagaaaataaaaagcaaaagttctgagtagtcatcaactgcagactgcctaaataggaagtctacrccaggaagtcatgtttttgctgctggaggtttgagtaggactctgtataactttgctctcttatgcaacttgtgattgatctgggttagttggctctgctgctattataaaagggatttccttttctttccctggagattgggtgcccatctttttccctacatttctgatagtaaaggtctttttattctcacagcatgagtttctggacaaagggtcatctgggaagcaaaagttgaggatcttactcaggtcactggaactagtgttctagaagtgcctggtgcatgatggtaataatataagtcacaccccaagtttgtattactaataagagttttgtactacaaactttccctgtctgttcttgttgagggggaaatggcactgagtgtaatactgtatggtcatgcaccacataagtacgtttaggtcaacaacgaagttcatttatgatggaggtcccctaagattataatggagctgaaaaactcccattgcttagtgacatcatagccattgtaacatcgtagcataatacattactcatatgtttgtggtaatagtggtgtaaacaaatctactgtgctgccaatcatataaaagtatagcacatacaattatgtacagtatataacacttgataatgttaatacattactaggtaactggtttatgcatttactatactatatttttatcattatttaagaatgtacaccggccgggtgaggtggctcacgcctgtaatcccagcacattgggaggccaagtcaggcggatcacgaggtcagatcgagaccatcctggctaacacggtgaaactccatctctactaaatatacaaaaattagctggacatggtggcgggcgcctctagtcccagctactcaggaggctgaggcaggagaatggcgtgaacccgggaggcagagcttgcagtaagccaagatcgtgccactgcactccagcctgggtgacagagcaagactgtatcaaaaaaaaaaaaaaagcacacctacttattttaaaaaatagtttattgtaaaacagcctcaggcaggtccttcaggagttatttcaaaataaggcattgttatcacgggaggtgacaggtccatgtttgttattgcccttgaagaccttctagtggaacaagatgtggaggtgcaagacagtgatattggtgattctgaccctgtatgggcctaggctactgtgtgcattcttatcttcatttttaactgcaaaggttttaaaagtaaaaaaaaaaataatagaaaaaagcttatagaaaaggatataaagaaagaaaatatttgtgtacagctgtacatgtgtttgtgttttcagctaagtgttattataagagtctaaaagtttaaaaatttataaagtaaaaaagttacagaagctaaagttaatttattattaaaagaaaaaacatttttataaattcagtgtagcctaattgtacaatgcttataaagtctacagtagtgtacagtaatgtcctaggccttcgtattcactcagcactcattcattgactcactcagagtaatttccagccctgcaagctccatttatggcaactgcctataaacatgtactgtttttaatcttttattctctattttactgtactttttctatgtttagatacacaaatacaagcattgtgttacagaggcctacagtattaactagtcacatgctgtccaagtttgtagcgtgtgaacagtaggctatcccatataacctaggtgtgcggtagtctataccacctaggctttgtgtaagtgcattctgtgatgtttgcatgatgacaaaattgcctgacgtatttctcagaacgtatccccattgttaagcaacacgtgactgtactataatatgatgtcaagttaccatgttgtttgggacatatgacaagaacagagctcaagaaacttttgtatacatgggacaatcttgtgagttgaaataatatttctctcaccttcaagggtgtgatttattctttttgggtataaattatgcaagcaaagctagagtattcttacaataaaataattttaaaagacagcaccgaaacatttttccaaattaaaggaagcttgagttatttttttctgatttttgaaatggaagaaccagtccacggggggaagtgatcagagtaaactaaaatttagtgctatgtccctctaatcacaaagtggtgtcatataggggtcacagtggaccatgatctgcttttatagataaatgatgttctgtgggagacgttctccaattcataagctagagaacagatttaaatttacaaaaccaaattgggataaccagtactgtaaacactgtcattataaccatggagcactagattgatgtgagatggattgacattcagcaggggtaaggacaggataggatatataggaggaaaccaaaccacaaaaaaattaaatgggaaattttgaaaggggcagcattcttaccttatgtttctatagcaccctttcacttttcttttacacttatccacatggaaaggttgttataaagggagcatgaaaattgaagattaaaaagtaaaaatgacttcacttgactagcctaaagaaaaaaaaaaagtaaaaatggacctccgcattaatggtaagaattctaagataattccttttttttttttcctgacagtgtcttactctgtcacccaggctagagtacagtggcacgatcaggacttactgcagcctccaccccccaggctcaggtaatccttccacctcagcctccttagtagctaggactataggcatgcaccaccatgcttgtatttttttttagagatgaggtttccccatgttgcccaggctggtctcaaactcctgggctcaagcaatccatccccctgagcttcccaaagtgctgggattacaggcatgagttaccgcacctggcccaggataattcttttattataagtgttcttgttcctttattcactattctggttaatggcaccaccatttacccagtggccctaggcagaaaaatattgaatctagaaattatcctagattcatttttcttccttactgcctgcattaaatttttcagtctctgggtccaggtggtcaaactgatacctttaattagccaacatttattgagtgcctagtagagtggtataaataaaaattgccacccttgtagagcttgcattttcttaaatatcaatcatatttctctgattctaagataagatttctgagatggaatgcattttacaataaagtttaaaaaatactacactaaaacttagcaagttgtgatgcagttgtcattgcctatacatgcacggacttagtggagctcacagaaagtacctgttaaactgtcacttcagttcatttatttgcatttggaagcctcatataaaatgaaattttaactgaaatttggatccctgattgttatttaaaatgttaagaaatagccagcaaacacataaaaagatgttcagcgtcattaaaaccataatgagataccactttacacctactagcatggctatgatttaaaaaaaaagtattggtgaggaggttttttaaaaaaaaaaaccgttggagaaaatggaaccctcctgttttgctttcagtccttggcatatatacccaaaggaatagaaaacaagtattcaagtacaagtacacacatgttcatagaggcattattcataaatggccaaaaggtagaaacagcccagatgtccatgaatggatgaatgcataaacaaattgttttatataatgcagtggaatattattcagccatgaaaagaaatgaattctgatatatgctacaacatggatgaacctccaaaacataagtgaaagaagccagacacaaaaggtcacatattatattatttcatttatgagatatccagaatagataaatctatagtgtcaaggcaaattggtggttgccaggggttagggagcaggggtgaatggggaaaaactgcttaatgaataagggggaataatggaagtgttttggaacttgatagaggtcatgattgcacaaaaatgtgaacctactaaatgccactgattgttcactttaaaatggttagttttgttttataaattttatctcaataaagtatttttcaaatattccactgtgctacagaattgaaatgaagttattgtatgccctaaagtttacctgtcatatactgttcattacaagtaaaaacagaatagtcaaatctctttatacaaaacctagaatttcagagttcagagagattgttatgaccttttcaagtgtcatcaaggaatgtcatttaggcacctgccgtctgtttatcaaaagctcgacttccaacagaagctgtatgacttttcatgatacataattgggtataacaggagtgtccacattccttttcccctcagcagctcaaactacatcaatatgccacaatcaggaatcataagtgatgtcatgctttgcagctaagtcatagagaactggtggcagagtcacaacttggctcaggatcaagatccagagcagtgactaaggacttcatgaagcagaatctcctgctcttactatggaggagggcctgggtcggcctctagctgagaaggtgctacactgggtcctctgttctaactactgcactgccaccagtatgatcctacttgtaggaatactttcccactgtcacctgccaagtctcaaacaagtctcagaactcagtgagactcataggcacagtgagcctatgtctccacactttacaggcccagaacctgatttccccacaccactccatctcttctttgtccattgtggctggacaaagttgtctgcctacttcctctggccaggtaccctgagtgccttgtagcactcaagcatgatttacatccctcattcaagataatttttcttctatttcccttgttggagaggaaaaagaaatagacatgtgtttaatatccagcacagagtatctctatacatttaaaaaatcaaagctttgaataaccaaatgcagaacaaacctcaatattccgtgatamctcttgagattgtaatatcaatcctaaagtatcaaagaggtcaagttcaccagcatggattttgaaaagtaaggtccttatgatgctctgcgcttaactgtcagtgaacaaaagtgatggagaagatatttacataatagctttggtttgttcataaaattatatgccaatttagttttcaaggtttgactctttgctgggcttgaatagtggctattttctttggtattgtttttaacctgaatcccttaaggcaaggcatgtactctccagttaggctatagagaccatgggcctcctttcctcttttttaggtccatttacacatttatgtttcctacctatcccctgtagtcatttgagtttataattactaacatagactcaagttttaaaattacatgtagttgtatagataactcacagtaagaccaaatccttaaataatgcatactaaattctgggcactgtttaacatgtttaatccatagtaactaatggaaacctcacaaccccatcargtagtgtggccctcatggaggtgcaccattcagatctgcctttaagaggaagcttatgtttgtttgcaaggagtgcagttagatgacagtctccagttgcagtgcctgtaggccatgcttttgctgggcggtcctagccaatgactgaacactctgggagtactaaggcctggccatttctgcccagtgtgggaactcccctaatgggtaatctttatttcagagctctccattaggttggcaggcctttgtctgatttgcctcatagtctgagrctctgtctccaattctactttcttcaccctcctcgccccaaaattttcacagcaaactaataaatctcttgcacttctgtctgtctcattgtctgtttctgggtagacccaactaatacggataagtattattattatcctcctgtcacagatgaagaaactgaggcacagagaaatggctcaaggtgtcacagccaagtgagtttcagtgttcttcatcatgtttttaaccattatggtatgttgccttccctttctgaagttcatgttcatccagttaagtatcctttgtatcccagaaacttggctggatgctagaagtatatagatgaataacatagcctttgatctcaaggagtccacaatcttgtggagaaaacaaggagaataagcagatagcatcggtctttgctctaaatgcaatgatgagatatgtgcagggtgccctgagagcccagaggagggacctaatttgtgtcatttctcacttcttctacctctgaatggactactcttcctcctcttgttcctgtagccatgccatcatatttatctgggatgcctgttatgtctttggaccaccccaaattgagttgggcatgactattctgtattcttacaggaaccctctgcacttaccataccacacccaccttaattgatatttcccagcctgtgtcctgcttgtctgtgtgctcagtgctacttcatgcctgccttgggccctggccccttgaggagcttaggaagtgtttgttgaatcaatgaatgaggagaatcatttgtttgcttggcctgtaagatgtgaatagaaaagagatttgaaatagaatacacaggagggaaaaggtgggggcagatgaattctaccattctcttgagagtatctcaccttatttctcactgtcatcagcaggtgtggatttgggatgtttccattcccctttaaatttttggttcaaacatggacacatgctttctatcttgcttcccgatgatacaaatatgttaagctgagtttttatccattaatccatccatccattcacccatccatacttgtttgttaagtctacyaacccatatttatctagtactctcatgtgtcaggcccagtgccaggttctgttcacacagtggtgaacaaaaagcacagtctctgtcctcaagaaggtttcattctggtaggataattggattctaaacaaatgtaacctgaatgtcctctagacccctccagttggatcctaggagaggtcactttaaatatttccagtggatatatagtcttccacctacaaaatggcacactgtcagccttgctcctttcttgtatctctctggacatcctcgaggccattttttccatatgaaataatgcatattattaatagattcttggtaattgagtaaacgcttcatacatggtgaatattatttttattattaatgatatttatataatgtgttctgctacttacagttttgcctttcttttcttccgatgactcttctcaccatatttcctggtcattgtctactgttgttttgtttgttgctttaaagctgcctgtacctttctcctatgctactgccactgtaggaaacacgtacatgttatattacctgatggttttttagcttcctctatggccactgtctccagatctctgttcctatatcagcatttgcactcatctattttgataagcttatctctctggctaaccaccctctttctgtaagacctcttcgagcgtttccaccatcacttggggacttttgccatttttcctgcttccagatctcaggtgctcctctcttcccagttcttggtgaagcattttcttcttgtctggactgccttcatggtagtcccatagcattgtgacatgcgaccctagtaacagaattatttcattctttatcacactgccttccttttctcagactgttaaatgtggctttcagttagaacctcttactggacctggaaccaccaatctcatctagcttcaggcccactgtatcagcctctttcctcatgtatggtcttttcccacccagggattcctgttttccctattttcaactggaagtgacatttaaactaaggaataaaggaaaattaggaattatctaggggaagagggaaggcaggattgagtatggtacatagaacaaatgaggaatcccagagaaggaaaagcttgtgccaagtcccagaggccaggagcagcatgggtgtgtaatagagaaaggtgtgctgagaaactgcagtcattacaatgtgtctggtgtgtcatagagtgcaagggcataggtggcaagrggtacccctgggaagttaggttgtgttagatcaaggtgggtctttcctgggtattgagaacagaaagaaaataatctggaagtgaaactggttgaattttctcaagtgcaggtgttttattcttaccgattttttccctggcccctaagggctagaacaccacctgctgacattctgtatgtatgatgcatggcttgcattgcttcttggcccttttctctatctttttttctactccctggactagactaatcttactattcattttctagatctattgattggcatgacgtggtagttgtttcaagtttccaggatccagctatcagtcctgccaacttctggatatgttggaactctcagatgaatcttttttgtctacatactaggaattggccttgtccaaagtcaccagatttaaatagtcaccacatgaatatcttgaagatacagtcaccatgacaacccaaaacaagaatcatacacctatggcagtgacaggctgtgttcccacagagaatttcccatcctattatccctcccatgtgaaggcttgctggatagatctaacatacttttctctcactccactttgaactctggaatctgactgtttattccattcatttgacaattagtaataccctcttacttttcrtctcttactgttcctttagccttttgtatatttctgtcttgcatccccaagtggtgttgagttccatgagggcagggaatatgggtttaactgctttgaagcctcctcaagggccagtcttgtgcctagagacataggggatatttggtatatgttcagtaagtggaactgtcggctggcaattaagccttaaggaaggcatggagaacctggagaccattcagaagagtggccaggcaacatgggtgttggctgtggagttactagacttggagttacagcccaaccagtctgctcaccccccaccttttcctctcacctctataaaacaaaggtgatggtggaaacttaatgcttattgtaaggatcaaatgaaataacatatcaacaaatgaagtcagtttttgctgttatttatagaaatggccttttgagttagaacaatcagaagtgaaggaaaaggttagaacagattataccggagaagactgggaaaagttcctatttgttggattaaggaaaagatgctctttcttagattaagtgctgctctgaggttggactgccagatttgaatttcggtcccattgtttgctagctgtgcaacactggagcaagttaacttaaccaatgtgcaccttgattttattataatctataaaatgggaataataatatttactgcataaatttattgtgagaaacaaatgaaataatcaaataatccctgcaaagtgctcattagcagaatgccagacacatagtatgtctcggggtggactggtttatttattgttacttgtatcagttacctattgctgtataattaaccacctcacatgcaatggtttgaaacagtgaatgtttattattgctcatgagtctacaagtcagttctttttatctcagttggtcttattcttatgttttagtcagctcttgggcaagaaggtagctctgctgatcatgaccaggttctttcacatgtgtcggggttgagggctataggctatctaaggatggccttggctgggctcactggactatcttccatgtgatctcttttcctctagaaggagaaccagggcttgttcatatgacagctgggcagggtaccaagagagagcgaaagtaaggaagaagtgacacggtggaatttctactgcatcctattggccaaagcagatgacaagaccagcccagatacaggagtggggaaagagattacatctcttttaggaagatctgcaaagtcacattgcaaagggcatagttataggtaaagattgtgctagttttgcagttgatctaccctaccacccttacattccttctagaaataagagaaacaaatcgttgtatcatgttttacagattacaaagaccttttgcctgtaaccactgagtcttgcaatgagactgtgagttaaggatgttttagccttcataacatgctagatactatcttaggcacatacttcttttgaaacctttttcttgtccttccagcacacattgatcgctaacatttgaatagtaagttttcctactaatcctactgctttcctgattcttcaaggcttatgttattttctttcatcatttcatgttctacccatatgcagagaaattgatactccagcctaaatcccccagagctttgtttttccatgtctaactgctgttggccaactcttcatacttgtcacatggctgcctcaaactcagcacgtccagatgcataaccagacatcttattattttaaaatataattagactcataatttgcagagtaaaaaatactatgaagataaaaaatacatgtagtaattgtttgactctttaagtcctgtctgtatgatttttcaccctctaaagttttggatacactgaaaatggctttctataattaatattcttaggaaaatactctctacacaaaagcattttttactcagccttaatcttaggtcagtaggtagggtcctgaatgcagatgccaaagagcttaggaaattttcagagtttttatttagggtttcagtggtgcttctaaatrtagcatgtcccatttttccttttccctcaaactgtctcattgatgtaacatgaaaccaaatagaacagtgccgaacagcttgaaagagtgaatatcatgtgttgaaaaggaatatcacagtatcacctggtaaaaatagcttgtacccacagcaagcagagattggtgcactctgggagagtgcatgttttttaaaggttttattcactttcccctccccaagaaattgacaggtgtttgcaaaagccctatcaagtaagaggttgatggattgtaggaggtgggaggaaagaacctttaagcttagtggccaagtaattcttaaaaggaagcaacagaaatgtggttaaaatggtcctttacttttccttgtcaccaatcaaatatgttcgtattcttgaggaytgaggtagtgatttgacaaagttaagattaagaagcctgcagaggaacaagtagggaaccatatcatgtatttattccatttaacaggcattaaccaggaaacactctacctcaagtgtccagaagatacaaaggtgaaatagacatggatcctcaaggagtttccagccatgtagggaagatatatgtatgtatataaatatgcatataaatactaccaagttgaaagggacagatgtagtcagaaagatataggtaaaccgatacagggtttgtatgttctgtcatttatttattctgacaaaaattgattgagtacctattgtatccaggcactgtgataggtgctggggacaaagtttacattctagcagtgcatgtaaataacaagcttattgtattagtccattctcatgctgccataaaggagtgcctgagactgggtaatttataaagaaagaggtttaattgactcacagttccacatggctgtggaagcctcaggaaacttacattcgtgtcagaaggygaagcacacatgtccttcttcacatgatggcaggaagaagtgccaagcaaaaggtggaaaagccccttataaaaccatcaaatctcctgagaactcactcgctatcacaagaacagcagcatggaggtaactgccgccatgattcagttacctcccaccgggtctctcccacaacacgtggggattatgggaactataattcaagatgagattttggtggggacatagccaaaccagccaaaccatatcacttataaaccactaaacagacaaaataatgcagtttcagatcatcattaagtgctgtaaggaaaataaagcaggttaagggggataggttaggggaacttgtttttcagtaggtggtcagggatatgtagagataggggtggcaaattgaagatcttcctgaaatctaagaccatgcataactagacatgggagaataaggatgtcttcatgcaagagcagtccactttggtatggcggtgggtgagagggggtaacaaagctcagaaatgtagtgaatctccatattctagtattttgaaggattttcaagaggtagaagacaggaccaagctgggaccaatggctggaggtttcaaaagtgaaaatctatgctgtctagtagtagagtgtagaagggcttctggcacactgttgttaaagcctggtcaactgcttatgaactccacaggggcacaggagtggtgcctttgtcattgtcaaatccttgtcatctgcctcagtgtctggcatgtagtagatgatcaagggttgatttttgaactgcatttctgaccgtcacatgtctggttgtgtgaaatctgtggatattctaggatatagtaggtgattaagaactgatttttgaattgcatttctgaacatcatgactggttgagtgaaatatacggataagttaagatggctatggatttaaatggaagtctgcagataacattttccaaaaagaatgatctattctggtttcagcatccctggatgaaatgaattaataacarcgctttacttaatagacagtttctctttctaggatcacagagtggttttattgaccatagagctgtacctgatttaaacagggtatggtaactgaatttcatttattccacttattcacaaaacatttatttattttagagagaataagtattttacccaggatttcacaggtagtaatcactgaggccttgtggctctaagtccatgctctttctactacatcctgctgtcttacatgaaacagattttatttcattttatgcatttctgtttatgtatctctatgtcatattttaatttctgtaacagcagcatcatttaccagctaagaggactgcctgctttggatggagacctagccactgtggtgacaaggacacctcattctctgtgaggtcttctgcttaatgaagcccttctggacctctctggcctctattattgtctcctgtctctgattacctatagcatttgtatactgctccacacctcacacttagcttattttcttgttaattctggttgagtcttgtctccctagatgtagaaaatccaaaggctgttttttaaaccagaagctccattgtccaacactagacatgggtgcctgtgatctatttgtttgatttagaatcattcatggctgaaaggaaagttgaactctggcccagagaagttgttcaataaatattttttggatgcatagtcttggttcccctacaaccttgcaatttattcttggcatcattgttttccggtgttcctcttagtgatgttgttaacctcaccatccttgaatcaacgtctggggtttatctctgtaataataatagcagcttattttttagcattattactgcatataaagcatcatactaagtactttatacaaattctcttattaagcccttatcatcactctctgaacctagacagcctgaccccagaacccacactcctcacctgggtactatatttcctttgtagacccttcttgtgcttaccaactcacaagggttcagcccttatgaatttctggtgaaggtgtgttgaagatattacctaagtattgtaaacatttctaagtcctttctattttagtgtcaaggctgtttttaatatcttctataaaattctgtggtttctttttcctcttaggtagatttgctaagtatagaagtgtgcagggaatagctagactagcatagaattgatatatttgccactcctggatttgccaggcaacaggattccttgttttcctgagctttcttgacactgttaatggtgttggacatagaaggataatgtgggatgtaaataatgaacactggaatgaagtggatagcagttcttgggacagtgtttctagtttttaggaaatagaataaaacttcaaaggccagagagggctgaagactgcatttattttcctgaatccttatttggattcccactcatttattactatttgacagtgacttattggggatagggagaatggggtcctctatgggactccctgcctcatcattttcattttccttttaactaccctgtgctttcatttgatagcaagactaaagaacatgaaaatgccaccgtggctgggcgcagtggctcatgcctgtaatcccagcactttgggaggccaaggcgggcggatcatgaggtcaggagttcgagaccagcctgaccaacatggtgaaacaccgtctctactaaaaatacaaaaaattagctgggcatggtgacaggcacctgtaatcccacctacttaaagggtgagccaggagaatcgcttgaacccaggaggcggaggttgcagtgagcagagatcgtgccactgcactccagcctgggtgacagagtgagactccatctcaaaaaaaaaaaaaaaaaaagccactactaaacggtgacgtttcagaagggcagataaagttacataatatttttaggcttcaactttttgctttggaaataccacatactccataggactgttggtggaataaataagatccaaattcctaactgtggcttgcaacatccagtattatctgatctcaacctgcctctcagacactcagatcttgttgacgcttgctcaccccacttcagtctcactggccctcttgctcttgttccaggatgtccaactggctccttagcgccatcctgctatacctgcacctccagaccctcacacggcttcctccttcacttggctcaggcttctgctctcaaggaccccccctcagaacagtccttctctcatctgcagtccagaagagctctccctccctccatcattctgcctatccaccttatcctgccttgttttccttatactacttattgctatctaaaactattttaattttttattacttgtttgtgctaccttcatttgaatgtaaactctatgagggcaaggattttgtctatctagtttccttgtctcctcattacgccatggacataaatgtgcctggcactattcattccacaaggaatgtttagacttcctaatttcagctttgtaacaactttttttcttgagtcgtgcatcttttatttttgcaaatgtagccaataaaacttaatttgacaatttgactagcctcagagtcaaattgaagttcatcgtgaatgcagcttcctactggaccacatagccacatacacaaaagatgccttttgtgtaggaaacattaggggcaggcctatcactagcaggtgattttgagagaagcagctaaggtaagatggaaagaattgaatwtgagtaaatcaagagaacaccaagagctgtatctgaacatgacggaaactgtaaccaaactggatgggcaaggggtaccagaagccctatacttatagggtgactttgatcaagtccttttacctcctctgcatttcagtttccttgggtgtaaaatgaggcccataggtggagaaatgggaggaggagaggctscctaccacataagggtgttgaaaaactgttgagagaacatacgtgatagcagtctatattgagtagcactcacataaattgacataaatgcatataaagtgcttggcatccagtaagtagtcaacaaatagtacctattactattaatattaacattattaaatcacttggaaatgatttgaagcacttgtaaagatttggatctcttactagtgttaatgattattttctttgaatttaagcaaaatttcgaattgtcttctgttcctgtttgcatttataagcatgggagggcccatgagtgcagtgagtaagaatctagactctagagtcaagacagaaatgggttcaagtcctgaagtaaatgaataaataaataagcaaattgactaaagttcaaacctaatcttaccccaagcaagcttttattttctttctctatcaaattcctgtccatcttgtgaaggagacactgtggccaaaaactaggagcaagagaaactgtaggctgggtaattcatggatgccttttgtacctctctatgaacgtgaaccccctgtattccttcyccagcagagacatgagcatgctttgtccacacagccccgctgggccttctcactgttttatgagacagataccaagacacatcagagtggcagcccctcactgccatcatcactgatgaatgacaaaagtttggaaaagaaagagctatggacaaataactctctccctcaagctcatcaagtggggacacacatcctccttgtctcagtggtttcctgatgtaccttgaaggtccttcacatctgtggtccttgcaactgctgggaatgacataaatcataatcctgatataaagattgattgaattcttgccaaatgccagacattgtgcttaatcctttatctgaatccttctacagcactaggagttgtaggtactattattgtcctcatttttacagatgaggaaactgaagtttcaagagatgaaataactttcccaaggtaccccagttaaaaagtagaagagttaggctgtcaatcaaagtcatctaacaccagagcttgtctgttttctgccagactgtaaactctttgggaggagagacaaccctctcattcacctttagtccccatctatacccagtttcacctcagttagtagttattaagatgaaattttaaaatcttttcatgtggatgatgccctaatgtaccatgagtgtatcttgagttgcaaggtagaagctgtcttcacctgtgcattctactcagcctttgcacagacacacagtctccctctagcctcatggtaccagggagtggagggtacatctctacagaggaagaaacattctgccagtccttcatagtaagtggtggagttaggatataagctgagggccctcaacttcatatttggccattttccctcttctgtatctttaaactttaaagaaatgtggagattttgtggatggggacaatgatatttgacaaattcttttttattattttaaaaaatcctaattgtgaggcaaaagttattttaatctctaatacaggcaaaaatgcttcattgattttttttttaaagcaaagtaataaaaacccatgtccttttttttggaataaatattatcactaggtgttgaggtctgcaagatgctaaataaggattcgagtaaaatgctttgcaaaaccatttcaatgcaaaatcaataatatgcattaaaatttatgaaaaatgaattaagaaaaaacaaccccttaccttttagtggatacacacacacatgcacaaacacacacgtacacacacatacacacgaaacattaacatgaaatgttaacttttggtcgtccactggagtttgaggaataatggcttcgtaaatgagaaaaacaccaagagctttgtatgaatataatgattgccataactaactagatacgcaaactaaatgcacaaagactctaagtgcataagaaagtagaagtctaacacaggatcctakaaatcccagaaactctagactttcagataagaatcctatacctttagttgccttctggacatcttcattggatcttgtgaatgagactgtgaactggtatttagctaagcatggctgcaaagcatgctgagtcatcagcatggtaggtaaggagaggtgagtggtggccagcagtccagaaaacattattttgaaaggttttactggtaaagcttcaagatcaagggtcctggggccatagatgtgctggcctggctggctggctgggctgtgcttctctagtttatggctaaagcccagccaaattcccttagagtaacttaagatttgttttatagttacttatattttttgtcttatctctctgtgagttccttgaggagccagtctctgaccggttcattattttaactgttcttgctgtatttacttcagagtaggcactctagaaatctctcttgagtgaattaaaggatgatttaaagagcattcacaggaagatcgggtacaaaaatggtactacaataataatgacaataattgctaccatttactgagcaccttctatatgccaggtgcattgttcgcatttctgattcctgtctttcaggtcagcaaccttttgtcaaatattcactgaggctgattatatgtccggttttgtattggctccggagttttcagggaagaaagggacccagtctgttgccttgaggaattcacagaaaagataaagtgcaattactatatggtgagctcagtgcttcaacagctgtgggagtttatgcacagtgacctaataaccttgggaaaagaggggtcatggtggagctaaatcttaaagatgaaataggaatttgccagatgaagacactagaggaaggcaggggacagtggatcagtctgggtagacagaacagtaaaggcagaggtaggaagatgctcagctatgtgatgggtttatggaacattaattaagaaaatatatagaacactggctgtgtgctaggcactggggatgtaattatgagcaaatcctcatagagcttataatctagtatttatgttatctaggggatagcataaataatagtaaaaagacaaacatttatctacaaattatagtaagttctatgaaggaaatgaattagattctaagagaatagaacataatttggatttggtctttgtgagaaaggtacatttaagcagagacataatggaataacaaggaagtgagtaggatgaagtgtgtgtcagatggggaattccatgtgagtgtaaaggccctagggcagccatgtttaagacgatgtaaggccaccagggagacagctagaaagagatcacatcaattcctttaggagacattttagggaatttgcattttatccgaggtgcaaggaaaaggtattgaaaggttttaagcaggggagcagcatgagttttttccttcatttttaaatgaaaattttgaagcatacatcaaagttaaaggaattttaaagtgagctcctgtatacccatcacataataccattttcattttattggatacaaagatgtgatgtatttttaaatgctctgtcctctttgtagaagagtactgaagaggaaggagaaggggaagtgggagctctagccctagtctcatcatttactgtcatcgcaggtaaagaagagctccagcatggaggcctggaaggctgctctgcacagtgtgtggcagaggccagaccacagtgggttttttgtatcatgccagagtacaggtggtcctatacttacaatggttcaacttactattttttgactttacgatggtgtgaaagcaatacacattcaggagcccctcgacttaacagtggggcaacatcttgatgaacccgtcataagttgaaaatacatattgtcagctgaaattgctttttgacttatgatatagatatagatagagagagagagacagagagacagagagagagagagtctcactctgtcacccaggctggagtgaagtggcatgatctcggctcgctgcaacctccacctcccgggttcaagcgattctcatgcctcagcctcctgagtagctgggattacagscatgcaccaccacacccagctattttttttgcattttagtagagatggggtttcgccatgttggccaggctggcctcaaactcctggcctcaagcgattgtcccaccttggcctcccaaagtgctgggattacaggcatgagccaccgcaccaggccaacttatggtattttcaattgagatgtaccccgatcataaatcaaggagcagctgtatatgtaggccatggggagattgtagaggatttcagttgagagtaaggtaacctcttatcagtggttttactttccacagtttcagtgacccttggtacttgaccttgatcccaaccttcgtcaaaaatgctacatacagtaagatattttgagagagagaaagagatcacgcttacataacttttattacaatatactgttatagttgttctattttattattagttattattgttgatctcttactgtgcttacttcataaattaaatgttatcataggtatgtatgtatgtatgtatacaaaaacaccatagtatatattgtgttaggtactatctcagtttcaggcatccactgaaggtgttggaacatatacccagtggagaagagggaactactgtagtgtgagcaggcttgcatattccaagggtcctggaggcaaaaatgtgtaaggaaatgtctgacatgagatagacctgggcctgggaagtgagtctggagcctttagtcctatgcaagaaagaggataagctgtgttstgtaaggccagggagaatgggaagaaagagagagggggaggggaaatatttgacgattatttaggggtataatgcctgaaccataatagttgcttgataagcatttattgagtgaattaaagtacaatcagcaggacttagaaagtcctggtgatgaaagacaaggagatgagttgtaacctgtgcaagtcactcaacttctctaagcctcagctcttcatctgtgagaggggaaagctaagggtacttcctattatatttgtcaaaaatctccagagaaacaaagtaaatgggatgtttctctctctctctctctctctctcatacatatatgttagatacatgaccctatactgcacagcttatcctctttcctaaagaagactaaagcctccagattcacctcccagacccagttctatcccatgttagatacatgtatataagtagatacatgtgtatatgtattaggtgtaggggagacatatagggaattggctcacatgattgcagagggtcacaaatsccaaaatctgtagtcagcaagatggagacccaagacaattgatggtatagttttagtacagatgctggcaggcttaagcctggaaagagccaatgtttcagtctgtgttcaatagcaggaaagaattgaagtctcaccttaagacagtcaggcaggaggagttccctcttacttgagggagggttggccattttgttctattcaggccttcaactgattggatgaggcccacccaaattagggagggcaaatgacttttttccgtctagggagggcaaatgactttattcagtctactgagccaaatgttaatctcatttaaaacacctcacagacatatctaaataatatttgaccaaatatctggtcaccctgtgacccagtcaagttgatacataaattaactatcatacttaccctgcttgctgtgaaatgctgttaagttttaaaatactgtacacatgaaaggaagtatcactattgattcaaagagaaaaggttactttaatgataatagcttaattttatccagtgcttcccatatcccaattattatttggtcttactagcattatctcatttaattctctcaataactttatccctctgtttacccgttagagagtccatgtctacaattgttgctgcacacagattccctgcattaagacatggtgaagaggagcacagtctctggagccagacttccatggtttcaatcccagctctgtcactagcctacatgaccttgggagcaagttactaacttctctgtccctgtttcctcttctctgaaatgggataattgcaaagtgcttaggacagagcctggcatttagtatacaaatatataccttgtgtgtgtgtgtgtgtgtgtgtgtgtgtgtgtgtgtatatagtatttgtgtgtttatatatctatgtgaatatattgcagtagtagtggtggtgatgacgacagtgattacacagagagcaaactctcatgccttcaggcaccagtcaggtaatatcagtgtgtgaagcgataaataataggtcaatatggagtgggggaagtgagtggagaactagggagtgtcctcttaacttgaaggcattaaaatccaggaatttccaaaacactacttgggccacctaaaactcattttttttttaccctcaggttgccgtctgccaaactgtaatgagtgtttcacaagtacttcccttaacaattgtgctagcagagtggcccattttacagatgtcaaattcgaagctcacttacaaggtagtcagtaccaggggaaactgggactgaacaaagggaacagaggtctgactccaaagccagtagggctatttggatggtctcaaggttcctaggtgagtggaactggaacattcagttcgtcctactgtctgtcatctctaacccctttgaggatacgatctctcactgatctgtggcagaggtagagcaagtgaaagaggaaaggtgcctgtggtgcttgcagtctccctggaatgtcttctgtgctctccctgtgcaaatcccacatcctgctgacaccaccctctcttctccattcccgtgcctatcacatgtgcgtctgttggtggccatgcaggttatggctgtttatgtttgtgatgctccttccattgtgagctcagaagggttagacccatattcatttttccatctcctacctgtttgagtttccattgagtaccatccattaaataccatctgctggatctgagttctagttattatccatctctcatcaagtgatgaagtctgggtgattcatttgccatctaagatgttcagtttctgcracttttaatttgtaattatttattattattttttagatggggtcttgctttgttgcccagactggtctcgaactcctgggcccaagagatcctcctgcctcagcctcccaagtagccagagctacaggtgtgtgccactacacctagctctccatctttaaaactgggataataactgtcacaagttgtattccccaggaagtagattctgatgtagactagcatgtaggagatttattagggagcgttcttgggatcatcacaggggaagagaagggaaggaagcaggatcaggcaaagggagaagagaggttacagtacatttttaatgaaggcctcagccccttccatgagaagctctgaagctaagatagcctttcaaaatagtcctgagtcagggtgagggtgtcaggtctttataccctatgttgrtcactcactggatgtggacacctcaagaagggggcatgaccttgggaaagacaattctctcagtcaaggcagtttcaaagagagttgacagttgagggttgtctaaactaaagttattctgtttcagaggaggacttggaaggcatcacagcctcccagtaacccaagaaaccaagttggttaacccagttactcaagtaacaacttcacaggaaggttgatacatgtaaaagcatactgtaaggtgttaaacttaaggttttagttgttgttaatgttaaaagtaatattactggggctgggtaaatacttcttcaactgagttgattctgtgtttttagagcagcttctcaataaaactcatgcagttagtatacacccttgttttattcttctcacttcccaaagacacccttctccctctctcttttgttattaagctcatcttaaacgtgcgtatgccatcctattttaaaacctctagggttggtttgatttgatttcctttccactgaaatgactgttctgaactctgaccttaatctgggatggttagaacagctggaagcactttcttgactgtctatctatcttcagactttatattccatacagtctcagagaaagtttaagtgcggtctttaaacattgctaacattaacaattcccatcaatgaagttaactaaatgtaaatcagtactggcactagcattcccaactttgtactgatcctggataggcttgtaaggctcagacgtcagaatatcttagcagaagctgacaacaggaaaaatgaatgttctaaagatcaagaatattgagcaactatgagtcaattccagggactagctgcttatagaaaagaactgtgtatgggagttcaaaggtgtaatatgttgttgatttcacacacacacacacacacacactcacacacatactgatgtggtcaggcaatcattctctgaattccatcatcatttgatttctctcaaatatatatgtgtatatatttctaactcacaaatctcattgtgtcatttccctgatgaaatatcttctgtagctccctgacatctccatcagaaaatctaaagtcttagcaaagctcttatgttccctaaatatgccagaatttttatgctgctgtgtctttgggcatgtcgtttcctttctgcagaaagctttctcattgcttatgcatccttcaggtctcagttcagatgttacctccactggacagccttccctggcttccccacaatgacacttgctgttctgtgctgcctttcctccaagacagtgagctgcaggatggaaggaaataaattcgtggactagttggaggggtgagaagatcagggtagagagagaatgggagaagttatatgcaaagcctttgtacttaaaactttcatcttgcagagtcgatactcggttatatgtatctctaaaagtgtgacttaatatatctgatatttcattttgttcttggctttaagaagaaccagaatcttttgattcaaggattagaagagcttctaaaggtaggctttctgacaaaaggaaaactttcccctgactgccctcttgtggaggtgccaaaatagcccaaagatggcaagtcyataaaatcatcataaaccttaattgagagagcagttttctgtactgtctgttgtactggttagtcaagctgccatatgcatataattacatatttttaaaatttgaatgtggcaaggcatgccccaaactgaattcagtttgtctctggtaaatcagatggttcttcaagaatacagaatacccagagtgaaggttatgaacagcacatggagacaggccacatgtgattaagagcggtctctggtggatgaagtgctagatgcacactagctttcactagcactttaagttccatttcccctaggctcatgccatgcctaagaatcatctgctgacctatgttaaaatgctgatttctgagccattcatccagattctgattcagtgtgtctgggctagagcccaggaatctgcctttaataagcacaccagggtgatgctaatggatgtagcccttttgaatcttgcagtggggatgggttttatagagtcatttacatgcttttctacaactggggcaactttcttattttattttgaaaattttttattgttatactttaagttctgggatacatgtgcagaatgtgcaggtttgttacataggtatacacgtgctatggtggtttgctgcacccatcaacccgtcatctacattaggtatttctcctaaagctacccctcccctagtacccccaccccctgacaggccctggtgtgtgatgttcccctccctgtgtccatgtgttctcattgttcaactcccatttatgagtgagaacatgcagtgtttggttttctgttcctgtgttagtttgctgagactgatggcttccagcttcattcatgtccctgcaaaggacatgaactcgtccatttttatgactgcatagtattccatggtgtatatgtgccacattttctttatccagtctatcattgatgggcatttgggttggttccaagtctttactattgtgaacagtgccacaataaacatacatgtgcatgtgtctttatagtggaatgatttataatcctttggatataaacccagtaatgggattgctgggtcaaatggtatttctggttccagatccttgaggaattgccacactgtcttccacagtggttgaactaatttacactcctaccatcagtgtaaaagcattcctatttctccacatcctctccagcatctgttatttcctgactttttaaagatcgccattctaactggcatgagatggtatttcattgtggttttgatttgtatttctctaatgaccagtgatgccttttttcatatgtttgttggccacataaatgtcttcttttgagaagtgtctgttcatatcctttgcccactttttaatggggttgtttgtttttttcttgtaaatttgtttaagttctttgtagattctgggtattagccctttgtcagatggatagattgcaaaaattttctcctattctgtaagttggactaggacaactttttatagaagtcatgattttacctattctcatctattgtctccattagagcactctttttagaacttatgccttgatttttggcttgaaagacatggtcttcatttccatacatgagattgctagtaagaattaggcatttgatctataactatggaacagactttctttcctgtctcctttcctccttccctccttttctctgtagctacctacctgtctgcctaactatgtacctatgtacctacccacctgtatttacaaaccaaccttcattgtgccttgtacccagtgaaccaatgtgaacttcagaaaagccagcctttcagaatggggattaccctgggattttgacctttttgatagggaaagatgaaaaagcattggccaggaagtttagctctcctagagaataataccaacagccatttttttaagatatggagtctcactctcactcaggctggagtgcattggcatgatcataatgccctgtagcctcaaactcctgggctcaagtgatcttcccacgtaatcctcctgagtagctgggaatacaagcacacaacactttacctgactaatattttttattttttttattttttgagacactgggtattggtttgttgtcctggcttgtctcaaacccccaatgtcaagtgatcctcccaactcagcctcccccaactgccatttcttgaacacctgccagataccaggcattctataagactttttaggtacattattactaattcatcaaagtagttcacaggtgaggaaattggaagcttaaagaggttatgtactatgtaagtcatctagagtctttaaggttgaactataacttgaatcaggtatgtctgacttcaaagctccttcctctctcactggatgagcatgtatctaactacctgcaggtggataccaatggtcatcagccttctctgggtctactagttagttttgttgtcattaaacataaaatttggggagaaaactccatattcaaaaaagtaagttagcaaatcaagcatttctccagggcacagctgctattttcccactttctgagaaatctgaaaatcagtattgaaatagaaaggaaaagaatgcttactgtgaatttttagaagtttctgaagattgttttaggaccacactgggcagccacgtatcttaattttgcattttgtaaagaacctgtggcattgttgacactcctgaaaggtcaataactacttgtttggtatttcaagttaattgtgagtttctgcattttgcatagctgagtctttattgttaaaaggtccctcataaatgttgcattcccctcattgttgagagctgccttgaatgcctagtaggccaatggaaatacatttgttgcagtggaaaggcatttgacttaacacagcgtaattaatttttctttagccatcaggacatttttaaaaatcaagtttgtgtttttctgattatgaaagaagcacatgttcagtgttaacaattaggaacatataaaacagtataaagatgataaatcatccatgatcttcttacccaagagtaattatagtagtaatttttttaaagttctttaaataaggcatgtttaccatgtgtcaactctgttgtagggtaggtgacataattctaattttatagatttggtaactaagcttagaaaggttaaataattgtcctgcttagtttacaacattctgttttcccctagttccaaagcctatactgtcccacataaccactgttaacattctagattgtttcctccaagtctttttttatgcatattttttcatggctgagatcatactgtgaacacagttttgaccctcccatttacccttcacataatggtataagcattttccttatataatatggctctgcctccctccctgccttcatctcatacctgcccccttctgtcttgtatgccacactccagtcacattggccttttttctgttcgtggaacaagtcaagaatgttcttgccttgggacctttgcactggccatttcctctgcctcaaacactcttgtcttagatcttaatggctcattggttagttttttctcatcctttaggtaggtgtcagcttcaatatataggttttccctgaaagtcttatctcacataggtcctgttttctttcttagcacttggtggatttccttcatagcacttcttataacttaccattagttcattttatttgcctttttattgtgttattgtatcaccttcacctttataggtctgggcctaacatgggcttatacatgatgctgcattgaacatttttctatataaaacactttctctatcattatgatagtttcatagaagttcaaactagatcaaagtgtaggaacattttgagggctcttgcttcacattactgcaaaaatttcatcccagcatcccaaagtgtatacaactrtaagcactgtgtgggggtgccagtttcactgcatccttgccagcatcatcagtttttaaagtcttagctattttgataggtgacttaaaccatgcctgcacactgtaggtgctcagtaaatttcatttgctaaagagatgatatataaagttgacatttggccagagttccaagaacacacacatcctttcctggactccttttcctttgaggtcacacagagaatgtaatacagagaacagcagtagccagtgccatggcgtacacctataatcacagcactttgggaggccaaggtaggaggatggcttgtggccaagggttctagagaagagcggcaagtagaggtgcccagattggctctattttcagccttcataatctgggcaggatcttctgaaaactttattttgctaggcctagaggtagccattgtctaaaaawacagttgccccttgctccttttcctctaaatctatatccaaatagtaaggaaggacctattcagagcaaagaaagcatatttgcgttgtcattgctggcatagacctgtccaaatgccatttcaatattatctccttgacagatgaggtaccatttttattcagatatctaattagcaatcgctttaaaaattcatcatatttaatgcatggcatagtaaatactttatcctctgagactttaacccaatataaagctcttgaacctgactgtatttacagctgcaagcctccttcttagggaggcagcgaagggggagatagatgcagagatatccccttagcattattttcatgtatgagttttaaaactagttgtgagggtagatgttttcccacatgtttgttcaccagttgtaagtcctatttggggtaactgttcatgtgttttgtctgagtctgtattgtgttttgtaatacatttatgtgagtgctttaagtagtaaaagcagtgatctttttttttgtatctttggtaaatatttttccagcttgtcttccctgaaactttttctgttttagacttcctgaagttttaaatgtacatgtaggccattccgtcaatatttttccttgttaattgcttttaagcttataagagtccaagattggctaatgggttacttttttttcctagttattttatggtttgataagcatgtcttgcttagaaggtcctttctacttgtataaaggaacgttgaaattgtatgaaatgtaaatacctggttccacagcattttccttgaaattgggaaatttttctagtttggctttgaaaaaaatagatttcaaaataaggtataactagataagatttaaaggtatttctttgtttagttccttggaaccattcagcttttatatatatatatatatatatatactctctctgctctgcctcctggaatagtatgcggaggaaccctttagcatactaatataataaggatgctttttatggcttaagagatcttgggaatccttgggaaattgttcagtgactctctgcaatggaattaatgttttaaacccagaagcatgcattctatataagagatatattttcagagctcttcttgctatgagctttccaacccttgcctcctaccaccctgggagtggtgcaccctccacaccccgcaccctccacccccagataattggattggagctagtgttctttgttgtttgcttttcagagaggggtggttgtgtattatattctggaaggaataggtactgctgtagtgtgagtgcattctctcggggactctgcagatccaaggccagttcttcattctgagcccctcaagtcactccttggcctctgctgttctttagctaaaggaagagattcccattgttcccatctatttttccaaagggagaatgccagtactgaggaagagggtgggcttagagagtcaatcaattatcttttgggcttaaaactaaagaaaatgaacccatggttcaaggatatctacttcatcatttattattttccatgtgaaaacccccttggagcaggataatctttttctaatcactgtactgaatggatccccaaaacagccaaccagaaatggaattttaaaacatggcttattttaaattaatttattttcttttttaaaccaatataatgaggaagcagagaggtacagaaagggctagggacttagccaaggtgacagagctaattagtgacagagcaaagatgcttgctgttcatgtcttccactctagtactttctactgtctcttttctcacaatcttcagaggtgtatagtttacaactgtggctatgtacaacagactatgtcttctagattgtaattttttaaacttagctaaaataacctattgaagataaatatattttaatttttataaatttcaccttagcgatgtgacctaaaatgtaaccacctcaagtagacactgaattttctacaygaaatttgctgtggactaaattgtgtcttcaaaatttgcatattgaagctctagctcttgatgtgactgtatttggacataaggcttctagggggtaattaaggttaaatgaggttataagggtagggtcctagtctgataggattgttggccttataagaagaggaagagagagatctttctctccaccatgcaaggacacagtgagaaggcagtcacctgcaaactaggaggagagtcccctctagaacccaaccatgctggcacccttatctcagacttccagcctccacaactacaagaaaatacatttcttttgtttaaaccacccagtctatggcattttgctatggcagcccaagttgactaatataaaagctttattgcctcactaaattctggtttctagacccagtagacatacaaattacaagatcattgaggctgatctgtgttttagaaaaatcattctgatagttcctttgaggctctgtgtgccttttgtgtgattgagttgtgagtgcttcagagcacttgctttaattgtaaggaatagcttattgttgactggaaacatcctggctcacaaatgaaattgatgaaagctggcctgtccttcactgaaccaggagtgaaggatatattagcattgtgatgtcactgtggccagaggcctttgctggactgggaactcacttctgagttcctgaaatcacttaattataggcgaatacacataatacctgaacagcatcactgcactatttttgtcttcccttccatgctgacttattcattaacatttgtgtaaaccatctgaaccatagaatccttttgggaggtcctccagctcatctcttctatctgtagaccaacttttcctcgagcatctctaacaaaactcagaggctctcatcttccccactgaagagttggtgcccttgaactgatggattcagctgatgtcaaaattggaaacaaatattaacgaatatttaattcaatctcggacaaagtaagagatctaaaaatgtgtggtcccaagcctcttaaacttcttgaaatcaaagaaagccaactgctggcctgaaggtcttggcagaatggtaatgctacttctatarcattaaccaccaaaagcccttcatctccaaggatagacaggctccttcaatcactcggtgcactagaagccaggaaacaagaaagggcacccacccacacagccagtcagcacctctcatatcctcccacagaccctgttctccaaatactagacagcagaataatcagttaagccttagtgactgccagggtgtttcagatccattcaaatgactgtgttggttttactcaggcttggcaattgttctttgcagaaggctgagtctagcaatagccccatttcacagctgatggtgctaacccatggcaaggcttgaagtctccacagcaaaggaattgagcagctctgactacaagccacctgaaagtgaatgagctcctcaaatattatccgccattctgccacactgccagtcactaggataaagagaaccagaaatggtcgctggctttgtagaattctcaatgtagcagaaaagaaagactcataagaacttatcattacagtgtgaaaagggctgtaatgttggaaaggaagcaaggaggctacaggagcagagaggagggtaacctaatgcagattcttaaaaactggctaaattaaattaaagatgtaaggcattgttaactttaaaggttttcctttttagattccaggatgatctctgtaccttctaatatagtttttttgaaaaaacaaacttgatttttaaaaactttggtttaatttcaacattctctcatgttggctttttaaaaacctctttctggctaggtgtggtgactcattcttgtaatcccagcattttgggaggccaaggtgggcagatcaattgagctcaggagtttgagaccagcctaggcaacatggcaaaacaccatctctacaaaaaagttttaaaaattagccaggcatggtggcatgtgtctgtggtcctggctactcaggaggctgaggtgggaggatcacctgagtccaggaggttgaggctgcagtgagccatgattgcaccactgcactccagcctgggcgacagagtgagactttatctctaaaacaaacaaacaaaaaacaaaaaaccatctttctaaccctttctgtttttagcgtgggcttggggaatgaggtgtattttctcagtgataccatcaggggtgggaaggataaggccaagtacagtgggaatacagacggttcctagggtcacctgcagaagaatagccagatggggaaactcaacgcctaagagattcagatgtttaagagtcatgtaaaagcctcaaaagcwtttgaggtcccaacatgtaaagtataggaattctcaggttggtatttgggcatcagagagttgggtggaggttgtaaaaaggtctgccacagaggacagttggaaggttctggtgctgaaatcagtggggaatgacagaggctaaacaggctcaggcagaggttatgtatgacaactgagtctcttttttcctcctgttaaaaagttagtgattttatctatctcaagtttgttgtaagctataaatgaaactctcacatataaaaagactagtccttgaaaaaatccccacctctcctttctcctacccccttcctctgcattctcacactactctttttcacttttcagaagccagtagtgtagagaaagagctattctaaaatattctatacaatgtgtgccactaggcttctaagggagatggtgatgtagtaactttcaagacacttagtctagtattgcaattgaaaaaaaaaattgaacagtatatattagtcagaataggccaattactgtaacaaacaaccctgaaatctcaatggtttgacacagtcagggttagctcttgctcatttcacagttcagcatgggtccataggatgctatactccactcagtcattcagggacccaggtgcctctcatctagtggctctgttctcctttagggcctcagagttctcctttgtaccctttgcatctacttggtaggcaaaggaagagagagagtgaagatggcacatcatagagaaattgttagagactagtcttaaaagtgatgtgcatcacttccacccacattccaatggccggagctcaatcactcagccccactgtattctagctgtatggctaggcagaaaaggaaataggactgggtggacacttggcagtccctgcaccgcagtcagaggtagcccaaaatgaggcaaattattggaaaagtagtgaatgagctccctttcactgaaggtatgtaagcagagtccagtgaccccttattttccaagtcctactggagtaaggtgggggaaatttaagctagaagaatgcagaggacctttctatctttgaggttctctgattcagtaaagcagaagggaattggagctgaattacccatctgaatttccggtgacttaaactgagttcttggagtagaaatagaatgttgaatttcatttcatgaattgttcttccagcttgacgtattggagatttttagcacgcacgctcacacctggctgctcgccaccttctgccattgcagatacgcttacaggaaaccgtaagtggatctgcttttgatgctggcagcgtcttactaaaatgcttttgctggcatcatggaacaggagcagaattcagctgggaccaataatgaggctatttagaaagttctctcctccaccccctgacaaggcagatgtggtagggatttttccactcccattctgtcgatggtggccaaaattagttcaaggccatcagaagtgtttagacctcaagagttgaaaccccagacccataaagaggacaaatcctcttcctcacgtctagcaagagaagaagaaactcacccccaaagactcccaacacagaaatttgtcacctattgttccgtaacagactttaaaaaggcacagccatgtgtcagtttggaaggaaaagaagcactgacctccattaaaaatatctccaagtaagttaaagttgctaatgctttccttttcctgaaaccatgttgtattgaaacaacattttcttctaagcactttcacttctatcatctcatgttaaaatccccagccattgtagtgtgaggtagggatgtcatgttttatccccatttaatagatgagacttcttgaggtgcagagagattaagtggctcgcttaaggtctgtgagacatgtatgcaagatgagtacccaaatctctatacttccaaactctttcgcctagaccacacaagattgtatcagctgatgggttttttggccattctagttcactgtaactgactctgtccatctgttgatccattaatccatctgtccatccacaaactgtaccaggcattgtgcttcagatacagagataaataagggtctttgccttcacagcttagtaggaaagatggaaatagagataaataaatgatggatacaagtacatatatagacaagttatgatgggtatrtgtgtggggaagggccaggattggaaacacaaaaagagcatggtaagttcttccttagaaggtcagggatgatgtcacaaaggtgacatttgagctgaatcttataggtgtatgaccatcagacacacaaggggtcgggggcatcccaggcgagacaccaacttgtgcaaaggcataaaatgtggcctatgcagggatgttctggcatgtttcgggatggttttagagagtaatgaacccaacgggggcaccctggcagcattgctgagctaaaagtaaaagaagatattctgtaatacttgtgtgcacccttgttcctggactcatgcgacatctcaattctctgactttaggcagtggtttgggtctgacccacacaatttagtctttgattatgtactcttgccttattctgcccatgttttcatcattaggcgtgggctccctagtctgactgtaaacactaataacagtacattgtgagtgccaagggactgcttggtgatttttaaatattcagaaatcaagcagtgagcccaagagaatatgagcaggatgtagcaccatgagaggaaaaatatatggactttagttcagttaggtaaaccagcaccatgccaggcatggagggcacagaagttgttgacgtcaaagagcttacagtcttgagtggaaggtagacagggaagctagtaatcacaattcaataaggacaagagtaacctgtggaacaagttctgtgagagctcaaatagggaaccattaattctgcctattctcactccaatataaattcccagggcaggggattttgtgtgccttgtttactgttgaatccccaatgtctggcacatagtaggtgttcaataaatatttgctgaatgaatttattgaaattaattcttgaacttgatttatgatcatcaaggataagtggggacaagtgttccagacagagagagaatagcttgggcaaagaaacatacataggtgcaagttttaatttgcccaaatgttgtttccctaaatgtactgccagagagtgttcttataaagtttggatatcattgagatttctggatggtggcctttctttcttttcttttattattgtttgtttgtttttaaacttttgattgaattctccccacacattactgtgctcagtgtcttgagaagattgaccatactggcacattttaaccagggcttctgtcaactgatgtccttttgaaccacctgcattagggtgcacattgttgcatcctctaccctcatccctctgttggaaaccrtagtggctatcaggtaaaattggtcataggtaatgtgaccatgtgacctggtttgccattactggtttatgcctgttgtcttgttgtaattattaatagagactccttgcactctcaaaaatatctgggtttgcccgagagaagcatcagtcaagaaaagtggttgatgtagaaagccccattaccagacattgggagcactaattcaacacttacttagcagatatttattgaatgtgattctattctggacacttcagggacccgtaagtatgaacaaaacgtggtctctcctttgcccttaattcaaagtgatgattgtacatatcctagctttctcgtggttataagaataacacagtaaatactctgtgaatatttgttgaatgattataatgagtaaatgatrtatgttatttaacctctttcttagttttccttatatgtcaatgcagagataataataacagtacctaccttataggattgttgtgaaactaagtgagtaaatacatataaagagctaagagtagtatctgacacagtaaatgctcaatagatagcagtattgtctgaaagcactttgcaaacacaacagagctacctatagctttctgcagcttaaaaatgagaaaagcagcgatttggaagctttgtytaggaaaggttgcatttgttaatttatttaactatcatttattatgaatcagatataagccccatcctcaaggagctcaagtgggacagacatgcaaaagaagactatgaatctacatacatttatgtcataaaaccatgtcctataaatttgtgggttttgttagaggtctgctgggtaccactttatagaccattcattgacagtttcagcagaaggggtggatgttgattgctattaatcaaggaagcaatgtggttagattggaatttaagaaaggttactgtggctggtagatggtattcatttaaaactgaaggtaaagatacgttgatggtaataattcaagacaggatcaagataccagctttattttcccagccctctctcagtatttgtgaaacctgtgttgtcaaacttgagtgtttccattgttaattgttgtacttcatgtttctataagtaaagaataattagctgggtgtgatggctcatgcctgtaatcccagcactttgggagtccaaagtgggcagatcacctgaggtcaggagttcgagaccagcccggccaacttggtgaaaccctgtctctacaataaataaataaataaataaataaataaataaataaataaawtagctgggcttgatggcaggtgcctgtaatcccagctactggggaggctgaggtgagataatctcctgaacccgggaggcagaggttgcagtgagcctagattgcaccattgcactctatcctgggcgacggagtgagactccatctcaaaaataaaaaaataataataaaaaaaattattcggaggaagattaattgtgaagcattcaggtaggtgaaaagtgtgagaggagtaagcactgttatcctgtatgcttgggaggcctcagcaatggagacattccatttgggatttcagatagcaatgactgaatgcttcaaaatgaaaataacagacaaggaggcttgagttcagtggaagtgctcagggacttgcctaaggtcacatagctagtttacggcagcattggtgctcaaacccgtcttttgactcccagttcacttttctttcattatagtattatttatactagactagataagtccctttactgattgctgagttccttaggaactgcgtgggtgtggggtaggcattaatgaggcccacccttcccccaactaggagaacagcactgttctatttgtttatatattgagggttttcataatattttgcttagaaaaaagcacttgctataaaaaagaaaaaaaaggttgaaaataaatcatctgaagctacaaattagctaaatagcctgatactcctgtagtgtaaaactatatagtctccttttaaactaattttatatttatataatatataatttttacacacacacacacatacagccacacatattaactaatgtcactgcctatatagatactctgttaagtacttgcacttcctagggttttcccagagacctggttgtatagatctgagaatatgggctacaatatcagcagtgccttcctcttttccatagctttcacaccatccagacctattggagttctctgtgactaagactttccagctatggaagcacaaattcagggggcaaaccgtcacattattcaccaaataaggttgtagccagagcatccccatctctatcaataaaacagtgcctgtgttgaaagctcatagcatgagctcaatggatttgttgagtttgaagagcaacttccactttcgagtttctgattttagtcacttgaacatttctaagaggaataataccttccgttggtagagctttctcacaacagaaaaaaatgattttgtggaaaggtggattccaaaagtttttgagtcatccttgggattcatctactcttcatgtatttctaagagaggccatatctcagcctgccatatgaatatatttattttactttagcaaatatttattgagcaccaactatgacagccactgtgctcagctggagggaaacaaagacaaataagaacagtctttgctyttgagtaccttgaaaacaggtgggagagacagacccgtaaacaactgtggtaatgctctgacatgagttctgtggagtcagaaagaacaagctagtatgaaagctcagataacaaagaagatcattttgcttagtgaggctgaggccttgaaggatgaatatgattttccatacagagaaggcattctagatggaagaaattacaggcataaagacaagtgttgtgagagaatagatggtcatatctagagctgtgtatagggaaaggaatgtcttggaggtatcaggaaacttaaataaagacaaaattttaaagagccttgaatgccgtactgaataattggccttgaaaaaagcaataaggatcttagaaagatttttaggcaggggagtaacagaacatagggcaaaccataagaaattgaccacgtttgactgcttttaacctaaaaaacaatttcatgtttcaacctaataaaaaatagtgaacatttttgagtaagtagcagcatgttacaccccacaatacatgccttacatggattatctcatctaatcctcacaagtttaggcattattgttgtccccagtttaaatatgacacaaaattcagagagtatctttggacttaatcaaggtcctggtccctgacttttaaaagcccatggttttaatgattttaaccaaccatctccagttctgcattttattaaaatagcttggttaggcacagtggtgcatgcctgtaatcccagcactttgagaggccaaggcaggaggatcgcttgagcccaggagtttgagaccaacctgggcaacatagtgagatcttgtctctactaaaaataaaaataaaaattagctgggtgttggggaaaaggcctgtagtcccagctactcaggaggctgaggtgggaggatgacttaarcctgagaggtccaggctgcagtgagccatgatcatgccactgcactccagcctgggtgacagagcaagaccttctctcaaaaagaaagaaaaaacaaaacctctcgtgaccagactgggcattagaggaacatgctactaccccggctctttctttgaggcagatttaaaaatcttcttcaaaagcttaatttccctttagccagcattattacagtgtaaagtcagttgaaaatctgagtaaaccctactgaaaatgttgtttgctaattaaaaactacttatttataaactctgacatattagaactggcagagacttcaggaatcatctagtttcatttcttatttactcaagaaggttctggtccagagaggagaagtggtttgcctgaggtcatagaattactagtagcagagatgaaactggccttgatgtctcctggctcttcctttatgttccctagtgaattaaaatggatcttactttcacaaacatgcactaagcacctactgtgtataaggcccattgttctaggtatgttcttctgttctcttacacatgcaaatgtgtacaaattcatgttaggtagatggttcagtttggctaactactgacactacgtcaaagatatagggggaatctgtcttttagctatccatatcatggaattggcaaacatacattgataataaatttttaatagtgaagatatccattaagattactgttctaagtccttgtgtgttttgtttccttttgccccaaggtacccatgtgctaacaaataataaagaaaaaatttcaagcaggagtttttacattasttgagttgtgaaaccttgaagatgatgtaagcatttcaaaatccttgaacaagatgtaagttttaatggtatgcataacatatatgacacacatttacattcataggatttttgaaggctagcaaaattttttgcaagcattcttatttcactgacaatggaaaaatcatcaatgtgatgattatttgattatcccactgtccattttatggataatgaagtgggcaaagtaggtatcaaataataaaattagtaaatactctttattcactcttctcagtaagggaggaatagcaagtggttagactgaatagtgagttcaatatcaataacccttttaaaataacttaagtgtaatttctataatgacctaggattaatgataacttggttaaaaaaatgaaaagttatgtttgtgagtaattttagggaaggaccagggcttttctagacactcaaattttgtagaagcctagcatcattgtggttacctcataatatcataaaggaaggttaacatgaaataagcacttgtagcaaataaggctttgggtgttgtaatgttaaaacttctgttcaaaaaccttacattaaaaaagtactcatcttcattaaagatgtgatccttttcacagaggtattttgaacttcaagctgctgttgctaaggggttgctacgggaaatgagctactcagcattaatgtgtaactttactcttctgcttaaaagtagttaaatcatttccccagctttagagtcagagaggggaagaactraaaagggtcaagtggagagttgcctctttctgacagttatatagcatgcctctcttgtttttcacatttttttatttgcctctcatagagaaaggaagcatcctttctgggcataagagggttgaaaactagactaccaagtagggcagggcttataataaatgtagaatgtccctggctaaggcagaagggaagtgcctgaccactgaaagaaaagcagccgtgggctgttgatctaaggcttctgctggtgaccaacctcaggaaagggctttttataataagtcagcattgaggatgacttgataaagaaagttatgtattagtgaatagagcattgaccaccaaataattatatcctaagcagttggttcaaaagtttttctgaattatttgaaatcaataatttatatcttttcttgagtgcccaccatattccaggtactgttattccatgtgctggggttataaggcaaataacgtacaatttctgccatgcaagctcacagtacagtgtgaaagtaacaatgaactggctgggtgcggtggctcacgcctgtaatcccagcactttgggaggccgaggcaggtggatcacctgaggtcgggagttcaagaccagcctgaccaacatggagaaatcctgtctctattaaaaatacaaaattagccgggcatggtggcgcatgcctgtaatctcagctacttgggaggctgaggcaagagaattgcttgaaccaggaaggcagaggttgcagtgagccaagatcacaccactgcacttccagcctgggtgacagagcgaaactccgcctcaaaaaaaaaaaaaaaaaaaagaaagaaaaagaaagaaagtaccaatgaactataatccattgaatgcaatctgtaattgaattgtttgaaaattactgaagtctggaattatgttctcagtggatttttaataaataaaatttggaaatatttgtaaagattaatgctttgggactttagcagacaatttcatctgaagatcagtcactctctacaccacttccaagcctggagaatggaatagcacatgcacgaaataatgtagacaaaatgtttcccttgtaatcctcataggaccaaggttctgttatcacctggtggcagaatacagaatttacaggcatagattattttgattgttactgttttaaatgtcaatagaagtcaaagacattattttgaatgttagtttttgagtatagagtaacacagaaaataagacttaaatatctttagattcacacttttctgtgtaagttggtatgttatagagaaaagactgtggactgaggttgggcatacgtaagcatgaaacttaaattggcctcttactagttacatgatcttgagaaaatcagttaaattatgtaatctctagttttcttattggaaatctcagagttgtgagattaaatgagatttataggcacagcacctaccataatgttcaacacacagtgaatgttccgtcaatattaattctggttccttttataaagaacgtactgaataagaggtctgcccgcccacagtcgtcatatcataacatccctctgtttatagcttttaaaaatggaggaggttggaatagattcagaggagccttcataggggttctggctaggatgcgatggctgtcagtatttctttcctttccccctaccccacctctattcttatatgaaaaatattctgcattttcctagccaattcttatcattctttggatctcgcctcagttcaggcttctcccacgaagccttccccatcactccagatctcatcctcattatcaactatctctaacacttaaytttggtattctttttacatccttccttaggctattaggattcatgcataaaaaggaaagctccttcccaatcagattttaagctccttgaaggtggggactatgacttctatttctttttattgttcacaccaataatttagcactgaactttgctcacaagattaagtaaatgttgatttgcagcaggcacttttttattagaactggaacagaccattcagcctttgttagttatgattttcttgttattctctagttgttttgagagtctttatatcatatcttcctcaacaagactgaattatcctgaaactaatacaaatttatgcatttcctccccattctacatattagtaataattgctgccatttagagtgatgcctccaccaagtttttttttttttctggcaacaaactataagtgaagtattattgtgcccattttacagatgaggaaattgaggcttatggagcctaacatatcatttttccctaaggagatgttcagccacccctagttgaatcaaacaaaatgggccttgggatagtacttgaagtgttaatgagtgggactattgatcttcgttcattccccataactcagcactacttggaaataaggacatataacttaattcaactactgcttgttgagcaactactgtatgtaaggggttttttcaggtttaaaagaggaaaaacgggtagggttggggacccaatcaggtactcatcctgctttctaaaatgctttgctttccagctttaatcttttgtatttctcctattccaaatttacagcctgattataataatagattaaatgagatatcttgaggacatacctagctaaaagcatgtcacaaagaaatctttttaagaaaatttttttaaagaatattttttaaattttttaatcttgctattttttagttgagaaaaaattgagcatgactttcaccttccctttcctttctcttctagtctgtgcccatctttctcactgattcaacaaatatttactaaggctgggcacagaggcttatacctataatattagcactttgagaggctgaggcaggaggatctcttgaggccaggagttcaagacaaggctgggcaaaatactgagacccctatctctaccaaaaaagaaaaattcttaattaataaacacaaatatttactaagcatattcttctgtgacataaaggaagagatatcttacttttagataaggaaaacacatttctagaagtatgcttagatactataattgtcactactgacaatttactgggttgagtaaaattgtgtatgtcaagtgcctaatacagtgtttggtatacagtagactcccggtaaaatatagcgttttcatttgtgctttagaattcctgttaatttcatccaggtgcggtggctcacgcctgtaatcccagcacttggggaggccgtggcgggcagatcacgaggtcaggagattgagaccatcctggctaacacggtgaaaccctgcctctactaaaaatacaaaaaattagccgggtgtggtggcgggcaccagtagtcccagctactcaggaggctgaggcaggagaatggctgaacctgggaggcggagcttgcggtgagccgagatggcgccactgcactccagcctgggcgtcaaagcgagactccatctcaaaaataaaataataaaataaaataaaataaaataaaataaaataaaataaaataaaataaaataaaaactctgccctaactggcaagtcaaagaattcctgttaatttcgttatttcttcttctcctccctttctcccctcccctcctctccctttgaccttttcttccttctttctcctcctcctcccttctttttccatggatgtaccttctttgccttttacatctattcctttattattagttacagaattataaatgagtccagaatttttttaaattccatatcaagtcattttcaaaaatttattaaactgaccaaacactatatcctttaatggtatgaatagctactccatactttacctgctcgtgcacttagatttataaaaatttatacatataccagggttgtttgtttgtttctttgttttggttttttatttttagtaaagctcatctgaactgatatgaagaggccccaaatcccttaatgcagggatcttcagaaatctctgtgtgttttcacattgaccctgctgagttttttgggggttatgatgaagaatatatcagggaaaagtccagacagccattccacctaaatcagatgcttggataaatgtgtatttacctttttttttcagaattttgtaagtaagatagttttcctgtacttcaaattttctttcccagaaagacatcctagtgctttaagagtatggtcaaaggcacatttgaaaaagtaagcatacactgactctggaaaggaaacttttactttcagctactgttcttgcataaggcttaggaatatgaagagaaagcaggaagatgaagtatgaatctactcttaggtccatttacctgcacaggtgaactcttggcgatttagacaggttagacatccatttgtcacatttccccccacagtagcattcttctagctttcccacaatctgtagtagacaaaactacttaggaaggagaaaggcattattgactatcaggtcatatatctcacagagaacattcgacagtgaatttctgatagactccttcacatcagtctggtgcatctttcttgcctctgtagtatgtttgcattttcctataaaaattgatttaatgtttctacatgataaagaaaaaaaaaagacagaaaccaacaccacaattcaacaaaggaaaattaagctttaaattttctcaaaagcttttacatatagtataccattttctgggcagactgattgtatttttcctaaagaaggaaatgccagcagtctaggtttatttttcaagggaagaggtaaaggatgaaaataaattgaaccacaggaaaatgtcaggtcatagtcactgatgacgctatttaaatggtgtgctataatcatattagggcagagcacatggaattcctgatttctgcatgacagtgaagaagggccagcaattatctatatgtgtgtgtgtggatatgtgagtgtctgttcactctaccttcccaccccattttgctaattcaattgaggggcaagaagaggtaatccagacagccggaacaggaggaaaaggtctgcagctgtgttcggagggactggtgtgaagagagaggctcagtctgacttggagttttgtgctgttgcacgtgaatgctctggaactgccctaatcgactgaaaatgagccggctacagtcatatggaacaggtctgtttagccacatcactggatagcctggcagatggtagaccgtcaatgggtggtattgaytggctggatttgccttagggtaacaagactatgggtccttaaaaacccgcttcatcttattttcctttgtgcagcttcatacagtagtggttttctcttctctctccccccagtccccagtatccccttttacccttttcaaattaaaagtcttccttggtaatcaaaatagagaggttaccttgagataaacactctttaaattagcaccaaggcaagaaaacttgagaatattttatttactaggctgattacattttaatgtttgaagaaagtgacattttttaattagtgtttaagacatatggtgagtgtacaaattagcttatttcatacaaccagaatttgatgagagcaactcctccttctcactccccagttaaaaattgtcacttgaaacttaatatatgcaaggaggttaaatggtattaagtgatgccgtcttgacttaaagatgaaggacatagtcactattgtgtatggctaaatacggcctggatgggctgggaaaatattactgtcaacacctgtgtttgcaagaaaatgtggaggttccagacctttaattttgtccagccaagaaaagaaaatcccaggtatctgtgtgtgttggtttctgttttagacacatgtggaacatagaatggtgttgcatgctttataagtaataagatcctccttaaaatcaggccatataacaatataagtgatgtaatttatttttgttcaggtggttctatatccttttaacatacccccaatcacttggagctttcaacttgggacattctgtttattcttggcagaggagcagattaattggaatagagtgatacaaaggagatgccaagttagctatacatccaaaatagtatacgacagaaatgttccacttcgaggcagatcttcgggaaaaagaacagcaatgggtagagacatgtgattggcttgctcttgtggttgtttatcactattcatataattgtatttttaaaagagaggcttaatattttgtattttttttcggtgtctttacttttaagctttcagttatttcttatcaggaaagacccacattaaataaacctaatttctacccagaagaaaagttgcacccttaaactcttgcctccatcttgtatgtgcttcatccacatgcacacttttgagttttcatcactgtgtgtgaatatttttctgtttttgctaaagagaaatattttcatgaggtttttggccttccccattgctctgtgttgattgtattttccttgttcatcctttgctgaatgaaacaaagcttgtttgtgtttcattcttcgcagttcttattagaatttgtggcagtgttttgttttgttttgtttcatttccttgctttaagtcaagagaaggaattttatttatttattttgacaagatatagtgagagacaatcttgcctgttaagatgctagtgtttctcatgtcacattttacacccaaaagctattccaaggggaaaaaaaaaagaaatcttttaagatggttcatttgaatctgtgcactctacccacctggtggttatatagtgaactgttactttaaagagtagtttaaacaccagccatgtttggggcaggctgctcttgcaaagagagcagtacatataacaggagtctactgtgtgtgagataaggggaaaattcagctcactgactagaggttttaatgtacgaactctagggaaataatatattgactgttccgtggtgcgcaagaaaattgaagaaccctttgcagacggagtgctttgcaaaggattctatctgtttctcttaaaacaaaatctgtggcaagatgtttgaaatcagcaggacgcttaatgctgctttgttaaataatgaggtaatattttgtcacttttttctgggcagcatctgtttttcccccctcttcttttttttccctatatttatgaaggattcctttttttccgcctcatggaagtcaaggaaatacaattcacgcttccatttctgttccttccttttggtgcttttggagaatttggttgtctttttttatttgcagtttcagccggctgctgtttcctagcccattgtgccacgtaaggcttctccactgcgcggagtaggtagttattaacgctgaattggcttctggtacagtccatctggactctgtgtgggaaagctggctgccggcgactgatgctgagatatctgcaacctttgggatgtgtgcatggtggcaaggggctgactgatatgagattacttcttttaagggaaattgtcattaatgagtcaagaaactgctcatttatggtaagaggaatacagcggcgctggcagccccacagtgctgggatatcatttttaggttgccttagctgcttgagtgagacaagtttctttctgtggtggtggattgtggcagaaaaaaaaaatcatgcatgactgggagactcgcctgcctgattcttgagataatatattgagaatctgttgctttacaaatgtcacatcactgatgtagcggtcagcccctcactctgaaagatgaattgtactattggaaatgcgataataaggttgacttttcccaacaataggattctgcctttgtctttagagaaaaggcctctgaggacatttgtgcatttgtttgaggattctgttgaaagactttaaagtggaggtttgtggaaaagtgatcaatatacaaaatgcatgaatttttagcctagcaaaaccagctagttatttatactgtatatacagctactattttggaaaagtggccagaataccttttaatatacctaatgttaatttatggttcaataagtgtactgaggttagtatggatgggagaaaagggtttttaaaatttttatcttttataacctccagagaaatctaagtaaatattttgttccaagtgagctgtttttatttgtgtttgtcagcattgtcttaatgtttacttttcacaatattttaatattggtgaaattgcactcagagtttatgttgttgatttggggcacacatacctactctgtgtatatatgctgaaccatttagaacactttaacctgtgaattcaccctcagtacacagttcaacagatactgtagtactattgtgactcacaggacattttatacatttgctaaagaaattactttaaaagtttacttaactgagtattgttccaccttaaggaattatagttttaacatttgtacttttctatttcatgtattttcatttctaatagctgaacgtattcatactcaagtctaatggattatgcagtgtacccaacacatattgttttatgatgtatctgtattttctgaagtgtgaatatatatgtatgtttatatgtgtgtgttcatgaaacagcatcttggacagaatagttttaatcttgaaaaatgtaaggttattttctttcctaataatttttcacaaacccatttattcttggactttgaaacccagaaatatagcwtattttttggtctgtatgtctactctgcctagttctgtctcactgtcaactctagtcaaagattaaagattacattgaattttgtatttggtaatatgtgttaccactgtgtatttattgaagaacaaattgattaaattatgagttaaataaatagtgacacattagtcttttgcataggtgtgaagcatgaacttctcaggtaagccacttaaaaaacccaaaccagaacaaaaaatacactactgaaggcttggtagtgtagaggttgttaaatgtgtaaataggcagacaaactgtatacctcaccatacacttgctaaatgtctctttgcaaatctcttaagaggccaaagaaaaaaagacatccctttgaaggagagaagcaaaatcacttatttagttaagcaaaatgaacactctgcacaggttttgaaatgaggctgttgtcaaaagcatgttttacctttctctaaaggggtaggagaatgtgttttagtggatttttaaaaattcagatcatgttcctatccaacttgaaaaataaattcatttaagtaaatcattcatcatcctcagttttgaaaagctcagacagaaggcagaaaggtagaggctgacagctgcccctcccttacccccaccattttttttctttttgtttattaggaaatagttttctgagacaaacttgtatgaacctagttcacggagcaagcttaatccccaacttgcttgcttttgaaatgttggccatgttagctggagaaggagcattacttactaaaaatcagcaatatctggaaataataaagttaaattgtagatgaattagcacattaaagtgcttttgttgtacctttaagcctacaggcagatcattaaatatgcatttcgctagaaagcaactgtctagaaagataaggtggttgaaaatattctacggtggaaaagccctccatcagagaggtggcacggttcggccctcaggatgggaaaagaaggaccctcccactgttagtttaggtttgcaagcctccagtgacctgcagttgttacagtacttttgagctgggaggagggaaaaggtaaaaatacaagtatggctgttgttgcttcagccgggccttaattaccagacacaagaagcagttcagaaatctggtctctgttgttgtagaggtcaccaaatcattaacatcgtcaatctggcagtagctaatttaaatagcacctgatgttgcaacgcctcccttcgtttccccagccaatcagatccaggcttcggctgacagatggtcccataaatggatgtaaaaaggggaagcttcgagccaatttcagcaaggctctgttcagttgttcttatctacatcctagaatcgggggtttcagctcactgctccttttcttttttttctttctctcccccgcccacccccccaaaaataattgatttgctttacaatcatccacactgtgttttgtggatctttaattatatataacaatagtagtcattttaaatatatattctgaaatctttgcaaattttaacagaagagtcgaagctctgcgagacccaatatttgccaataagaatggttatggtaggtatgactagatttataatctgttgtttgtgttgctggagggaagaaaagcatctacaccttgaccagtcttatgcttgcacaagagtttagttctgtgctgctgtttggttcctacatttactatctcttttgtgtagagagtgcgggtaggtccttttattgaaaagcaatggggatataagattgtcatttttagcaagtcgttgtcagttttcccttcaacataaaggcaaggggtggagggggagggctgaaataattgctggtttattgaaagaggttatattacttgagacataatggcaaaagaagggttttcttttttgtaagggagagggggtttgtctacgtgcctgggttttgtggggctgggggtggatgcagcggggttaggaatctctcaatttccgtgctggaaatttaaacctcgagaggcagctcctggatactgaacactgagatgggcagttgtgtttcgggggactgcgcagtcaaaacggcaaagagagtgatttatttgggcttcagtaaatgctgcatcttgtatttcaaagagtttcctgtcatgacctcataaaaaagaggaggcggcttgtatgtgtagcagtgcctggcgtgttgagttgttgcttccttctctgggcagcagctctgtaagaaggaatgtcagcttttacataacgttcctttccgcttttgacacactgtgtgagggtccatcttcttctgatcacagatggagtggaatggcttgaagatggtaagtgaaaagaggaaggcagcctggaggtcccagccctgtgtgtgtgtgtgtgtgtgtgtgcttgtatgtgtgtatgtgtaaggatgctggactgtgcatcgtaaatcactgtgctgatcgtttgtgtgtgtatgtatgtgtgtgtttattagtatttctcttttctgaaaaccagaatccatctccaagtgtaatggcactgcatgcacacaaggcacacacactgcctcttccagcaaacacacattttagccaaggaaggttggtgtcttttttgacaatcaatgtcaccgtcactgttggctggcgtgtccaccgcctctgtgagccttcaacggaattacacgactgctaaagttaaaggcacatttctttttcagtctcatgctaggagtgatggggaaggatgggaatgaggggtggaggaggtgagattcagtaccagccgatgcaattgtgaaacaggactttcggatgtggaaggggaagtggaaaacctttctgccgaagtagtaaatctatttttagcatcatctttttctgaaaaaagaagcagggaaactccttgagtgccgcttctgtcgcctgatgttgaccctgaagatatggcacaaaatggcatgattagatgccacgagtgcccactttgactttgaattttcaccagcaataggtttcacaaggtttcagagctgggtatgggggcaggctgtaaattcataaccatcttacttatttttccctagaaaagcctggggaggactttttgctctgcatagatgttataacaaagctgtggtctttttcccattcttagaggattgcctttgtctggctgcttgttttgatgggtgtaaaacaaataagattagaccgagcagcccaactgaaagcgatagctgggaggaaaacccaatgaaaggttgccggggaaacgaacagaggagaagccgagtagggagcaggtggctatcatgagaacacactgcaaacagtgtaaaaaaaaaggggagggggacaggacctcgattatctttgctgttctttgtggccagcccaactttaattatwcgttattaataggtgttaattacatttctaactctggtttacagtgatttttagaaatctatttttaagcatctgttctgtctcccctgtttttgtgtgtgtgtgcgtgtgtgtgtgcgcgtgtggtttttgttgttgttgttgttgtttaaaaaacccagagaggaggtgagggggaagggagggtagggaatcttgcttttttttttttcctttttcccccttttccctggtgtgaaattgtacatgcgaaaaatcgcaaggaatcctgtgagaccatttgaaaaaatgtaaattatattgaatgaagttgacggaagcataatagtgaactcccacagctgataggttctgcaaatgatttcttagaaatttccagcaaatattcataggaaaaatataggtagaatagatctaccctaagcaatgatttggggttaggtgattttggtatttttactaaatcggatgttgatactatagtttcaggggaattcattgtacctctcatttttttcctcagtagaaattactttacaaaataataaatgaagagctttttgctttccttctttccccatgcccacagtcacaggatccatcaggcttgcactctcataaccactgccttccatttggcatttggtcctgattctggtcttggcacaaactgagtgaaaagctgatttttatattagtgtctttggacgtctgggacccatgtgtgcactgggtgacaagcatctctcttttttctctaaatgtgctttactaatagtctctttttctcatgatggtgggtaccataaggattgaaaggtgtagtatttgggtgaacaggagatagcgtaaaaacaattgaaatggtgatctgttagggttttttactaaaggacaaaatagatgcatgatcagggagctaattgtaagcccaaaaatgagakatttaaaaatgctgaaatacactaaaagattaggaaatataattggctttattgaaagtacacttaatttttgctctcttcattgcaaatccccccaattcttttttccttgcagatgcgtctttttgttttctcttcttattaggggatttaaaaattttattttcactcttgaggtaaaaataaataaacttgtattttttgtcatacacttgaaacttgcggccatatgttgagtgcataagcctgtgtcacctttaaaaaaatagaatttttttaagtctccaatatagtttctttttttattttctgagaattttctggcaatttttagttaggggaaaataatttctgtaagaagtgtcatcttggcttgggttgtaaaaaagacacgtggttctgatgctgacctttctcgatcctttgtcttaaaaatattaatgcctactaccttcatgtggagttgtgctcttatggaagcacaaggctgaatgtgcatttattaagaagtgaaaatccaattggaaatatttctgcaaaaaacatctgactaagtagcagttttaatgatcagaatgtccatatatctcatagtaacataacagctaaatcatttaatatttaaatttttgaaagggtaaaattaacatagatgaggaagtagctgaaaaattactttgagaattgttgatttacaagacaatttaatatctcattttttaaaaagctaacaaacaacttaaccattcatttgtgatctcagtcccattcatttttacctgccattcattcaagtcattctcctggccagatgtagatggccttgcttctgtttgatggtttgcacaaaaccttaaaactttttctctcccaatactccttccttggtcctttgaaaattagggtgttgttatgagaggaaggccagattgttgtgagataataacaatagaatatttagaaagagagagagagaaagaaaatgaactgcgcatttgccttttagttctaaacttagtcttgaaattggatttgggacactttggacttcagatattttaaacttaggatttctattaggtataagctatttgaaatttcacatctagaaattattgtttgaatggtgctttgtatgtgtgtgttcaatatctctaaaaggacttgtggatgaattgagatgtttttctcaagttagagttactgtgaacaacaatgggatttcctcagagtaagtctttttttttttggtttgatttcttccctttacacttatttccttattataggtgggttcttttcctatatgtaggccaaatactatttcttccatgaggagatatgctgcttcatttagccctgagcatcttaacaccttattttaatttttttaaaaaaagaaacaaattgtctgtatgtacctcaagtaagaaatggttgtcttcatagaggtcatcatacatagacgaaagtactttggccttgacaaatttcttcattagctccaatgatctgtggccaccaggcagttaatttatatgcctagacatttaatatgtacatttgttggtgagctggccagmggatgctaaacacacgagtatgcgctggcaaatgctgcaatgcagtatttttttcccaatgtcattgggaattttggggctaggaagggacatgaacattttcaagcttttatcttactattgtccagtcgatgggccatgttgtacagatttggtcaattctccttttgaaagtaaagtcaaccttttatttaccactatccattcccccatccatgtaatgtatatgtggaaagtgtgtgtgtgcgagaaagagaagcagagagactctgtgtgtatcagtataagtgtgttgcagattcctgcacctgtcttaggctttccttatttggtattactaaacatgtatacacacttacttgcaagtatatgtgcatctataaatggagagaaaaccaaactgggctgcttcccataagaactggtttctcttcatgactccaagagttctcatattagaaaaatatgaaatttcaaatattcattaaaaaatatatattcagaccctgcagtctgttagtaaccaaacacctttctttagctgccacttaagaaattataagtgtgcaaatgcataacaatgtttgtgagctaaaagccatcccttcaatcaagggcctgggtatgaattaaaatgtgtgtatgtgagtgtatatggatatgtgtatatgtatggggggcggtgggcaggatgtttttctttgagggcatttgaacctagtctttaccattggtaaaaataaggaggcggtaagatggaagtgttaacatctgtgctttgctttgtaagttggtgtgcaagtgtgtgtgtattaggaacatccttatrtttgtgaaatctccacgtattttaggggtaaagggcttttataggtcactggctttctaagggtaaaaaaaaaagaaaaggtgatctgtgggtgggtgggagtcacaagcagtaattgtcttaaattagctatttagcagtgaaaaggaaaaaaaggctggaagacaagagtgtagaagagtaccaacatgtgggtctgcatctttccggtataggagataatgagtgataaatttgaactggtgcagtgcaagatgcccgataatttctctgaaccttgactttgcaggtccattacttccttgcttgcttgttcacacctttaattatatccagtttgggatgctagctgggggcaccacagataagccattttgtttgttgtttacttcattaagtattcaggcagtgtattcacagtagctttggagcatcagtgttaggaattgagcagtttggaaatggaattgttaaaaaagaacaaaaaaataagacagcaatcagccagctagcttgctttggatgttcacatccactctgcttaatggtaatatttatgctttcccttgcacattaattaagaaataacttacgcagtgtcagggctcttaataggctggtgactttctctctctttctctgtctctgtctccgtctctctgtctctctctctctctctgtctctcactctagctccagctgtctctttctctccaccccacccttgagactgtctttgctcagaacattttaagaycaaccaattttgctttaggggagctcatattcagatccttgttgtatctaataccaaaggtatttctcccctcaataaagatccccctctacaaggatcaagaaatgctgagagccctaaaggaatccttaaataaattttggttgagaaagcagtagaagtgttgaggaaataaggtcagtgtaatttttgtgcttgcgtttttgttttttgttgtttttggaaagtcttatttttaaccccaaaagtaaaatrcaaaactagcatatgggatttttttaatgaaaaaaatatatatgtcttaggtctctcctgaaaataacctcccttggactcttcatttgaaaaataacatgtaaactttagcttaatttttgaattactcattttaaactataaaatatagttcataaatattttttccataggaagtttagttcttttttcaggctatggggaagcagagaaatgacccagcgaagatggtgaattctgaaaaaaacacagcatggaggtttcctctgtttgcacttcgtagcattgaatcttctcctgcttctatgagttatcctttagcccttaaagttgttttgccaacagtgttcataatagagactgactgtcattccttgttgkgtgaagatgtatttgttgaggacttactatgtgcatttctttggaacgtggaatccaaggtcaccatttctttttcttttgacaatgatcagaagacataattaattagaggataagtccctgtgattggagatgaagttagggtgagggatttttaaggtggcacattgcacaatgaggtttgtgtcaaatagtaagaaaaggtctgctggaacattcaagtacataaatgtctttccttctgtatttataagcatctaggtgtgactccaaaagatagaaataagagatcttttggacattttagtctataaggtttcatgtgtccacatcttcagcctcaggaagaaatatagaagtttggactgttgaaaggaacttgtctttcagtcagcagcccatgaagcttggctgaaactggttaattttacagaaacacgaatgtcttgcctccttgcttctgatgtaagtggctttttgaattccttttcctctgttacctcccaggagcatctgaacagatagtgaccgttttggcatgccaaattggaagtttgctagtggagcagaaatcatagttactttgtcatatacatctaaatactgtggtgtgtgtgtgtgtgtstgygtgtgtgtgtgtgtgtgtgtgtcatgtgttgtagacagctgggagccccggtgtgccgtgggatgtgccaataatggcttctmaagtactctgtgttttcctaagctgccagtctaaaccctttaaaggtttgctttctaatttgtacatgaaaaataacaggctgagttgaactttttttttcaagtgccccctttgaagatgcagcagtagtaaatactgctctaatgataaactttagttctaagtgctacttaaaagtctgtagtagaaaggctgagaacttgccatctttactaatgaagctttccttaggaaaatgctcacttaaaagggagtaaatgaccaagtccctgaaatttgtgatttttaccagatttgacttatcttttcttattttactttttgtaatgcagccaaccacacatccaaaattcttggtattatacatgtcttcaacattaattatctctgttgatgcactgggtacagatagtacagttcccacaagtccagattcttactgtaacaccaaaacaaaagtgatatttatgaataatattgggaaagttgtcctcatagtaaccattccccaaaggaagctttacataaatgtgcacttattattcaggatattaaaagggaatcgttagcttttactttttaatttgggctaaaatatgtaaattggttttattttggagtttctctgttttaggtgactttgggggaggataactttctagcttgattatattttaatcacctctctagtggaaaagttaatcttaaaagcaacctgcttattgtgattaggacccagagggcctgtgttcagatggggctaaaaacatattatattgacctgtacacacgtagaaaaattagatttatttctactagataccgctattaccatgcctttgttggcaaggctatctcagagaccagagaaccgtgagtctgcctctggcctccgaggaacatcacggtgtgcctgtacaggcaagcctctaaaaagattgttctttgtcttaagaaactggcaagtgcaaaggacttcagagtcagttgaacttaagttggaatcctagctcttccagttactaactgggcaatcacagatgagttacttcaacatgagccacaattcctcatctttaaatggtgatgacaatatctaactcacagggtttctgcaagaatcagatgagaaacagtatttgaaggcaccagtcatacataggacttgaaaattgaaggtgctttgagggtgttaagtctctttcagtctgtcagtctttctgtcccttggcaaaagcccttccccagaaagaggcccatctgcccatgccagatgtcctgggcagtgacattgtatgctaccctcactgtctccatactgtccccagcatgcaagaagggtggcacacagtgttgttgtttttttctatatagacaagccctcagttcttcctcggaattgtatggctttattaagttttctgcatcctcctaggatttcacaagctgtatccatgatctcctttggaattagaattcacttgggatttagttgtcaaaagagaaaaacgatgaagataaaattaattttaaccagtgctgtttttttaatttcatgaaagagcctgttaggaaagttaaaagtcagccagaaagaaaataaaaataggctgagcttaattgatatggtcccatctttgctgtctgtatattgtaacttgcaaattatttgactttttcccagaaaccaacttacttcagatctattttttttccttttcactgtatcagctgttttcctcctttccccttgttttcccaataggctgaactttgaagttctgtttctcacggaatggtgaagaggttgaggcaaaaagtggcttaatgagatttttgtaacttgccatcagttttccttctgcttggcaaggcagcatgatggatggctttggcagtgtgaacacctctagaagtgatcagattgactgaagagatgtgcaggatgtcagcagaatgctgaccctcaattcattaccctcccatttgaaggaaaaaaaaaagagagagagaaaagaggaaaacaaccacaaaagccttggcgtagttgttgattacacacacttgggaaggggtaatgggtcgcgtcaggactggtgttaggttaaacctaattttgtaccttttccccaagggtctgaagggggaaataaataaataggcaccataaattaattcacaaattgttctaaatggggacctgttgctgtgacctgttgccgttatgaagaaataatacaaattgtcctgaagggattcaagattcaaattgaaaacacaatcttgaaacaccgattttgaattctacttcatatgcttacaggaaggatataaagggaagtcgatttttttcttcaatgtaatccttaaagtaggggaaggggttattagttgatctgatatcccaaatgccattttgcaggtcctatgctaaaaaaagaaagagagagagagagagagagggagggagggagggagggagagagagagagagacagagagaaagaaagaaaagaaaggaaagaaagaaagaaaaagaaagaaagaaagaaagaaagaaagaaagaaagaaagaaagaaagaaagaaagaaaaagaaaaagatcctttgctatggaacaggcagacaataaaacttttctctttccatatgaatctattttaagtcttcaccaagaatctttggaggattttgcaggtgtgtgtctatacatattgtatgtgatgtgcaagctctctggaagaatttggttggtttttagactgtgtttgtatgggcagaaatatatctgtaaaaagcgggagggacttgattttggagaagggatggtatagaagatgtttgtccatattttagccttggaaaatctcatgcctattaatgaaggacaaaaaagaaatgatttactgatttgagcaggcaaatgagaaggttggatattcttaggaccttcttgctaggtaggtgtttgtttatttaaaagttaaaaattcatccatatttaggtcaatacttgaatctcagttccttcttttttttagatttctggctgaagtttttcatgagaagaaaaaagacttggagcttagaactgctttagtaagaactattaaacaggtctccagtcattgaattttggaggcatgggcttgcagttggtataatcttaacagtattcttcctgaactatcccatgtccatttcccaagaacagaagaacaagttcgcattctagaacttcagctgttctcagcatagttctgcttgtaacagatctgtgaccatagagatcatctttcatgttcactcagccttgtataatttttgccctatggtgtcagtttgatctctttaatgtaattagggcaggtactgttaactcttttttatagaaaataaagcttagccacttgactaagcttgcacgtttagtaatatcagaagtcttcgctccagagtgtttgggaatatgtccagctcagccaaagtttacttttcttgggggaaaaataaggtaatttctcttctatatcaaatttttcgttggagaatcaacaaatatatatatatatatatatagcatgtctgttgcatataaaccatattctagatgcatcctggagcatcatagtatttaaaatatattatagtaagcaaggacaatggcaagcagaatgatgtggacagtgtctcagcagaggaggtacaatgtacaaaagagggagacattagttcttgttgggggaaggagacaagcttcatggaggaaatgccatttgagtagagccagggaaactggatagatggaaaaattagaagaaaggggaattccacatggagagaatcatatgaataaaggcatagagatgggaacttacaaggcctacttaagaaactgtaagtaatctggtgtgaatgcagcatatgttgtgtaaagataaagctagaaagagataggtaaaagctatgatttaggaaggttcagttgttttgacttggttttgactttgaattggtagctatggaatgtcttaggtcagaggactgtcctttcttaattctttttcagggtcaagacctgtctttattaagccattatttctcagaagttgaagtcaccctaaagatacttctaaattagacattggttaggggaatcagcattagagcactcttctggtcataatgtgatgttatgatgatgatgctcattggtgaagtcacattaaggactgcttttagggttatagtggcagaaagcagtaggaggaaaaatatcgactttacttcagattgtaaagaagtgtgctattagaggagtacactgcattctctcaccaacaggtctccagtgctcattttgtgggataatgtgtggccagagagaagatggtggtgagtggggaatatgcttattttctccagtataaaaatgtacccacttcaaacttgcaagtacacgtaccaaagcatgcttgtcttgactggtcatctgttagccctggagggcatagatcatgtcaaatcctctcttacttcaatgtctaatacatagtaagtactcaaaaaaaatgtttattgaattaggttgtcataatatggcttttgttgggggttttgtttttatctctgatttttaaagagactgaactacagagttagacttgtggatcttggatctgtcatcaacttctaggagcctatttagcccaactaacataacctttctgaccttcagtctcttaatatgtaaaacagaatgaatacaacttcatggcttaatgggaggatccattgaattgtatccttgatacactctattggacaggataataatattagtaagttactagattctagttttacctatggatagtttattgggtctcgaccggcattaaaaattaaaacaatggaatgatagaattgaatgaaatagaaaagaaagtatcattgggtggtacttattaagggttagtattatttcatgaatctttgcttcagttacctatgttatgagttgtgatatgaagctgtggtgttccatatggtgttcaatatgttccttacttttttattttactttgttgggtcatggtcagaaaagtttgagaaatactgktctagataatagtgagctctgtattatacaaaggaaaaataacagtcagcttttttagaactatgcaatgcaagatctctagtatcttctgagttattaaagaaaggatgacttctagttgttttagatttaatatgaagcatcatatcctacatctttgataactactgatgtctgcatgatatatgttggggctctttattaaccaaagtatttattaactaggaaacyttatgccttggttgtgctacatagcaaaacctggaatgtaataataaaagtgacaataatcagtagtgaatgtgacctagaggtgggactagaaataataagattagttttcatttcttgagctcttgatatgagtcagacactgtgccttacaaacaccatcccttttaatccttagaacaaacttaaaaggtaaatgttaatttctctattttatggacaagctaactgaggttttggtgggtaaattacagccagtaattggttgggccaggatttgatttgaacccagatttgtctgactccagaataaaatttcaaaaatttattcagttccatgaaaatgtattaaagtgcctactatgtgttagctctgtactcctctacaaagataagtcagtctctgtccttgaggctttactagctgccctttgtattttactatgtaagaagatgaataaggatttattttatcacagcaggagataggacaggcacatagagtactgtatattttacttcagaagtgttaagaaaagtgcctgacacacagtaggcattcactaargatttattacattgaattgaagttggattaattctcctctagggattagggaacctttgtactaaagaaacactgtacatttttatatgtttagctgtatatgcctagtggcatgggtattcttacctgcaatgtgggcagatccatctgtcccaaatccattcagtgccttttggagctcctaaaactggcagcacagaaaagccaacaagagctcaagaactcaaattgtaaacttcaagtttcattcagccagagagaacattttccatcttagtgtgaaaagcaaatcccatggcagagacatttggagaatgataaatggaaggtgggcttccttagaatggaaaattgttattatcattgttaatgttatttttacaatgccatttactagctttataaattcaagcaagttatattacctctctaagcctcagtttccacatttttaaaaggattaataccactcaggattgttaggattaaatagacccatttgataaaaacttactgagacttactatttggtagtctgtaaatatgtagtagtaaaggagacatggcccccygtcctcaaagagctgaatatctggtgaatgtgctgtgagaagtgggattcagactcccaccacctgcacaggtcactattgataggatgcagcactctacagtcctccttggggtatgtatatattgtcatatacatgtctcaattgcatcatcagaatttcaagtttattgagggtkagtgagctcaaatattcatctgtttatctccacctacccctaagtttcatccttgcctgttgacacaatgttaccttatacagtagttgctagatgaatccagcccaattcagcaaatatttaccaagtggctcagggtacagtgctgggaaagggagggtaacatttgctgaacagagttgaatttaaaacaactttagagcataaaaggggaacagtgtcatgaagtggtgatatactacactagtgctaaaaatacctgtgatctactcaggaagaaattagggctctaaagaaaattcggcagtaagcctaaaaataatgtattttttcactctcccagtgctgttttgtttgtgtttcatggagaaacagtgtatttgctataagcacacaattaagatgagatttcagagatggctacttaattcatctgtggctcaggaccaagtctaggtagcttcacaaaacccaggagcccctctgtggccagactcctctcctttccagcctcccatcttgggtctctttgccttctgttcatgctccactgtagaactgcaccacggtgttccctactgttgctcacacagatccctcggtctccaacatctttctgctttcttcacctggcttcatgagacaaataggaggcctgtgtcacccagaaaggcttgccttaactcactgtgggttgtagccatctctgttaacactgccagcatcattccatcattggtcttccacactccataatcaaatgtttatttttctaggtttcaccactgcctcaacaatcagcactgagtttatctttatgcttggcaccaagtaggtgctcagtaattgattgttaactgatgtagtcagatattaattaggtgtttcataatgtgttsccatcaggtgccccctagcttatgagtgggatattggacccaaatcccccttgttgtgaagactggttttgacacagctattgctcaccaaccccagttctgtaactttgagctgaagatcttgagtatatctatttacattaaactttttccctgatcaccatgactcacctgtaattcctcagtaattcttctttcctctagactcctttatgtcacttgctgtctgtaccacgcagttaacaatgacacatcacaataatagtgaccctttatgtaatgtgtgtgtcagactttgcagaaagaactttacttaggttatctcattaaatctcacaacgattctaagaaacagatatttttattcccattttgaagaaagaggacaacgtagtttaagtaacttgtacaaggttacatggctaggaaaatatcagactgggaatttaaaacctagtttgtttcattccaaagcccatgttctgtctcctattttatcttactcatcccttaaaaggtaggaattaatgagaaacatttagcctagtggttattaatagggatatttttgagatagggtctcactctgtcacccagactgcagtgcagtggtgcaatcacagctcactgcagcttcaacttcccaaggaaatagagacttttgatcaagactacctggattcaaatcctggctttatcagttgtgacctaggggaaatcatttccactccctatgcctcaacattttcatctgtaaactagggttgttgtgaggatgtgatggaccaatgaatattaaggatttaaaacagttacttggcatataaagtgataatgatcatcatcattattgttatcatacaatattaatttgtgtcccattcttcaaatttttgttgagtgcctgccagacactgttctaggtaatggtgatagcagtgactaagacaagtccttgcctttatggagctttcattttagaggaagaagacagagaatagagtaagtaagtagtaagtagaacatggcatagtagtgtgtgcctgtagtcctagctacccaggaggctgaggtaggaggatcacttgagcccgggagtttgaggctgcagtaagctgtgatcacaccactgcactccagcttaggtggcagagactctgtatctttatttaaaaaaaaaaaataaaagtagatattatatattatgtcgtgttttataatttcacatagtgaaatgatgtttaaaaaataaaagatgctagattagagagttacactaacgagtccttgtttgtggcacacagtgaggccacaatagttcagccagtgccttgcttctgcttgatgagctggaaccgtcaatgccctactctgaaaggctgagcttcatatgtccaactactaactcttggagacaggcttgcctgacctgcatgtggtgtaaggtggtcatctgtggaatgattggacaattggactgaggtgtctgagcctcaggaaaacttaagatagagaactcataaagaggccaggggtcccagcctttgaagagaggtcctattctgtgaaatgggacaaatgttccaggagggtcaggaggaggatttggccaatcattcaactaagaacagggtcagccagaatgtcttctcaattaaggctkttaagatctcctgatggctccttgcaggagcctgaacctagaaggtgagttagccttggcattatcataggattctacctttccatgagtgttctgctggttaagggcatcttaggagtctgcaaaatggggtgtttttttccttcacttacttgtagtrgggtcttggtaaagtcattagcctgtctgagcctcagtttccttatctgtaaaattgggctaataataccttcctccaaagcttgtttagaagatgaactaattaacatgtgtaaagaacctgaatcggggcccggcacstagtaggcatctaataaaggaagatttttaaaataagytcagtccccctagggtgtgcattttaggtattggtaatttattttggggctcacagggagagaagagaaaaatgagagctacttcccattctataactttcaaaaaartgagcagataatctcaaaaccaaagatatgtcatctcagaaaggactgtgaagaaaataaaattagatttgctgtaaatcagtatgattgagactggtctctgtcaaagactgtgttggccccatcctcttggtgtcacaggcttttagaggcctggggctctgtgaagaaaagcacttggttaaaatggctctggagtcttaaatcctgagtccaattctttctagtaataagttagartatttactttttagtgggggatgaaggggatggatgatttggttattttcatatgtcaaaaatttcaaggaaggactcctgtgctaactggaattatacataaacctaattgatgctctggtgagagcaactggaaagcactagttttagaatgtagacataaacctttatgtattgtatctcctgtctccattgtgtatactgttacataaaattaaagattaaaattaaacttttaaatttcactgattaaaatcaatttacctgattaaaattaagattgaagagaaagagagaaaaaagcacagtttattctcatcccaaacctcctttgttttcattagcaatgtgtagacytgaaattaccttaaaaacaaaacaaaactcccccatgaaacacatttaagaataaaagaatgattttccaaatatttgtcaatgcactttttgtacagggcactgaatgaaactttaaatatttttttcctcttatggttagtgacatgttastattgtgattcactcagaatttatttgacccccttgatcactagttcacatttgttttaatcttgatggctacactcatctaaaataaacagagcaggaagagtaagagaacgcttaaaaaaaaagcattttaaaataaagagtcacccattcctcttacgattatctcagcatgctgagaaagaagcctgatgggttggagataaggatgtctcctcctatgtccccgtgtgctctgcctctaaactctcctagcaccctgcacctgcctctgatagctgatccattcagtgggcattggttgaattccccatgtactgcctgctgggagtaagaagtcaaccaaaattcaggccttattttcaaggcattccctgtcagtggggagacaggcaggtaaaaagcgactcaatatagggtggtaagtaccaggacagaggagagagaggagttgtctgaagctatgtaggtcagggaggtggactccagggagtcttgcaaaatggcagggtaatttagatggtgatggcraaagcatttcagtggacatatatgcaaagacatggaagggacatactgccaaaggcattcagattatggtacttggctcactgcatctggaactttgttttcaaatgtctactaaccttccaagactaaattcctagagggcagtgatcaagtgccatggaactcagttatccaacagtaatagatttaatctttgccacattcctgtgaaccacatttctgtgaagcctataacattatcctattgatatgccccaagttacatttggaaaaccgagacacagaatggttaagtgacttgtccaaggtcacacagctaaacaggaatttaaacctgggcagtcaagctctagtgactgttttcttaactattatgctatgcaattagtatttaataaatgtttgaattgatgttaattgaatggatgtagaagtgattatgtgataatttatttattcacttatttaaaagaaataacatgccaggcgtgcccagatctaatagttgttgcaggaaaatgtcaagagcccccattggctttggctttggctttggctttgtgacttacagaaactcttaaaggtagaaatgttctgcagggctgtgaacctcaagatggtacttcagatttcagccaaattcagactcaacgtggaaataaaatatgagtttaggcctgaaacagaggagatctaatttcctatgtggagatgaagaaacaaaggctgtaaacatggccttacttggaaaatggaaggccctaggttttgaaaacagcctcttgggatagtttgaaggaagttgagtgagacaacaatgatgagggcaatatagctttaaaagaatgaattcactcttacttttgcattgattctgaagaggagagataagcgaggtttatggtgagagcaaagtggtgatgaacaggcaagggaagcagatttggctatagaaagcaggtgaggacctagagagtcatccatttattcatttattctaccagcaaaatcatgagctctgcgctgttccctgggattacaaatgaatcaaacacagtcgcagtcctcaaggagctcacagtccagtgatagagaaagataggaggctggagagtttcaatgctatgtggcacatgtccgtaatggaaatgtgtgtgagagacaaaggtaagagccatgatgggggattggagaaggggcatgctaggtctgatggcagagagaggagggctttccaggccaagggagtgcttatgtgcagagtgtggcacaggagagaacacagtgtgttctggtttgtcattgctggctgcagaagcctacagaaggctgtggcctggaatgtgcattccagggcttatggaacttgtagtgggtaaagaaggaagatgggagtcagtgaccagaagatgtcagttcagatccaggctctgcaccatgtgaatattggctagttagctttacctttcatttgctccttaacccttagtttgctcacctgtaaactgcaagtgatggcaagggaagacaccacctatctctcaggatcttcaggaaaattaagtggggtggtgagtgtgaacgtacttacaaaatcctctgagtccagcatgtaatttaattattataaattattataaaaaattattttattattttgtaagtgagggttttgtaagggctttgtaagagtctcatttcttcagggggaatgacacttgctctgttatctctacacttcccaccacacctttctgactgtgccctggaaaaatcctctggaagtgcattctgtcagtttagctgcttattgrggtatacagtaagaaaggagcagtccaagtggaggatggaccaagaacaaccctgctcttccaccctgagtttccttgtggggagccggaaaagccctctgctgtcagtatgcagagtgcactgtggcagtgatctgaaatttcccaggaaaacatgatggttttccttgtaggaaagcagaaaccctaatgactcttattaacatttgaagtacctcacttgggccattcacagtggatggctttttgaaagggcaaaagataccagaaattgtgtttgtaagtgtcaaacatgctactttcattatttctttttttagaawccacatagcccctccccctttgctatgtgtttactggtttggcattattgtgagagcttattagtggatgtttgtggagcattgtgaagatgaatagctattggcataggtgatgagtagtaatgtttttaagtatacttttctatttcagaaattaaattccaaggataaatcttaccagctcttagattagtcaactttgccacctgcagcacattttaatgggcacatatttcagaatgttaccttttggacaaggaaaatgaacatgtactgagtgcttactgtgtactgagctctgaaccaggtgccttcagatttgttgtttttctcacagcaaccctgcaagacagatagaattgttcacatttttcaaatgagtaaacttaaattgcactgcagagagtctgaactggctaaaccaaggtcaaggctggtggtggatttccaacccaagtcggatcacctccaaatctcatgctttttccattataccatgtagaattttgaattttgaattatggtctttcctgtaacacccatttattgggcagtatttactgactaataaacagcagatacacaggctagttgattttaatagggttagataatttacattctctaagattactaggttgcatttcatagtgataggaaaagtcctcagacttagagattgaagaaagggcacaaatttggtttcagccttgrgttcaagttacartcctagttaagtgacagtggactctgcctgaagactcattactccatcatgtgtagagtgacagcacttctacatctgtaaatgagaggaatgacaatacccacttctcaaagttgtgtgagaattaagtgaagtgatgtatgtaaagacacctctcaccatttcttattagtaccattggaaggacttaatgataattacttgcctaaatattttcctgtgtaactcaaagcactttttaatcagcattataacaggatttccctttactgagtgtttgtcatattccaggcactttgtatgtactttttccattactacacttatgacattagacagtaatttcttatttacttatttatttacttccttgcaggcaggaactctttctctctccttcatatctctggcattcaacataatggtttctggcccatcgaaggaactcattaatgttaggraacttagcttggcttttgttccttcttttgagagctaacttcagtttgggggaggggctgctccaatgaagtactaaattaacatcattaaattgtgtctcataacttgccctcaaatatatacctgtaactaaagaaattttagattgctctaattgacaatggatgattctgaatatgtgttaacattttactttttaaaaaaggtaaatttctgggataaaaagaayatattaagagttgcaagagtttaccaaacaaattttctttgtatctgtgattcaaaggacaagcttaccctactcagaaaagtaatgttttagtttcaaaatacatgtattatatccatttgataaatatacatgataatatacatgtatcatatamtaaatattcttagggacatagtaaattaattctaaaagggtcttatctgagaattgtagattatgcagcttgaattataatacaaatgtaatttttgaaattttatcatgtcttttttataatttaaaagttttatttttgatttttaaaaatgccaacttgacttttgcccaattagtgagtgtgacctttcaaaagcatattttgaaaaggcaaaagattgtgaagacagaaatactaacttatttattctcttataatctaaaattctatttttatgtggcaaatcataaaaatacatacagtaggagtttttttaaaaaaatagaacaatgggccgagtgcggtgactcacacctgtaatcccagcactttgggaggccgaggagggctgatcacaaggtcaagacattgagaccatcctagccaacatggtgaaaacctgtctctactaaaaatacaaaaaaattagctgggcttggtggcgcatgcctgtagtcccagttactcaggaggctgaggcaggagaatcacttgaacctaggaggcggaggtttcagtgagcagagatcacagcactgcactccagcctggggacagagcaagactctgtctcaaaacaaacaaacaaacaaatagaacaatgaagaaagtgaaattaagggaaactaagaggattttaaaaagataaattcagaagtaaaatttatgtttaaaaaaaaaaaaaaaaccagaagtttgcagtgaggtcccatgctctttacacacagaaaactatagatttggcacccattttcctaatattgaaaacaaaagcaaacccatcatgcagaggacagagaatattagtggtttaatgtcataaaaagtgcttgcctcagagcagacgtaagtattccgatacttgtgatttctggattttgtttgtttttttccatttctactttgcttgcttcttgttcatgatatttttaatcgatacgtattagaaggatgttcaaatgcaagaaagagagagagaagcttaaaaagcgtggtatggaatgccacttgacagtgtcatacattcacaagatgtccttgaagatggagcacagaacagagatcagggaaattttgtcagctgcagttgggaaaataaatggctgttgtgtgattgggcagatcctgaaagcagactcctgctcaaaccatgtaattaacaaaagtgggagcttttgtccaagtgcaaaatgttcataatatcagagtttgtcagcaggagcttttagaacggatcagtacttttcactccctgatccagggaatggttttcttataaatcatcttctctccttgctgtcctcatgaaggttgctgccgggcgataggcagacttaagattgtaaccttgctaattcacagtgatttaggtgaaggggagactgaaccagagactgtttctagaaatgtgatttttattcatttgggctcccatgagtactctaatgtaggaacaaacagagtgtgtccaaggagagatcytacaggatagctctggggaggagacagaatcatttttaatactgtgactccaaactggtttgaaggacttgacattttctttcttttttaaaaaacaacttcctttcagattataaaactgctgtattctcactgtaaaaacaaaacagagttgacaaataaagatggagaaaagtgtaacaatcacctgtaattctgccatttattctagtgttttttatttttccctcctactctgtacttgtttatataattgagataatcaatcttttatttcacttctttttctacattgatcatatacattttctcacattataaaaacccattataaacataactttagcaattgcagaatactgtatcaaaaaactgcacaatgagttatttagccatcccccttgttagactcctgggctgtttccgtttttctcactcctcttaatataactcattgtatgtacttctggtctgcagaattttggattcttttctgagtttcagaatggaccagtgggtccaagaatatgaacataagaagagatgtgccaatttatccttatacccataattatgagaaagactatttcactgcatcttagaacttgacagttgcaaaccttaaatttctagtttccatgtaaacatgttgcccacaaataattcaaaggcacacttctcctcacccaggcctgaattctcaccaacattgatttggtggagtccagttttactcctgcctccactaccttcccagggaatgtttaggggcaatggtatccaactggccctcagaggaagtttgagggataaagttctcctatcaagtcaaaatgttctttttttctaacatttatctcttataaaaagaaagaaagagagagagaaagaaagaaagaaagaaaagaaagaaagaaagaaagaaagaaagaaagaaagaaagaaagaaagaaagaaagaaagrgaaagaaagaaagaaagaaagaagcagtgaagggagaaattaacaataaactttcaagtgtgataaagtaattttcagatttaaaactactctatcagaataacattcaggatcttttcatgaatgaacatgtagctatatgaggctatatgaattgtccatgagtataatttatcacggccagttatatatgcattgaggtgctaagaaccattttatttcacttattatcttcaccttcagaatgacttaattttttgaattgcacaattagaagagccattgaccttacacaatttctcttaaaaagaacaagacttctacacagatttttctagacacaaactccctctactcccttttactcctcccctcttcctcaccctggttatgttaagaaaacaagtgttaattttcaaaataaaatatatttctatgtagatttctgaagaatttaatctgagtgtgcataaaacttaatttcagagatgtgacctaatgctttagatcatgatacatatgtggaatagcacattgctgtttacaagtaaacctcaagagtttgctgcgactgagccactagccaggcattttataaatatacaatactaatgtttacatgaattgtgccattggctattgtttatgcatttaattggaaagataagtctggcttaatcagtttgtgggcagtttttcaaatgattcattaattatgagaaagactgttctttgtatggaagatgaagataatgtatttcccatcacaactggttcccatcccaacaagtatccagagattattattaggcattttagttattttatccacattaaaccttcagagttcagagggtcttagggagcagaatgggaagaaattgttttccaatcgattttctttttattagagctgatacttttgcaggaaagctgagcttgcccacaaaattgtatttttattaaaatgcaaacatttgtctttttcaaatctgacttaaacaaagaaagcttattgaaagtacggtactgtatttatttactggccattttggaaaggagaaccgaattgtgggggatgaaggaaacgttccctcatctttataatgtgctgaatgatcaagctgtccctcagctatggagagtttgttgtaaaagtcagttaaaaccaaatacccaggggtcttaccagaactgcatcaggatggacacaccaggaaatcatcttaggcccaaaatgaagctctaaagaaacactgtaaaatgtaaaggaggccagtatttatttaggaggggaaatgggtgtgatgtgtctggggaagaagattaaaacttggatttccgtgaatttgagaatgatgcctatgagaaattaaattttgattatgcttttcatatccgtgctggccctgctattttaagtattaatgcctcttgttctctccagtggctgctgattttttaaaagccctgactaccaccactgagaatacttttggcatgcctggtgttcatctccagagcagaagttgctgtttgaaagaagggatgcctcacgcttacctcattgttacaaatataagttccttttagattataaagcgctatattctcattgtagaaacaaaacaaagagttgacaaataawcaagtcatttgtttaggatgtaggcatttataccaggaaaaggacagtcagttcagtatcaaaacaggtaggattagtctgagtgtatacgatttatatgcttttgctgaggagggggtgtcatttgagaaactctgaaggagactgcttaaaacaaagggatatacaattgattttaatgaattatttgtttgcctgccctcctctgccatcctcccagcttcaaccctctacagggagggaccagattatttttgttttcccaccttctagaagaatgccttggcttataattgcattcaataaacttgtgttgaattgaatacacttgttttaaggatatgctgagaatttattaccacataacttcccagagtaaataggtctttcaggttatttgtgcctctgcccaaaggtattattaagctgtcagcatgtgtttcttggatggaattaaatatttttttctagagttttctagttaccttctggcagaagctacagaaacatggtatgaatggttttgggaaacatgagtgcagtctttagccacagtcccctagtccagtggtctttgtgagtcatcacctgtaatttggttggaagggtggtatttccaagttcccttttcctagagttatcagatcatcagtctcagctcctccccttgggtcccattaataacatatgtctccttcacagttgaatcataaccaggaaagtgttgcatttcaaaaaaaaatattaacctgaagggacttgagcgaattaaagcctcttgaaaagaaggacgggagagaatagattttatgagctgatctaagacactttaaagaaatatgaaattggggaattgtaacgacatttttagtatcttttaaggagcaagaagagaagtgaggaattttacaaaaaaaaataatgtctgtcttcaggaacacagagcctgctgtgtaattttctaactttgggaatttgtttttcaggcttggaaaggtgggtgagatgcagtagtctgggctattgcatccaccagagtctaacatactacatgtcagaattttacaagggttaagtgggaaattcctacaaagagaattaggacttttatttttgttctcattaataatttaaatctatttctttaatggttcaattcagtgactgcccttggtaaacattattcttcatgcacctgagagagcttgttctattacataagggttagctttatacatatattttcaaaaatccttccaacatggtaaaagaaaacacctttacatactcattaaaatatttaataaaatacatgcatgagtctcaggtgtacacacctgagacatgtttgcaatcagtacattcctttaacatctttctcgtttctgggaatactgacttttaaaggtagctgaaagtagaggataagggtatttgtaaaagaaacatcatgttctgtgaccttctttggttctttcctcttgatcctttcgcatgaattgtgcagtgaggctatatctccrccagaaaaccaggagttaaggactgccaaaagtatggtgacaggtgtacaagaaccctgcactgggctcttagatgatgaatgtcagtactgagttctgtatcaggtcagattcctgtaatgtaaagttgtaacctttgatttgcctcatgaagtaaatcctgaaagtaggtgtaggttaactagattaaaatatctaaatgcaaaacaataacgtggggtcgtatgtaggtaaagtggaggggatagggtaagacagggttctaaaccttgctattaagaagtaaaagagtgttagtctacactgaagtattccaaaaatgtcacaggcttgaatgggaaggaacagtttgtggactttccatctttatttttatactaccatttttagggaaaatattaggacaaggacacaatatggtgtggttggcaggatggtaagaagactatggtagcaacaatgattctcctccactgtgaggagggggatcaatcctgtaactctagcctgattgccccaaacttgagaaaattaaagctttgtgaagagtggaggatggaaggaggtgtaagaaagtcatgagctaatggaataaatattaactactcaggaggttgaggtgggaggatcacttgagcccaggagttcaagtccagctggggcaacatagagagacccagtcaaaaaaaagggaaggaaggaaggaaggaaggcaggaaggaaggaaaaaaagttttaagggagctttaaatacatttttagtacatccgtacacttttagattttagaatagtcttgcttaatatacttcaaagattttcctagtcacaagacatgctgctgtctcttctctgacatgtggacccttcatcaataaatatttatttgattagtaaattaatgaattctgagagcaagaaatcatatgaaaagagtggtttgggaaggaaggaaaggttttacttttgattatattgctaatcagcttttcttgtctaactcttaacctagtttcttaggtattggtttttatctttctccttgttctcttctaataatattagcatcagtcaccactagcatctgtggagggattaccatgccaggaatagtgctgagtgctccatgtacattatctcactgagtcctttttataccagtaagagcaaaggctgccctgaaccaccaggttctattcttttccttttgactcattaaatagggctgagataaaagtgtggaggggccgagtgaagatgattgacactatatgctgccaacatgcttaattaacagttctcagccaccttggtgtgaggtaggtagagggcagagggtaggtcagtggaagggctggggtaaggccgtattctaaactttcctatcaagaagtgaaagagtgctagtctacacagaggtgctccaaaaatgctgcaggttcgaatgggaaggaacaatttgggaactttcaatctggagataatagattggctttagtgaacataaaatgctgtttgagtgtacatttttctgaggatatagggccaaggcattcaataggttttctgaggatatagggccaaagcattcaatagtagactcatgccagccaaagctttaaccctcctgcttgaatgagtgcttttttttttttgaggtggagtcttgctctgtcacccaggctggagtgcagtggcgtgatctcggctcactgcaaccaccgccttccaggttcaagtgattctcctgccttagcctcccaagttgctgggattacaggcacaggcacccgccatcatgcctggcaaatttttgtatttttagtagaggtggggtttctccatgttggccaggttggtctcaaactcctgatctcaggtgatcctcccaccttggcctcccaaagtgctgggattacaggcatgagccaccacacctggctaatgagtgcttcttaaaatctgcatttgacatagagatggaaagtagaatggtagttgccaggagctggggaaagtaggggaatgaggaggtattgtttaatgggtatagagtttcagacttacaagatgacaagaattctgctggtggctgcaaagcaatatgaaggtacttaatgccactgaactgtatactttaaaactatttagttggcaaattttgctatgtgtattttaccacaattttaaaaattgaaaaaaaatctgcatttgaaagaatatttaagtgtatgcctggcatataataggtgctcagtaggtgactggttgcttacctgtcctgttcttttgttatctgtaaaatggggatgatattagtactttattggcttgtacttcacagggttgtttgagagatccagtaagctaatggacatgtaaggactttcattcattctacagtcctttatctgggacctaccgattgttaggctttattctacattcaggagatgctgtaataaacaaaacagatgtgatctctgtgctgtggacctcacagttcaggtcatgaattttaatgaactgtaaagtgctatactcagaaaagtatggaggtagacatgtctccacaagtctgttgaagtacattctggtcctccactttaaaattacagggttgggcttcatggaccctaatgttctctggtatctgttgaattcaagaagggtctgctctttgtctttgttatctctgtatccccagagttcagcacagatctcggctccatctctgtttatctaacatacccagatctagccatagtggaagtaaaccctttttaaatgtgcgtatgacctgacatatccaggaactagtgttacaggtaacttgggtaganaaaaggagcctggattgtgttgagagaggtgccagaagggaacagaggggtggctttttagtttccaagagcaggaggctggctgagcctctgctccttacctcccctctgcagatataaacgaccctggtgatgatccggcagctgcacgtctgaagccttccctcttgcttttgttgtatattttgcagaaaagagtggtgggaggggtgaggttaatgcattgagtgtgagtaattagtcattcaaaccatcgacatttacgatgacaggatttgagtgcctacgttattgtgcaccgctctaatagtttatccctgaaattttctgcctgtataatgtttcttaaaatatatcmcagaaacataaaagatttaatgtagtgctttgtacatccattagagttcgaagtcaactgaacctcctcaatgatctatcctggatgctgactgtaattctgttcttaattgctattcaaatgaggaaaggagggcaagtcaggggcttggaacctggtcagctgcaaagttggctgtgagacccacacagaatgtttcattaaagtacatatgcacacttgagtaactgatatatttatttgcaatgaaaattgtgctgttagaatatcaaaggcgttagcctgaggaagcaagtgttctgattttgcccagccagcctctgtacttactggaggatgtgctttctaccaacacacatcttttctactcctgttctgtccctctgtttcccaagcagagagaacaggtgtcctgtctttgaggtctatcatgtaaccttaaaatgctgtagtttcatattcgtgcatttaatatctttacatcttggcaacttctcttattttccaggtaatgttttaaaatcctcttgtttcattcacatgtcagatttgattctgatgttttacatttctgattttttttttcagcctgtgttgcatcctaagatgcatcattaagacctgtgaggggtcttattataggatgtatattaacacatttgcaaatgtttctcagctttcagacagcacacttttattgagaaaactctctttgtatgtgtccatttgtgtgttttcatcagttccttctggatacacaaaagaataactgtgtagtgtagatgcagagcaaagagagctccatctacattggatgagaatgacttgacctaatttatagatgtggtcagctaaagtagctcagtagtgagcattgtatctcatggctccttttagaagctagttgggaccagttgggctgtctaatctacagacaggactcacctcctggagtcaacatagattaggaaatccacatagaatgcaaggaaggccacaaagctgatgcggggactgaaattactttgctgcagccttgttacttcacaggccttcctggaggaggtggacctgtgagatgttcacatggacaagtgctggctttcaccacgtgtctgaaaacgaaagatgaacctgactatcaggtgacctttatgagttttggtcccacagaatctcarcatgaaattcttccacatactccatcactagcaccaaataagctgccttggtgtgggatattttctaggtgtttgttggggagctgaaagaagggtaacctgaaaaaggtagaaaacagagaagagtttctaaagattgtgggcctggggggtttttgccattaaatcgaatgtagtagtccggcctcctgaatggataaattctgattttcatgttcattatcgagttggcagtgcttcttatgtttgttgcctggacacctgactcagtgaagcagtgagacaacacagcaaatggaggcactgcaaagacccagaaggccccacagcttggcagagctgaaacctgcctcctagccaggagttgtgctgatgctctgtaatgccatccctttagcatgcctccttccctggggaccatctccctgattcttttcctggacccttgcctcgaaggcaaagtggctgaataggctttgctgggtacaacttctatcagtcctgaggggagcttgatttaagattcttctcagaagctttttgctttctccttgctgtctggaccagccttctagaatcctaaagttgacctgaagccaagaagaaaattctggtgatgggagaagtggagccacttaaattacttacatgatggtaaagaatcttagatgctccccatctttcttagtctgctttatttccttggctcctcttgagccatgttttcctttttgtttcatttatcatttgtgaccatcagaagatgaaagaattagaataacactcacctacgtggggcatgatgaggaataatagttatgatgcctctgggccctttgtattttagacatttaatgtacattatctctcatcctgaagataaccctgcgtggcaagctttttattccagttttgctgaagaggaagctgaggctcagagtattgaagtaacctgcctcagatcacacagctaataagtggtaaaactaagttttttgtttttttgttttttgagacggagtttcactcctgttgcccaggctagagtgcagtggtgcaatcttggctcactgtaccctctacctcccaggttcaagtgattctcctgcctcagcctcccgagtagctgggattacaggtgtgcaccaccacacacacacagctaattttgtattttcaatagagactgggtttctccatgttggtcaggctggtcttgaactcctgacctcaggtgatctgcccacctcggcctcccaaagtgttgggattacaggtgtgagccaccgcacctggcctagaactcagattttaaatcacctgttgtcttgactcaaacactcattccatttttactataccactctgcttcagatgagaaaataaacaaaaacaaaaacaaaaaatagtctctgaacattgatgaggatgtggagcaactggaactttcatactctgctggtgggaatataaatggatacagccactttgaaatactgttggcagtatctactgaagctaaatatacatacaccctatgatcccaaaaacagaatcctaggactatccccaatagaaatatgtacatttttgtaccaaaatgttgtacataacgctcatagcagcattatctatagtagttcaaaattagaaacaatccaaatgttcatcaacagataaataaaatgtaatatttccacacaatggaaattgctatagcagtgggaagaacaatgcattgttacatgtaacagagcagatgacactccatacatgtgtgaaaaggcacaaaagagtatgtgttgtatgagtccatgtatataaaggtaaaaaaataggtaaaacaaatctgtggactagaattcagaatagtggttacctttgaggggtgaggtaaatgacagggatggagaacctgagaaaggcatttggggtgccagtcatgttctgtattgtgatctgaaaggtaattacccagttgtgaattgtgttcactttgtaaacattctttgtgttgtacccttaagatttatacactttattacatgtatgttatagtaaatgaaaatgcttcccccctaaatcctctgagcaggcaaatggtaataataatggaagctactagttatcagatgtctgctatgccttggtttcctcatctataagacatagagaatattagaatatgcttcattgccttcttgtgaggagacagtgagagaagtcacattggatgattggcagagtaactaataaacatcagtgattgtggttatgtgcccaccactgttctggtgctttacataagtcatatcactggatcggttcttaccgctttgccatacggtggcattgttcccatttttcaaatgaggaaaatgaagactsttaggatttaagtcccttgccaaggtcacacagctagtaagtggcagagtatgatttcatttccaaggagttgatgatcagtttctgaggagatggaagccattttatgatggacaaatagaggacggtgtaagacaaaatggaaagttgcgaattatgggctgcgtttggggccaggaaatccggktgcaggcctggactttgcccccatttttctatgataacagagaagtaactggacatctctgggcttcatctcgaatgtgagtgttgagctagattttgttcccttatgtgccttctggctctgcaattttgcaattctccatgtttgtcattccatacagggcatcttcatgacctgacttcatgagcttaaactcatttttcatataaaaccctattccagcattttctcagaactgtccctaaatctccctatcctataagcagaagtaattgcttctgtattgcatgatcactgccctataccagctgtttacctgtctgtgtcctctatagactataagctccctgaggatagggattcattcatttctttattctcatacgtgctacctggaacattcacaccagccagaaatctttgtttaattaaatattttaatcaagagaaagtcctttttgagtaatatgtgagtggacagcctcaggcggtgctggacctaacgtggagacctagagaaaagtttgcctccatgttttttgttttattagaggtctgggagaaacaataacagaatggctagattaaaaaaaaaaagacattagatgactttgcagctccctagaatgtacctgtaaaatctaaaatttgatcagtgattaagcatcagtgaaaatttaaacccttcccatattgaacaaccccacttaatttaatgtcattttattttatgagatagttaataaacaggtactgtatttgatcttgtgagtgtagtcctctatatttagctttttcagctttaatggaactataattttaatcatgattattactttacattttaattataatttggtgtggcttaagtatacatttctgagagtgattgtgtaatgaaaacaggaattagcttttcattaacaaaataatgggagagttcctactgcattctagtctgtgttcaaaatctatgggctggcctaaaaatagaaagaggagtttaacattttggttaaaaacatgcttctaaattggctgtgttcacaacccagtctcttgctccatcttgctttatcttcttctctttcttttcaaaaaaattaataaacttttaaaagagactttgtgtctgagatttcaaaaggctttttcaattgtttttatttttatttagataattagcaccatggagcctcaggtgtcaaatggtccgacatccaatacaagcaatggaccctccagcaacaacagaaactgtccttctcccatgcaaacaggggcaaccacagatgacagcaaaaccaacctcatcgtcaactatttaccccagaatatgacccaagaagaattcaggagtctcttcgggagcattggtgaaatagaatcctgcaaacttgtgagagacaaaattacaggtatgcacaggatttgaagctatgttgttccattagatgtgcagatcttagcagaaatgcacatgtgtgatggtgcacctgaatgtctatatcatgtaccctgcatgcaagatggcatggatacacagtcataaactcacactacatacaccacataagaccttattgtagattggtactgctggggagcagatgaagattttggtacatcttcatcttcatgtaaaatgatcctttgattttgtctccttttattcttaatcagccattccttccctttgttctatagtttccagtcccacaactctgccctccctatactatacactagtttttgctcatgtattctcctcctctcaatatttgcttcatgtgtgcccagtgttcttccatgtgcctgaaacaagtgttttaaagggggccactgtggatgtgtggacagttgacacaactgcccttgtccctggggagaaacaggccctaaggatagcagattattctggaatacaactactctgcagtaggagggaaatgcttaatgaagatctgcatttgaggtattttgttttattttatctgtctgttcgttttgaagatactctttgagatgtgagggcatttttacttgaaagtgaatcaacaccctatacaacttcaatacatgagatttttaggttctgattttctcctaattgacaactgttcattgagaaccaaatgtttgccagacactgacactataattctttgggggaaagtttccctataatcttattggcagtgagaatattttcttggaatatattaggctacataatgatggcagtgaagctgctactctctgatactccactcctgaaatcattcatatccaactttgaatacttgtcagttttgagtattgacttttgtttccctttccctagacagtttaattaatcagcaactgtcctagagtttttttttttttaaaaaggaagctgcatcattaaaatagggatatacatcatctttattttaaatcagagaatacattctatatgtgtgtgtgtagatatatacattcttctgttctcataattcacatgtaaatctgttccccttataaattaagtagtttgcaaaatcataaaacttaaataccactgctactttccaaaatacaagtcacctaacactccagacataattttcttatttgaaaaactggaagataatgcttgtctcaaagggcttattgtgaggattaaatgagagactagatatattgcatctagcacaatgtctactgcacagtggtccctcagtaaataaatctattattgtaagtacagctagtatgcttcaaggaaagtggccagaacagaaaaaaaagtatctrtcaaattctccaaatagggccaggctttgattatcttgtaccagagcactggaacatctatccttaaacagaatttcccatacgttcagaaagccaatatttagattcctgaataatctttatataataggatgataattcaaaccaaattaaaaccagttaaccatatgattcttcctcctactcctatatagaaaatgtatttttagtatagccttaccttcaaaatacagactctgccagctatattagtgaatattattaatcaccttttcagaattccttcagaactgtagcgagatttttgagaagtactgattcatggtgttgttccttgttttctaaagacacatgtttaaacaagcagattcctttactgaaagaatgctaatttggtagttcaccgagtggatttgaataggagtgacagcttcgaagacagcctttaatttggtatacaaaaccaaaattgtcaactttggtttgtttagcaccctctccagcacaagcagagacatacagtagcatctgagcttaaagaagaagcttatggggttgaaagcagaaatacaattcaggcataaatttataattatgcattcttcttaaattcaggcccaaaaaatttttatttgtagagagcttatgggaatgaggcagggaaatatagagagagaccagagatatttgccctcatttgacagcagtgtttaatagaagtaaaacttgtggttgtaaagagtgcttattaaattcttcatttacactacctaattaattctagcattttaaattaacagtgaaactagtccctgctgtaccattccatagatgcagcatatttcctccatccacccgttgttcaggtttaattggctatgctaaaagtcagagaaggagggagagatagggctgtggggaaatggggaaggagtgggaattgctctagcggaggacctccccgaggccaacatttggggttaggtcacaatgcaggctggaagaggtgaggtatatcacaccaggcaagtggagaggctgcagctggtggttcagaagtcagggtaaatgacatcatgggtatttttgttgccctgatttttaacatcctagtccccctttttcctccaacacctcctacagatctcaatgcatctcgatcctgtgaagtttacaaggagttctaaatatccagtgggaggattggggggtgggaggtggcaaagagataagaattcaagattaagattttccagccccaaccactccctaagagaatgtaatggattcccttagaaggttctggcttctgcaatgttaaaatctctttacagagagaggaagtgactctgttgatagccttaccagcaggctagattcatccctggctgtgaattgtcaatgaattctccgtttgagaacagakagaagaaatttggtcatggagttaagtgttatgtgctggggacataaacatcaccatttatcaagcacttcatctgtgctggatacttgctaagcrctggacataccctatttcatttaacacggagcctccattttcttagatgaggaaactgaagcttggtgatttccccaggcagcatagttattagcaggtggtggagctgggagtcacccctactttccaaaagcatgattttatttggaggcatgtacagggtaaagaccctgcctaacctgcacttcataacccaatgcaacattgtgttctgctgagcagaggttgctgggcaccctctggagagtctatctaatgtaccatggctttaaacaagactcatgtgtataaagggagcaaagataacaatatttatcatcctctggggatataactcagcctttgtcttccttcagagtagaaccaaatttactgaaaatgccagttttaagataccttgcttttggacatctctgttacttatcttctcagagacattacatttttctttttccaattgggaaaggacactcaccagaataatccaggtaccagggagaagaaaggcatatcctgagttgcttttgtgtacagccgtgacacatcatggcattggaagctaagtctttagcttttcttcttcatctacctgcagcctctgctgctggggaaaacaaaggaagtgtcatgtgacccacagagttcatgcaacctagaaactcaggcaaagaacaccaaatacctggtagaaattatattattcccatggactccaaggagttgatttagtttcttatttttttgttttgttaccattttggttttggttttgttttgtaaacattgagattgccttactgaatccaagttcctatgtgatcagtattttaggggagaaaacatgtggcttgaccagggcaaggttaggtggctcagggtatgtcttgaaaccagcagagctgaattattattattatttctttgccttttttgcatttttataagtgtttatcttgttaccgccccaaaacaaataaggaaagaaaaaaaaagaaaaatctctagaaagaaattaggccaggcgcagtgactcacgcttggaatcccagcactttgggtggccaaggcagatgggtcacctgaggtcaggagtttaagaccagcctggccaacatggtgaaaccccgtctctactaaaaatacaaaaattagctaggcgtggtggtgggcgcctgtaatcccagctactcgggaggctgaggcaggagaattgcttgaatctgggaggcggaggttgcattgagctgagattgcgctccagcctgggtaacaagtacgaaactctgtctcaaaaaaaaaagaaaaagaaaaaagaaatcagtgtaagacaacaaacagttttgacctgcctatttacattgtgtgattatttgcatcacagtgataaaaaaaagaattgtatttttacttcatgtcactctctgtgtacccatgcattgtcctttttttttttttttttttgagatgaagtctcactctgttgcccagactggagtgcagtggtgcaatctcggctcactgcaacctccacctcctgggttcaagtgattctcctgcctcagcctcccgagtaactgggactacaggcacccgccaccacgcctggctaatttttgtatttttagtagagacagggtttcaccatattggccaggctggtctcaaactcctgaccttgtgatctgcctgcctcggcctcccaacgtgctgggattacaggcatgagccactgtgcctagccacagtgtactttgtttttgaggacaggacagaccaaactgaacattatcaataacaaaactgaatctattaagagacaagtatatggaacatgctattaatacgtaagtgctataggtggttggaagaggtgaggttggtgttagctggagctgttggggaaagtttaaaagatagggtaaggatttaggtagaggaaagaaaagcaaaggaatagagctaaaattttagtcaaagaacaaaagcattttttattcctctgtgctttggacaaaagaagtagcgctggaacatgtctctttggaagcagtggtctaatatgaagcagcatggtcaaatgaagttaagcataccaaaaaattcagtcagttagagttgtaccccaatggacaaagacaacatttcctaaacaccacttctaatccgtgtcttcatttcttcctttataatacgtctctttggtttaattaatatcatttagtggaaaaagaataaggccaaataaatgaccttcactactgtgggcaagagggtggatattttgctgctgcctttgtatctgaatttacaactctaattaaaggaaccaactcagttttgatgcagtaacactgggtaacttgtgttctttcttgaatttctgaaagtgctaacaatcctgagcgtgtctctctcagtaggtgagatgtgggaaatggaccacagcggtggccacagtatctattagagcatctaggctttgagtcatgacagagtacagtctattgggttgaagaggagaggggagtgagggttctggattgttttaatgtaccttatatactttcatgtactggacttataggaacactatgggaatttggttgaattttacttctgagataactatataaacaataaaaggctctgaaaaatcctaagatataaaaattccttgaactcactcccaaaatgtgaattcagccccaaggtgagtttattggcataatttcttacaacacccagcagacatataagaataactgcaacagcttttattttttgtgtgtgccttaatatgtttactgggcactataataatgctttaaatatagtagcttatttaaataataaatcaagctatcttggagaatcataatggccaatgcttttgagtacttactgtgtgccaagcattgtgctgagatcagtagacggagtctcacataatcctcatgatggccattttacagatgcagaaacttgaaatcaggagcagttgaattactggccaacgtgacttagcttccaagttaagggaggtggtacttgaacccagcactgactaattgtgaattgtcaaatttatactttatttctggcagtttgccccaaaatactaaactgactcctcccctttacaaactaactcagcttgtatacctagggaatgaaatttttgaataccgggaaaacataattagagctcagaatcttttgttttggaaaatagcacacagtgcattaaaaagataaatttttggtattaaacaggtcactgcttagctaaacaaagaagactagacttggagtggttttttcacttctgatattctcttttcgtgaaatactcttcagtatgttcaccttttctttattgtgcaggcactgtattgaaatggatgctgcctacaatttaagcataataaaaacccagcctcatttaggcatatccaagaaaatcccaagatattgattagctaaatgaacttttctacatgcacataagacggaaagtsattagtgatgggaagagtacagcaaatggtagcatttatcagcatattttgctgctgatttggaaaatgtgcttagtacaatgtgatgtatctcctgatttcagaggaaaatcaggcagattcgcatctgtcattttatttaccacctccctgcagtcatacatattctacaaagaagaataaaagagttttgatttgttgactcgggaagagggggttggctattgttggaggtgagtggaaaatttttaggtatggagaagatttggcagcctaatggggttgcaaaacaggagaattggagtctgccttattaaggggaacttgaagaacgtcagaacgtgtagtgcaaacagtaaaccatgtaatcattgtgcttcttacacactcatcagggggaatcagagactttccatcctttctaattagggcaggttggcagttgagtggagctgtgaggtttagggtttgtgcaggtacattatgcatcttctgacacaattttttcccaggatgtctgtagtcaggattacagaccaggtatggtttccttttgcctcctggctgtgttccccttcatcttaccttccaaatcagacagttctgccctgcttccgaactcagataaccgtaggaaagtattctcacatcccagaagagatgtctcaaaggatttttacctaggatgtgaatcaggctgggtattttaagaattttctatttctgtactttagctgactgtttggttcgtaagaccaattccctgttcacgcagccttctcttcttcccccaacacacacacacacacacacccacacattcactcactcactcctcccttctctgtagaatgccctggttgattgagactaggaactaaggaggaaggtaatgtcaaactgaaatttccacacattatctaaaaatgtaattcatcagcttcagggtaggaggaaagtgctttctgaaatgtgttaatgggaaattcattttcttcttgtcttctgtgaggtgtagtagtggtgatttctttttccaatctgccccctcgcccccattccacatctccctgactgctcttaactgataaactctgtatctgtgtttattcctcgtaagaactaaagatcattaagttgctttttcgttttttctacagtcccaaaattgagctttgataggagaagatatttctagtttggagagaagataaaattcagatagagatcatatatttgtataaggtttttatatttgtaaaacattttcaatcaaccaacagtatttatttagtgtctactctctcagaccaaatagatattattccctttccttcccttctctgaaattctgtatcacagtctgtgaggaggtcaaaatggataagtcatagtttgtgcccatgtgttgctgcaggaccaacgagccagggaaaccagaacaaatgacagcccttcatgaaagtctggaagtgacrgggagctggctgcttattatgcatattaactacacatctaccttgctgttttgtgggcgggggcaagagggaagtggaggttgttttgttttgttcttcaccaaggcccaatcttacttttccttggtcctggctattaatgtcattggaaggatggtgaaaaaggattcataatgatacaatgaagttggaggtttgatggaatgcctactgcgtgtcagctacagtgctaggcatattatagatgttatctcattgaagctttatatcagtgttgcctgatcagtgattttattcccattttgcagatgcagaacccaagacctagaattagtcagctggtgagtggggttagggcatctgactgcaaagtctatggtctttctgttaccataccactctgtctgtgctgaatgaagacaacatcagttatgggtgttcaaaggagaaaaagatgacaatagactgagattctcaaagcaagtgtcaaagaaaagcgagccttcaacttggccctgaatttggtagagattagattgtaggagaccagtccatgcagaggaggcagctgagcgaagctycagagacattgttatggaatgaatgtttatgtccccgcaaaattcttatgttgaagttctaacccccaatgtaatagtttttggagatagggcctctgcagaagtaattaaggttaaatgaggccataatggtagatccctgatctgataagattagtgatcttataagaagaggaagagagactggaattttctccatacatatgcaacaagcaagaaggcagctatctgcaagccagaraaagagccttcactagaacccaaccatgctagcaccctgatcttggatttccagactccagaactgtgagaaaataaatttctgttgtttaagccacccagtctgtggtatcttcttatagtagcccaagctgcctaatacagacatcttcaagagataatgaatagaacaggcaggactactctgtcgggtaaatggggataccacctttgtgtcagtgaaatatctgaagctcagagatgttaaataatttatccagggtcacagttaataagcggtggagctgatatttgaacccaagtctgattctgaggtctgcgttccttctactttgctagtaactaactctacctaacacagaaggaagttgacagctttcagacttcccatggcgtctgtgatctgagaaccattatttatctctctaaggtgatgtacccatttgctcagtgacttgctttccacctacttagttcttgcggatttctaagttgagttttctgcatgtcccttattttgtagttgaatgtctggtgagatacaaggcctcataaacacaaagtggatacagctagctagggtaataactctaattcctatggccgctaatggaatttctcatcacaaacttctggaatcagattaaataattttattggtgatataagcataaaatatacacttagcaatccctgatatttgcccttagtgtttgttttcagaggcttttatactcagtacttcctttgacgagtcaagagcacttggctgcttatttttcttgctctttcttcctctcttttctttgcctggtttgttgttgttgttatattttgtgtgtgtgtgtgtgtgtgtgtgtgtgtgtgtttgtcctgcttcctctttctgccttcttgttttttgacatgtcactttgatccaaaaaggattttcattggcttattagatagtatggaaaaaactaaaattgaaatagccatcaattttttwaaaaaacagaatagaaggaaatggatatagaatggtaaaaggagaccagaggaaatttagtaaattaattgtggttaaatgactcaaacggaccacctagtttgagttttctttttttttaattattattatactttaagttttagggtacatgtgcacaatatgcaggttagttacatatgtatacatgtgccatgctggtgtgctgcacccattaactcgtcatttagcattagttatatctcctaatgctatccctcccccctccccccaccccacaacagtccccagagtatgatgttccccttcctgtgtccatgtgttctcattgttcaattcccatctaggagttttctttacatcaatgaaaatgaatggtgacaactttggttcctttctcaagtagttaccagaatccccacaccctctcccaccactggccctgtagccctttctctggagacaggcctctgattgtagagacacttgcccactgtaatgcaggattggatagaaagcctgaaatcatatacatggaattttcctcatctttcttgcctgggtccattttggattgattgacttgctttttatggctagggcaggcagtaacacagagaagctgcctgagtggagttcttgtttttattaatataaggtataaacaatgtgccctatggaggaggtgttctgaagcaggccttccttgcctgctgccctgaactgaggtattactgaagtattactgctttctgagtcacttcagtctttcctctcccttcagaccccaaggctggacatgcaggaacttcagttttcagcttccgtctttctcgtgagggtttctgcagtgagttctgtctggtttctcattacccagagccctgagctggacaacaaacaggaaactcaaatgtcactctcatatcctggtcctaactgtggaaactggaactagtcctcaaccacctttgctcttcccagtgcccctcaccagtcaatggacacagatcaccctctaagtacgagagagagacagcactacccaagagctccgcacaccccagcacacacacacatcccccaaacacttttctggcatgcatgtgcgtgcacaggcacrcacacacacacacacacacatcccccaaacacttttctggcaggcatgtgcgcacgcaggcacacacacaaacacatcccccaaacactttctggtcagaaataccaaacccagtgcatcagactaaccagaattgagacagacttcactgaaagtcctgccttgccttccccaccccatacttgatagatgtatttgaaaccttatgtaagtcatgttatccctttggatctccatttcctcaatacacagtagagaagataaatcttaaccctaccttctttggatggtacttgtgaattcaaaccaggtgatacatgcgaaggcactttgtaaatgaaagcagtctataaatgggttgctcctatctcgtaactcctaaccacttctcatcaagggtgttagccctgggccaacagatggataaagggggaggagagggaaggtggatgtctgttcctggttcaatcctaggttatgtaattccaagtaggaagtaggagatggcatctgagaaggcaggagaatagaatggaaacttacgtttactaagcacctgctagatgccagatgttagatgccgccttatatttatctcatttaatcctgaccacatctacagtaggtacacattagtgacccccttatttagacaaggaaaccaaggttcctggagtttaatgtgactagcctaaggtcacacagcaagcaagtggccaagccggctgcatacccatgtctgtctgccagctgggacgagagaccttcacaagagagggtttcccacattcttgctgtttcatcctgagtcatgaatgtggctgtacattgtattccagtaaacctcaggaatagctgcagaaataatgaacaccaatttcagtggttctggaagattgtaaatgaaagcctttagttcaataagatgctcctccatttacagtgggattatatcctgatacaccgtcataaattgaaaatatcataagttgaaaatgcatttaatactctgataaacccattgtaaagtcaagaagtcatcataaatccaaccattgtaagtcggggacggtctgtagttgaatatgtcaggataatttctgagattttttttaaaattaggccacttctataagtggtaacatgataaagtggaaggatccactaagttcttgttctcgggctagctatgggacttttggtggatcaagccattctgtgcctcaggttgttgtgcataaaatggagataatactgacttttcgcacctttctgtgtgttgtgagatcagatgatttgctaatgtgctggtaaattcaggatattactgtggtcacctataagataggacattgtaagcaggggatttatgagggtaaaacaaacccttaaaccccctgtgataagctatctttccttcctagtctgccttccagaagttttgctcagttatctgcgtacatctcaacaaaagctgattaactctctcagacatcagtgtctaactgttattaatgctcaagctgatcaaattacaatgccacagatcctacttgtgctgttaatattagattttggattccggtctataatgaatgatttttcctccatgcattgggaaaattggttagcagagttcataagaaagtttaattagcaggctgtttgtgaaaatagcggctgtgagtcatcattcagaatgaactaacatttctcaggcttgaatttgttcttttgttccttgagcagccacataggatccttgtgtttgggaagctggtgtccacatgttgcccatttgaatggcaccatgtaataaactaataaccaaaacatcagatttaaaaaaccagagaggaagaggaggtatagggtgtttgtatatatagatatgtgtatctgtgtctgctaagggaatattttaggcctaagctaatccagcacggtgctagacaggatagtctagtgattaagagctagactacctatatctacgtctctgccttatcatttactagctgtgtaacaggcaaattyttaacttctctgggcctcaggtttatcatttataaaatagtgatactgataggattattgtgaacattaatttatgtaaactacccagaacaacacctggcatatagtaatataattcttacaggagttctgtgagatgtaggtattattagctccattttatagatgaggaaacagctgtgtgatcttggataagaaagtaacttatctaagatcacacagcttctaagtggcaaagtcgaaccaatgtttatttgactccaaagcctctgtttgtatttactatactgtactagcttccagggtcgtatgcctagttcattaagtgtagatactctgtttgtgtgtgtgtgtgtctgcatgtgtgtatgtgtgtacctatgagagtttgctcctgcttgactatccatacagccacacacaattgttttgcatttttttccttgggtctttggttctcctagtgaaacttcaggagctcactgctgactactcacacagtgagctagaaccagacttgtacaacttgtaccaacatgaaaatgtgtcttcagatgtctgactcccctccccactatgcaattctgtcctgtgtctagattatcccagaagcaagactctgtgatgtcatctgagaagccaaatcatagactgtcacagtgaaaagagaccttaaaagtactccatggcagccaggcctggtggctcacccctgtaatcccagcactttgggagtccaaggcgggtggatcacgaggtcaggagtttaagaccagcctggccaaaatggtgaaactccatctctactaaaaatacaaaacaagctgtgcatggtggcaggcgcctgtaatcccagctattcgggaggctgaggcagagaattgcttgaacccaggaggcagaggttgcagcagtgagccgagattgtgccactgcactccagcctggacgacagagcaagactccttctcaaaaaaaaaaaaaaaaaagaaagaaatactctgtggcttggtcttattttcaactggcaggattgttatttcaggaactatagttcaggtttggggaccagatcccccaccttaagtaaaaatcttgagacagtattcagtcctgtttcaaagggtaatattcatttgagaattccatctaaaaatcttttccaaaggcgcttaattgataatgttttttaaaaggggttctgtgaccaaatgagtttgaaaaactgaagtgaaccaagtttaaaagtgatttattggtggggcatggtgcctcatgcctataatcctggcactgtgggagrccgaggcaggcggatcacttgaggtcaagagttcgaggccagcctggccaacatggtgaaaccccatctctactaaaaatacaaaaaattagctgggctttgtggtgggtgcctgtaataccagctacttgggggactgaggcacgagaatcacttgaacctgagaggcggaggttgcagtgagctgagatcacaccactgcactccagcctgggtgatggagcgagattccatctcaaaataaaaaaaaaaaatggggggctctttttatcagtacttctctgaacctgtgctaacacgacgtgaaaaggaatggyataatatggagcattacccaaggaacccttttccctccagcattttgtatactctcctttctaagccagtagagaagaatggagtccttggaggataaatttgagggtgggagacaaggaggcagtttgcaacagttcctacatgaagacctcatttatttcattaagaaagaggggagatcttctgctgccccggggtgggcaagtaaaagcgttggtgtcctgggaaagtctcacctactcccaggaggaacagaaaatgatgccatatggatccaaactctagcatcagcacagtcccatctcacactaggcatttttttgaaaattattgagtactgagcacgttctgggtatgattcaaaccgtgggttcatttggtgtcctgactgtcagggtgacattccattttccattgcctggaagagctgagccattagaaggtcttcgtattttgcaatctcactcgtattcctgggcactccttcattttcacatctgccacgtacttgactccatgtaatgaagctggtcattcttgctttgtgtagccattccccaagaatcccgagctttttagaaaatcaaagaagatgacgttcccccgcaatttctaccytaaagacctatttctgcatgagttgttcttgggtttttatgtctttattttgccttatttcctacctgcaagttaaatagcaatgaaaagggaaaacatacttttgtttcttgttttttttcttcttcatggatctgggaatttctttctttttaaacatttgttgaaatcaaactaagatgttagaacatggtggtgagcttcatgcctggcactttactatcagcgaactcctcgatgataaggacagaggtgtccatttctgcatttcacacagatattagtggtagatccaaggccagagagcaccttagtgttatttcagaaaggacacgctgacagaggttttcaaagtccttcagctaacatttggcatcctgacttatctctgtatggacaagttatttatctcatctccttgagtgagagccataaatgtctttcactttgaataaggcagttttaatggatttatattctgttaatgtttatgaagtattactctgtgccaagccctctcacataacttatcccttttgatctaaatcccaacatgatatcaggagcttctacatgcgctttgtaagaatggtgtctggtgggagttttagaagccattgtcttagtgttaaatatagcagttcctttcatgcacagacatttcacccacagaaagtctcattttgcccaaaggctaattacagtgtatgtaattagtattaacctgataattttttctatctcttcctcttttgttgctaaaccctcgtggttaacatcagctgcattgctggaatcacctgttggtttgcatccactctgggtggaatgtcttgtctatctgacacccagacctttgtttcatgtgagagtaagccaaccaagaattaggaattctggttcatttttctggctagctgggagtttgccaaaatcatcctctttttttttcaacccttgttaaaaacatttttaaacgtgtgactattctttcctgtcttgtaagaatattctgaacataatttaatttaatgttgcttcgattaagaatctttcattgccccagggtcatcagtctgaatactccttctttttgtatgataaatgctgaaggtgagatagttgtcactgaggcttctattgtcctagtgcactacttagaatatcttttccttttcagtttttttttaactaagtacttgataccagcttttatcttacaaatttcctttcttttctgaacaaacagaagaaaaatcaagttcagattagttcagtttttcgtttattgaggtgtatttttgaaatgtgtatttaaagatctgtcatttggagcaatttattttatataacaaaccaaaagggtgggggagtggaagacaagaaaatacctcctttgagaaatagttggttggcctttcttttgtttgttttttgagacagggtctccctctgccatgcagcctggagtgcaagggcaggatcgtggctccctgcacctcctcctcccaggcccaagcagtcctcctgcctcagcctcccaaagtgctgggattatacatgtgagccactgcacgcagcagttggcctttcttaatgaatagtgtagctttgtaattggtctttctgcttttgggactgctagaaatgaatgtatatagtctgtgcattttcatgttcagagacatcattttacatctgtgtgaacaatttggctatcttctctgaaatcagaaactctattaaaggcctgtatgggctttggagctggatggatgttcagatcttggaatctgaggcctccttgattataaattgcaatgataatgcttaccttgttggattgctttagacaatagatgaaatgatagaaataaaatgtttagtatactgactggcactcacaaaatgataactgtttttgttactattcattcacttattgaattcattcattcatccatccattcaacatagatttcttgaaaatctactatgtaccagacattggtcataacaagatccatgtgggtcataataagactcacgcgcccgcccttaaggaacttagggtctattgagaaatacattcagttcaacaagcttatattaaatacctactgtaggccaggcactttgcttgttgccatctttatgccacatgatgagtacaaacatctacttaggaagccagaatataccctctggaaataaccaaggactggcccaaggtaattttaaatactttgggaattcgggtcctgggtttgttgttgttgcgttgatgttattttgagagagagtcttgctgtgatgcccaggctggagtgcagtggtgtgatctcggctcactgcaacctctgcctcttgggttcaagtgaatctcctgcctcagccacccaagtagctgggaccacaggcacatgccaccacacccagctaatttttgtactttttgtagagacagggttttgctatgttggtcaggctggtctcaaacccttgacctcaagtgatccacctgccttggcctcccaaagtgccaggattactggcgtgagccactgcacccagccagtcctgtttttttaaacaatattgttggcagagagcagacacactcaaaattacagatgcttaaatgcttcctgaatctctgccagagatataaggagatctcatatacacatctgagaatggattcaacttagaaatggtattgacagtacaggttgacatcaacaacaagtggaagtgatgactataaatttcgtgacagttctttcttctcgaggaatgggtgctyattgtgtcctctccttctggaatgctctactatacctgttgcccttgactgcctattgcctggctgtctcctgtcaattttttcaaattagtctcaattcagatatcacatcctccagaaagccctctctcatctcactattgtaacacttaactatactctactatcactgataattcatgagtctgacttttctactagatcatgagctccttgcttctttctttgtcctcagtttccacatctgtagaagggatttgaagatggctgatactaaagtcttttccaagattgtcattctatgatgtaccagatccagtttgaaaggcacagccaagttgggagatgggaatgggatactttgggatatatattggaattaaatgggagaacaaagacttggagttggtactagaaaacccatgctctctcgccgggtgcagtggctcacgcctgtaataccagcactttgggaggtcgaggcggcagatcacttgaggccagaagttcgagaccagcctggccaacattgcaaaatctcgtctctactaaaaatacaaaaattaggcgggagtggtggttcatgcctgtaaccccagctactcgggaggctaaggcatgagaattgcttgaatacaggaagcagaggttgcagtgagcccatatcatgccactgctccccagcctaggtgacagagtgagattcagtctcaaaagaaacaacccaaacaaacaaccgcatgctctctcaaagtctcaggcatactatgctaatgtcaggtatttagcatacaaatgagcacatattcaagaaaccagggcacagcagaaagtacactggctctagagtcagatgggcctagccactattttctagacaagaaagctacttctccctctgggccgtaatgggccttaatttcccctttagtaaaacagatatcaaaatacctgcttcagagggttgtaaagattatgtaagtaatgatataagtgaagtgcttggcccataatgcgtgctcaaaaaatatttgctattatttttattttctcagttagaaataagtataaactgaaacccactatgagcattgagtctaaaataaatataatttagaacctttaaagggatcttatgggtcagtcttacctactgctctagcatcctcagacaaatagtaggtctggcttctgtttgcacatgtctaggcatggggctctcgctacctcacaaggcagcccaccccttaaaaaagcattattagaaagttatccttttataaaggcaaaaatctgttccctaattttcttccactgcctgactctcattctctccttcagggccccacatagcaagtctacccttattttcccatcatgacctttgaaaatattagaagggactttgaggtcaggcacagtggcacatgccagtgctttgggaagcctaggtggaaggattgcttgaggccaggagttcaagaccagtctgggcaacacagcaatacaatataaaaaataaaagaaagggctttggatacctctagagtcttctctccttcaaactaaatgcccacaggtctttcacatgtgtcttatgggatcgggttccgcttaccaacttcctatggacatgggtaaggctctggtaaaaaaaagattttgctgcttttcccggtccttttatgtttggtatttgggagactgaaggtagttaagagaatgtaaatatccatgtgaatagataatattcattagtttacccaacaaacatttactggatatccaataatgtcatgggccctttgttagttcctggggaaagagaaatgaataaagcagcatcttgttcccatgttgctcccagtctagcggggaacagagacacattaccagacagttttcaaaggatgtgtcagtgagaatgttcgcctgatctgcaagactgaggggagggggccactgtagttttttcatacatgtcttattcagcagcatggtaattcagattgaagaaactaagggtgcccctttcctcttttcagtcatttgacaagcgtgatgatggattgccctcacattcacttgtgccactgctccaacatgccaagcacgttcctgcttcagggcctttgcacatgagattccttctccctggaatgcccttttctctaacagaagtgactggctaccacccttcaatcaccccagccctttccctcagatctctgctctaacatcatgttagcagtgaggccttacctgaccatctgtattagtgagggttctctagaaggacaagaactaacaggagatatatatatatatagatatagatatagatacacacacacacacactcacatatatatgtgtgtgtatacatgtatatactatgcatatatacgtatatacatatacctatatgtatatatagtatatatgcatatacacacatacacgtatatatgtatacatatatacgtgtatgtatacgtatacatatatatgcataaatatatgtatataggtatatatatgtgtgtatatatgtatatgtgtgcatatacatatatacacacatatacatatatacttatatatgtatatacatgtatatgtgtgtatatatacatatatgtgtatatgtgtgtatatgtgtgtatatatgtgtatatatatgtgtatatgtgtgtgtgtatatatatatgtgtgtgtgtatatatatataaaggggagtttattaagtattaacatacacaatcacaaggtcccgcaatcggttgtctgcaagctgaggagcaaggagagccagttcgagttcccaaacagaagaacttggagtccgatgttcaagggcaggaagcatccagcacaggagaaagatgtaggctgggaggctaggccagtctctccttttcacgtttttctgcctgctttatattctaaggcagctgattagatcgtgcccactagattaagggtggatctgcctttgttaatctcttttggcaacaccctcacagacacgcccaggatcaatactttgtagccttcaatccaatcaagttgacactcagtattaaccatcacaggtccaccccttgtcagcttgaacccatacacatctcttgaggttataaataatcttcaaataaaggtagtaataagctcatgattacacctaacataatacaactatccttcaaacaaccagaaacgcacccatccccaacccaaataccattatactgagttaacaatacttaaatgctgatatgaagtcaataaatcttatgtcacatgataaaggaaaaggaaataaaataaagacattttcttagtacaagtgtatacatgcacaaacatgtctttagcaaaagaaggaggaaatacccatgacaattacagtccctgtttctgtacccatttgtattccctttgccttcagcaagcacctcagcaggtcatggtttttttcctggtggaatgacccaaaccttcattcctgaggtgtctgggccatttgcagtcctgcctggattggactgttgtagcttcccattgaccttaatcacagggcgtggtaatactaagagacaccctaatgaatctcctgtattccatgtatattcttccttacctccattgtggagtagtagactaatttcatcttgatagtctgggtcaatcaccccagccaacactgcaactcccttcttagcctgttgacttaaaggtaggaggagcccaaagtgtccaggcagcaatcttaacttctagtttaatggaattgttattgtgtctcctgttggcagcgttcctccctctggaactaagacctctaggccagcagaacgtggtgttgcaggaacaggaacaaaaattttgctagtggatcactagaggtgatggtgagtggtgccacttccacttccaccccttgattcctggacccatgaatcctggctatgggagaaacagtaccatatattggacactgattcagagcatacacagccttctggagaactttgccccagccctgcaaaatattgtcacctagttggttttgtaattgtgacttcaaaggccattccatcattctatcaatccagctgcttcaggatgatggggaacatggtaatatcagtggaattccatgagcaagagcccactgctgcacttctttagcaataaaatgagtgctttggtcagaggcaatgttgtgtggaataccatgatggtggataaggcattccgtgaatccatggatggtagtctcggcagaakcattgtgtgcaggataggcaaacccatttctggagtaagtgtctattccagtgaggacaaacctctgccctttccgtgatggaagaggtctaatataatcaacctgccaccaggtagccggctaatcaccccgaggaatggtgtcatatcaagggctcgatagtggtctctgctgctggccaattaggcactcagcagtggctgtagccaggtcacccttggtgagtggaagtccatgttgctgagcctatgcataacctccatccctgccaccgtggccactttgttcatgacaggkgtggctggggaaagaggctgagtggtgtccacataatgggccattctatccacttaattattaaaatcctcctctgctgaagttacccattggtgagcactcacatgggatacaagtatcttcacagtttttgaccactcagagaggtccatccacatacctctccccaaatttctttgtcaccaattttgcaatcatgcttcttccaagtccctgaccatccagccaaaccattggctacagcccatgaatcactatataattgaacatgtggccatttctccttctatgcaaagtgcacacccaggtgcactgctcaaagttctgcctactgggaagattacccttcaccgctgtccttcagggatgtcctagaaaggggctgtagtgcaacagctctccactttcgggtggtgcctgcatagtgtgcagaaccatctttaaaccaggccctagttttctcttcctctgtcaactgatcatagggaactccccatgaggccattggcgcaaactggggaagagaaggcagggtggcaggagtgtccccagcttcatcagggtggcaggagtgtccccagcttcattaggatcctcccacacatccccattccaagtttcagggtcccattttttccaatcaatgccctcactttaacagtagacacctggcgaggctgtgcatgcatctttagttgcgggtcagccactcacatgataagagctcatgtctgtttttccgtaatttcagctctttctctacaagagataagactctcactcaaggcaatctcagtagatttgaagctcagtatctgcttctgaagctgggagacagaatccctgagttcatcattttctttcatcactttgtccactgaacttaggagcaaccaaccagcttcattatgttccttggttctccacatacagtcaaaggtatcatgtatagagtcactaaactccttgccactcacgagcggtgaatcaggagtatcaaattcatttattttgcataacgctctaaacaggtcatgccaaagactgtcaatgttctctgtgctattagaagtagagttcttagcattttggggtctaatcatattaagcagccaactccaaaaatcccaaaactaattaaagaactccatccttaatattctgttcctctagaaccactcctggtaccaaaatctgtattagtcagggttctttagagggatagaactgataggagatatgtatatatatatatatatwcacacacacatatatatatgtatatatatatatataaagaggagtttattaagtgttaacttacatgatcacagggtcccacaacaggttgtctgaaagctgaggagcaaggagagccagtctgagtcaaagaactgaagaacttggagtccgatgttcaagggcaggaagcatccagcatgggaaaaagatgctggatctctgggaggctaggcctgtctttccttttcacatttttctgcctgctttatattcactggcagctgtttagatggtgcccaccagattaagggtggatctgccttccccagcccactgactcaaatgttaatctcttttggcagcaccttcccagacacacccaggagcaatactttgtatccttcagtctaatcaagttgacgctcagtattaactatcatacctatttaaaaaccatcataccttttaaaaatcgcaactccaccccctacactgcctttccttcttctctgctttattttctccctacaactcactatcatctgaaaaacgttatattttatttatgtatttcttgtccatttccctcaaccccaatcagaatgtaaattcagtgatggcagaaaacaagtaggttttgttctcttttatattcctagtgaatggaatatgcctggtacataacacatgctcactaaatatctgtgggataaatgtagtacttagattcagccctcaagttcgaatgtcatcattgtgatagggaaactctatcaaaactctgctttatcttcaaagcccagctcaaatgtctccacctccatgaagccttccctactctactcagtcagaatcaatttcaacttcctctctgttcttatatatagctttaaaagaaaaatacctgttatatgtattatttttgctgggctatatgtattattttttctgggctataattagtttttatacctgtgttttccttctacattataagctccctgaatgcggggacaattttttggtcattttggggtctacccatagtgtctagcatgtggtaggtgctagttatatgtgggatttgtgtgcatgttaaatattatatgctccaatgtaaaagaaaggcatcagaagcagcctctaccttcaagaaggttgcggtttcattgaggaataacattcacatagaccacagtgtcagacagtatcttgtggggcatgagagaagaaggaaaaggaaccaacatctattgagcatctgttttatggcagcgactttacatgcattatcacttttaatcctcctattaaccccttgaaaaaagtaatattagccccatcttataaatgagtttattggagcagaaagacgcaaagtaagaatgtaaattctggggacaaaaagaaatagcatataccaagaaattctgagagctttcccatcagagcttcccttctctgttaccatgagttgggtgtgtagtatccccagaaaccaaggcacagggaggttaatttaacttagccagagtcacacagcagtaaattgaagaactgggattcagacacacgtctgaccaactccaattccctttctttccagtgtttctcatcatactttaaaccaatgcttcttaatccttcatgtgcatttgacttacctgaggattttgtggaagtacagattttgattcagtaggtctgggatgggacctgaagatctgcatttctcacaagtccctgggtgatgccagtgatgctgatacaggaaccacaccttgagtagcaaggttttaaaccattcttaagctgggcatggtggcctgtaatcccaacactttgagaggccaaggcaggaggaatgcttgagcccaaaagttggagaccargctgagcaacaaaacaagacctgatttcttaataaacaaataaatttagccaggtgtggtggcatgcacctgtaatctcagctaccctggttgctgaggtgggaggatcgcttgagcccaggagtttgaggctgcagcaagctgtgatcatgccaccatactccagcttgcgcaaaagaatgagacaaaacaagcaaacaaacaaaaaaaccccacatacttagtttgaggaaattgtgtgaatgaccaaaagaaaataaatcctctgactagttggctgtagtaacactgggcttgcaggaaataagccaagactcattgtaagcctctcagaggtgggatgggagggaacaatcataggtgctccagaaccccaagggatccccagtcagtgtgttaagaaggagaagagacccccagtgcaagtgaatgtatccccttgagtaactgcctgatgccagacactctgctggacacttaaacttgggccagtccctgtagagagaaagtgtgaactgagatatccaacagactggagttcattcaaatcctagcctcagagcctacttgctggttgacttcagacagattatttaacatttctcaagcctcactttccttatctgcacagtaggcctgatgatacccatttcacacagaattaaatgaggtaacattaataagccacttagcrcagtgcctggcacaaagtaggcactgaataaattgtagctgctattagtccccatgttaatataatcttcacagtgatactttgattgtgagaattaagggattatctctgttttttccagataagagagcatactgataaagcttaaatgacttaaccaaggttatacagcaagtagttttgaaccacacacacattgatacatgcagtaacaaccattcatctgaccctttcttgggtgtgtttgggtagatttaagcctgctgaaagcaagaaagacctctcagaatgggcagtgaaggagtcccaggatatggagttggctgcaattaacctagtatgtggattaytgccatgcaggtaattttgaggtgactggggattttatcatgcactttcagaacaggatttcagcctgaactaggggttctaacttccataaaaattccttactcaactcagaagttttcaacagcagctacccatctggctgcctcctcaggggctttgtagatgaggggagtaactgttcggtttctggagaatgatggtttttaaaaagcgaaagagcaaggtgtgcagattggcagtgcagaaatgctgaggttctttctggccagcttctctactgcagccatcaaccataaggatgtcaggatcagaataatctccaggatcctaaaggcaaggaaaagctacgtctatccagaatggctgggaaaataaggggttataaccagctatgctctcaacactttctagagattaaatataacaaaaatgcttaacacaaactactggagataatttactctttyacagcagattcmaaaagcctctgatacatttcagggtctcagaatcattgttattataataacattttagttcaaatggagtaactagttgtggcagagagtacaggatttgaagtcaaatgatctagatcggaagataacaatctacagctcatgggccaaattgggccactactgcctgtttttctagaaaaagttctattggaacacagctacactcatttgtttacatactgtctatggctgctacacaatggcagagttgtcagggaccctaagacctaccaagcctaaactacttactgtcttgccctatacataaaaaagttttctaacccctgatccagactatgatctagctctgtgatcttaggcaaatcaccattttctctgaacttcaatatccacatctataaaatgataattatctctcaaacagggttgttgagagaatcaaatgcatagaaggatgggaaagcattttgtaaactcagaatctctgtggaaaggtggataagggtgatttttgttgttcatctgatctgtgccagaggagaacctacccaggacatttcttgtttgtgttttgttttccagcccccggagtcagtttattgttgtgtcctctctttctcacaaatgcaaaattaattccctgggtaccccctcttttccccctcttcccccaaacttaccaaacattctggttatatgctttcagtaatggaggactggtacaaatgcatacatccattctttcatttatcaagcatttgttgatgacttactatgtgcaaggatagaaacttttatgagctagttattatgggaagatgtgttttgtttctaaggggaaaagttggatatacaaattattataacagaataaagatgttgccatgtcatagtaggaggagacattgtgtatttgtgtgtgtgcctatgtgcctatgctttataaaaacagaaatattgaagttcagatttaagagcagcttgttaaaaacaaaaacctgtttaattcaaaatactctgaagtgctttaaagtgtagccattatgtatagcagttttctcttggaaagtacattctgaattataagtttccatctcaaactgccaagaatgcatttcctgcccatgcatgataactggtgaccattcacacatgcctgctggacaggattattagggactggtcacagtaagggttgtaggtcacctgggcaccaaggggccaaatgctcactatagtttctaaattttggaggcagtcttaatttcatatctcattttttaataaagaggattcaataaaygtaactttgatgatttcctttttatttgttcaacttcccatcaaaatagactcataaattgggaacaaaaatacagcttgttttaattttctgttctgaaaatactgttgccatccctatgttctcaaatcttgctactgctgataaagggagaagatgtagccatttggaaaaaaaaagaaagagtaataaaaagatattatttctggaatacagatacagatacactagctctgggctccagactggatccctcaggccctcccagcatagcatttctcttggtccccatagaaaaagtgttgctattttttgtgaatgcgtttcatctatttttttctaggtacacttagcatacagaactgcaaatataaaacccatcaccaatatatggccaccaaaattaaaacataaaatttttcctcattttactctcccttactactgaaatagtttctaaaagaagtaaagcttgggtttttttattttctacatagagatttaatcctctacaggacatgttaaaagagaatgcttagatccatagagtgctttttattagacttagctgaactcctatgatggtgagaagcatgttaagaaaacctgttcatgaactaggctaaccacaggtagtttcattgtggtaccagactatctcatatctttcaattcacaggcaagtttttctgcctctgtcctcctcttgttctatgcaatgttctgttttagagcttgaagttcattatttcatatcaaggagaatcatcatcatttttcctcttcctttctgaaatgatgttcatctgttttttgtttgtttttttttttttcattttcccaaaagcaccctcattcttgatgttaaatgcagtctctctctaaagttagagcaggtgataacacagttgtgctaattgcagtcaggaactaaggtgatggtggatttgggactgatagaagcaggtggcttgacatgatacatcttgctgggcagggctcctttccctcatttgaccttcagaatcttcctaggacttgaatgtattttccttcctccagaagcaaaggtctaaaacaaaaataaaatatagaatgtgaaaattatgcccattatatttattttagattttcatcaatatatgagtaattttagaaagatggatagtgtgtcaggagcatgtaccactcgtaagcatgattcctccacatatattccatcagtataaataaatcaagtactactccaatgtgagttaggtctaatttttgctgttaagtggtgttttgtttatatttttcataatttattttaattttaygcaaattaaattgggctggatagattgaccatctgaccagtttcctagaacttatgcataaggtttatcattgagataattgttttaaaaatatcctttaaaagcagctcaacttggtgaatgtttttaaaaagtgattataagaatacttttgtacagcaatttttaaagcttctcatatatgcaaggtaaatatgactgagaaatttgcatgatgaaaatgtatttaattaggtgaattatttagctaggtttgatgaggtgacaccaaatttcggataaatgatatttttaaaccaatgaaattggtctctgtatttttgtatttgcaaaatgaaatttctgggaacatatggcagggtcttgtaattcacctccccctgcccccaccacacgtacacacacacacacacacacacacacacacacamgccactcacacaccatacttacacagtgagatggaaagagaagggtcccagcagctggagtgcacccagcattctctccttcctcttcagttactaatcctggctggtgaagggcatgtctggtaaagtttgcccctgtctttcttcttctcaccctgttcttccaaaacaaaggaatatcctaatggaagtgtcattttgggttttccatttggggtcaaatgccattgagctttcttgtgattctctttgctccatcctataacaaagtcacccattttctcatccagaacccaacttgttttcccaggtttcctcctacaaccaacacaaacacagacatttaccagcaaaacagaagctgttggaaagattttttggccgctgaaatgggctcctgtcaccaggacatggcaggctttttgctgtattatctcccagccctggcccccgtactccaaagagagctttatgtaatcagtctttgctgacatgtgacgtcctgtcattttcctccccttcggctctgctgccgcccacaaatcaataacattgcttgggaagttcaggctggttttgcagccaccccaagctctgtgtttcttaaagggtatgtcagaaaatgtaaagtttcctaatgatatttctggctgatgacacatggcagagctgatggactatttataatcagtggcacgattgcaagcacattatttttatttcacttggggggagccctgtcacttgctacctctctttgcagacaagttgatgccatctccacctaaagtagctaaatcctcttttcagagtttatttgcactcttagctttgtgttaggagctcccyagctctttccagtagaaaccccctctcctttttctttattgttctttggctcagggaatgatgagggtaaagaatgatttgtagcaactgctttgaattctagccatgcctgcatccttaactatacacatctccagtctttgctactcaagtcttgctacatccctctgaatgtgggtgtggctggcatgaccgaggcaatagacactgctactgtgtccagcacttgcctcaattttacaggcctgagcagagcatagctgtcttttgttgagcacctactccaatctagacaatgtacttggtaggcattttatacacaatctctcactctctcaaacctacctgaggtaagtgctgttatctccagaacagagattggaggtgggagggggagagagattaaattacttccttacaaagtcgcacagctgatagggaaagctctaggactccagtttaagtctcttctgacaaaccacacctgttctctttccgctaccatgtcctgcctcttcctgattatgtggacacttgtgtatctcttgtgtggctgtgcaggggcacttacccagttttagcttgcacagctcctaaagtttaatagccaatgagagtgagagttggaggaattggaaacctctcaatctgggggtaaaccctggtgtaagaggaactgtataccaaaggagagttttgactcactgcagtgggaagtgttgcctctataaagatactgagcatgctctctctctctctctttctctctgtctgtctctctctccctttctctctctctttttaatatttccacaggacagagtttagggtatggatttgttaactatattgatccaaaggatgcagagaaagccatcaacactttaaatggactcagactccagaccaaaaccataaaggtaagaggtgatgtgctggctcctgattcaggaggctctggttaaatttcattctgttgatctggtaaatccaggctatgtgggggctggaagcagtgttcttgatttattcaaagaacatttaccatccactatactaaatgggagacacagagtgttacagaagagtgaggtgagggttgagtagagggaagggaccacaagctgtgagacctccaattaagagggcagatgggatatttgggattcaagaccccacaaagagggcctgtgagcctgagtctgcaaagatggccagagctgagccaagggaaaaggctgaggccaggaagctgttccaggcagaggaaacagcacatgcaaagctgtgaaaatgtaagacgttgtgagcagggacagcatataaatagtgtggcctaagtttggatgggaaggtgaaaagatgaggatgggaggtggcagggccaaatcaggaggctttgtgtgccaggctgcagcttggctttacctaagggtggttaggaccctcctaatcgagactcgaaaagggagcatcagttataaataaacgcaccagtgtaatagggatgggtactataataaaattgatgagaacatagtatgggaatgacagaaaaagtaacatttcagcaatctgaaaataattaggtgggtagataatatctcaggaagggttgttttaagtcaaaaaagaaaaacagtaacccagagcctgctcctctagaaggaggtttaagtttctgtcactggatagtcatactctgggtccagacttcacctrtgggatccttcaggaggtagtgctgtttgccttgggggattcccttgggcagccggtggtggtctagtggatggagcctgcctcctcctcggccttccttccctttcttcccctacctccaggcagcgtcctgcttaggggcagctgccagccaattaatgagtccccatctttcatagcctattaaactgcagggaagtgtctcctgggcgctcttatcctcacgacagcaggtctgacgcaaagtaggacaaaagagaaacctctcccagaatggaaatctatagatggcaccagctctcagcatctgaaaacacaaaaccagaactttttagtccaacaaagctacttttccaacatccagcctgatagaggagactactggtataagataatcttagctggaaggtaatcaaaacaaaaacaaagcaaaacctttctctttttagaatatgtgattatctttctttcttttttaagcagctttacttttgcaattgagtttagcttatttctaaagatgattgctttccctgatctcatacagcctgatacacaaagatcccaaaatggacctgattcaggctcctcagtctaggcttagaatcatttcctatgagttctctaatgaggaaataatcaagagttgtttaattatggggtagtcctctgagaggcaggaggattaatttctttcaaagtaaaaacatacctattttcatgctttaagtaaagacggatgctcatgtcacctgactctttgatgaggccacactagactgagagctgtatttgtaggtttgattgattttctgtgctatccagttcagcattagaatgtcagatgtctactcttcccttgacagacaccctgaccttgaactgaaaaaggtacttttctttacagttttcttgaaaccccaactcttctccaggggcttaggatcaaataatcaactttccattttgcttttttttttttaagtattccataaggccactgtggttccccaaagactgagtagacctggcttttctggtctcagatgtaccccctagcccatcatgccatcagatgctttatctaagtggatcttagagacaaggatcattgattattttctttctgtaaagagtcagtctgcctccttccgttatctatattcctttccccaccccctcacccaccctgtatcaaaacgctgccaacacatttgcacccagcggtaatgtgggcttctgagacactgtaggattcaaaatgcacgatgccatggctgaatcaataatttccattctcctctacaaatgaaaatttaatgtgcaaacctggggacttcagccctttcattaaagcagtttatttgctgtactaaaaattaagtttgagtgataggttcctttattaacttttcttcccttttctaaagggacacaatgtttaaggtaaaaatcatattaaaggaaagaaaaaagcaaaccccttttgtatgctgtttaatagtctcatcwtttattaatttttttaaattgcttttttgtctttcaggccactgtttacctctgcttcagtttgctttgataagtgacatgagatctatctctttgctctgactcccatgaaggaatagttaacttgcctatctggaaaaaaaccaagtatcttctttggaagcgtacattacagaggtctcaggaccatctagtacatgtttgtgaactttggtcaaatttccccctccttttcaaatttctggagtgcaaaacactctactttaaatgttatgcacaaagtaggttcaggcaaatcaatagttaattccaaagctgtgaaggttaatgattaacagctggattcagggaaggttctggaaagctctaaggcatcggtggagactgtagtgagctgtaaagaagacagctattctgctgctgctgctaactgtttaaacccagattgttgccagatctaccagttgtccaatacacatgaaaatctagatttttttcctgccaatctcccaatttttaaaagctagaaaataactcaaagaattttaagaattatgtaggtgggccaaacagaacttaatagttgaccttttgacaggcagtttgcaaaccaccccccaacccacccccaccaaaaaaaaaatgaactcaaatttaaatatgaaaacatcgttttgccaattggtagtgaatggctcattacaggtccactacaggctgagcatcccaaattggaaaatctgaaacccaaaatgctccaaaatttgaaactttttgagcacctacatgacactcaaaggaaatgctcattggtgcattttagatttcaagtttttggattaaggatgttgaatcagtataatgcaaatattccaaaatctaaaatttgtggtcccatttctgataagggatactcaacctgtactaggaggtacccacaaatgatggttcccagtcaacaaatatccatttcccttttattaggggcagtgttacatgactctgtgtgaatactgacagcattcagagagcaatctgacctctgttctccagaagcatgcaatctaggcatcggcacagcaccaaagcagagaaagagcatgatgtgtaattaagcttccaatgcatagtgtggatggtgactccaggggaattgttctttgggttataacttctttagtgggagaaagttcccaccacacatcttggagatcaggctcagagacactaagtgacttgtccaaagccatacaacaggccagcagtggagctcaagttagcttcaaaagggcctctgaaggattctgccagaagaggagctgcttaatatgttagcatgagcttgaaataataataataaagattaatagtaatgctaatttatagtgagtattcactctgtatccaatactattataacccttttacatgcttratatcatttcatctttgaaatatccctggagctaggtgctttacacacatcaactctaattcttaaaatagccctgtcaggaggtactattacctcctttatacaggtgaggaaactgaggcccaaggaggcttagagacacacccaggatgacacaattgataagcaagacttggagtaagaaaaaatgttctaaaaataactctctggcagtaggtcgtaagtgttggaatgtcacactgcctgcttgctcagcaacacgtgcattctgtgagggtgtgtgggtgtgtatttggctctgtgcacacatgggttatactctctggcatgggaaggagaataaaaagcaaacaaatgaattgtgtgtctcctccaggttctttagtaaacagacatggctcagggcttctgcyatcaacctagggacagacctgacttcatttcttcttgggtccctgctttccaggctctgtgctaggtcctcggatttaggtgaatcagaaatgacagtgccctagagattcttccatccatgtgagtcagagagctatggagtatggaccatgggcttacattcactagcctgccagagcagcctggaaccccacttaggaaactgggtcattgttcagtgtttcagccctgagcccagcccagtggagatgacttgcctcatgtaggagtttgggatgctatttgtttagctttgtttttggtttgtgtgtatgtgtgtgtttgttttgttttgttttgttttgtttttttagacagagtttcactcttgttgcccaggctggaacgcaatggtgcgatctgggctcacagcaacctctgcctcctgggttcaagcaattctcctgcctcagcctctggggtagctgggattacaggcatgcactaccacgcccggctaattttgtatttttagtagagacagggtttctccgtgttggtcagtctggttgcgaactcctgacctcaggtgatccacccgcctcagcctcccaaagtgctgggattacaggcgtgagccaccgcgcccggctagctttgtttttaaaagtcgtctccaatagggatcattttagactctgcaaatggctgtggattctgaaaaattattcctggtactccttgaccccacacctgatgcctgtcccaggcctgaccttctgttgggctccaaaagaacagcttctgaatttacattgtaattttatccttttactaagaactgcttcagtgaagttgcatttggtccagctctgtcacattaatcaggaacaaagaaaattagtaccttcaaaagagaaatacgtttaccaaagttttggattgatgttcaaattacattgagaaccttcagtaaaaagtgatccaaaatggaatgtgagggtttggtatcacacccactaaacctttcrgagtgttgggacacctgtttgcgttttgacctaaatgtcaggagtaggattaaacaagcgttcactgctggctctgcctccagaagctcctgtctcatgggggacacagacatgcaaaggaccaactctaaagcagtgggacagggcagtcatggggctgcagaggtttctgtttgatattggggttggggagatagggagctgtgcaaggtttgagtgagcaaaagatctgatcaaagtaaagttccaagaaagttcatctgtcaacgacgtgccacatagaatgtttgacagatgaaaccagagcttgcaggctgctgtggtaggtttttgtcagccttagacattggttttcatcagctctattaggagccttatccactcatttttaaagcaaaacatgcttctttgtaaataatttggtatgtacagaatcatatcrtgaaggcaatatcagccattcctaagccaacagtgttaacatttttatatatttatatatttccatccttttttttttttaaattaagacagggtctcgcttgggagtgcagtggtgcaattccagctcaccataacctccacctcccgggatcaagcaattctcctgcctcagcctcccgagtagctgggattacaggcacctgccaccacgcccggctgatttttgtatttttagtagagacagggtttcatcatgttggccaggctggtctcaaactcctgacctcaagtgatctgcccaccttggcctcccaaagtgctgggattacgggtgtgagccactgcgcccggccgatttccatcctttttttattgtattatatgtgcacaaatgacttagtgacttacctttttctaataattatattaagctattacccaaaggattaaaatatgattttaaatgaaatatttccagaggacaggtattgtgagtgattgcagcactggatctgggatgaaggggtaaaagagctgctcctgccactctgagcaaatctatgagagttagcactcaggcaggcagccggtgagagaataagaaagacacttagccatgaggcagtggcccaattctggagggagcaggagtagagaaggggaaggtgtgtgagggaaggcttttcagaaggaaacaccttccttctctgggaaggagagtgagctccttcatttccacctcttcctgttgtgatgctgcttaaccacttctccattttcgctttattcttctaataccactaacagtgcctccgggggtctttccacacttgagctttgcaggttccagtttgcccctcccacttctttctcttgccaggggtcgtcagggagctgcgcctccccctctcctccctgcatccacctgccttgctaagggcctccattccgctgaggcatcttttctttgcattcggcataagcaattatttctcctatcactgctcttaatgcttcctggagagttagcagatcattttttgctgatggatatcaccccacacagaaatgatggactgcctccctcagtcttgttaatagtaaaaaggcattttctctcctcctccattaccgctagtcacaacctgggcgagaatgcttctctgccaaggtcagcaggggcggctggatcactgaatccccagggagccaagagagagcaygtggcaatgccagcagaaaccagagacacgtttaccccagttgtgctagcagccctctcttgtgggagattttatttggctgctctgcttcccagtgccctgttcacttcctttgagtgaataatttcaaatacaaggataggagttggagaaatggaaatacaattcccctcttctctctgctcagtgaaggtgatacgttcccagtatcttgaagttcattcatagtgtcctgtgtccacatctaaaaaggaaattagaccggtatgggttgggaaggcacaggttttcagaagtacatggaatggggtctgggggctttagctgtcttcaagtgtaaaagaagccaacaatgtgatgtgagctgcttcaaaaaaaaaaaaaaaaatcagcacaactttagttgtgttgggagaattatggactccatatcacagaaaatagtggtcctttcttgtccactctggtcagcccatcctagtgtcttatgtcccattctcrgcttcatattttaaaagattgtctaaaggtgaatgacaaagatgggaaagaagtctctgcacccacccacagattcacctcacaatggttgcttttctattctctaggaaagaaaattctgcagtgaccctgaggcattagtttgatcctatatttcaagaatctgggaagagaacctgtgtagctatcagagtagaatgtttgccttgggtggtaatgaggctccgatcatcggaagcattcagatgaactcataagggatgatgtagacaggatttcagtcccacagtggagtctgactaaatgatcctaaaggtcccttctagctctaagatgctataattttgtgttatttctgattgtagagctgctctgtccagcatagtagccactagcaatatatggctatttatatttgaatttaaattaattaaaatttaataaaattcaaagttcagtttcttagtcacactaggcatgtttgaagtgctcagtagccacttgtagctaatggctacctatattagacagcacagatagagaacattttcctgatcccagaaaattctgtgggacagtgctggcctaaaacatcagtggccctgcggattaaagactcatttctccatggtgctcctgcagcctctgggcaggatggctggtctgtcagtgatcatagagcaccacactcctcttccttctccccttttgtccattcaaaagagctctgagttcagatggaaagtcaagttccagctctgtcaaaaactgctaaggatgaccttgggcaacttactttacttctttggactggtttcctcatctgcaaaatgattttttccagttccaacagtataactaacaaattatagtgtgatctttctggcttggtaacctttcagggaaagtaacagtttgtgccaagcacacggcttttatttcactgtctggattagtgtgccatagtggaaacatcccagaacatggaattatatcccagtttgtctcttagttcagctgtgtgaccttggataagtacttgatctcactgagccagagtttgtcatctggaaaatggaactaatgatatcttacttgtagggaatcgtagcttacagtggatgctcaagaaatgctccccaggatgaagatgatggtgaatggtgctatccctaaagtgaacattacatgaggagagggggggacttttttccatctacatgtttcagtgatgagtaagggagtaaagaatgagtctgaattttactaagattcgggcaacatatataaaaagctttgtataggggaaagtattatgaagcttccagctggccacagtaatcgtatcagtcttttataaagcaggagccaggagttgcagtctagtgaagagactgaatctggggccctgagcccaagaccagatattccactaaccaggccatgagacctttacacagctctcccttctgaaggccactagatagacagagagaacttagtacgtactaagtatgcctctttgataatttgatagatattttaaaagaagttgcaagacacatgaatctatcgtcacatcttttctattctttaaaagaaatacttgtctggcctactaggtgccagacacccttatgatattcgtagataccctttaactgcatgattctttctggcttcttcatcacatcagagtcagctcttagaaaagaagctaaaatccgcggcataaagtatatgatacatttcatttcacttgagagagcatttttttttgagctcttgccctgataaagctttgagactaggtgccacaggggtctatggagatcaccagaatgctcagactcatagggcaggtaaggtgttatcacacttgtagtgcctgggatctgggatcaggatgcctgtagtgggaggtagggtaagtgtaactattgccactgaaatatactgctgtgtatcttctgtggagtcaaaggagaggagagtcatttgtgcctgggactcgtggaggaggtggcattcagtatgggcttagaaagatgggcaggagtttattctgccatgatggtgaacaaacagcaaaacaaagacatagaaatagaaattttckggacatattcagaaaactgtgacatgtttttgtctgaactggagcatagggtgcatgaaggggttggcaggagatgagaggttgggccagattccagagggctttgaatgcccaggtaaggggtttagactcccatcacaaaatggcacaatcggaactcattagaaccatttccatgaagtttcacctctgataaaagaatagcacgtatcaggtggcaggtaggggaagtgtaaagagtggtgctacataagcagatgcctgtcctgcctgtgaacaggcctacagccacaggcacagaggtaaactgatcctcacaatcaaagctgcggtttccaggaaccagttggcttctttcttctgtccctgctcctagaggtgggattgtaggtccttgagaggatttgttcctagaaggccctggcagcatcagaatctgttccctgattccattctcctcatctccccagggacttgtctgctctggggagtttgtatgcactcagagaaaagggtgttacaacagattggggaaaatctgcagcctgatcttctgaaatgattggtttgtgtgtgtgtgtctcctctgctagactaatagtcctacatgtcagggactgttgtattcatctctacacccttggtgtctagcataaggcctgattatacagcaagtgtatcaaagccattgtttattgagcatttactgtgtgccaggcattgtgcctagaagtcttaaatgcattttcttgtttaaccctcaaacagctctgtaacagagcttctaaactatgtattcaagtgatgcagctcagaaaggttaagtgactcaccccatagtcacacagctaataacggtcaggtttcaagtccacatctctccaaccccaaagcacttgctcttaattgctgcctccttttcattctagagcaggtgctcactttcagttaaagtaacataaacaagaacttctttggagtgatttgtctcaaaatatagttacccaatactctaactagcacctatcaatgagacccataggataaggggtggtaaggacagaaaagatggccctggggtgtgaagctagaataataatagaagaatggaagctacaggggagacagatgtgaactcagtagaaggaaaaacttttcaacaattaatgaggctgggcatggtggctctcatctgtaatcccagcactttgagaggctgagacgagcagatcatctgaggtcaggagttcgagaccaacctggccaacatagtgaaatcccttctctactaaaaatataaaattagctgggcatggtggcgcatgcctgtaatcacagctacttgggaggctgaggcaagagaattgcttgaactcaggaggcagaggttgcagtgagccaagatggtgccactgcactccagcctgggcaacagagtaagacttggtctcaaaaaaaaaaattaatcatggccagcaatagtgtaggatgcctcatgaggtggtgagcttcctgtccttggaaatgtatacattgaatggtcggctgtcttggatcatgccatgaacttttggggccacttccagcaccaaatttctgtgaagcagatttcaggaatataactttctgctgagttccccattgccactgtatgtcacctttatgtgacacttactatgtctccacttactatgaaccacagttatagaaatttgcagttttgtgaacagaatgcctggctcatgaaaaaaatccagtcaatgatagaggccacgtcattactctaatccacaggggcccaacaaatggcgttgctgttttccacatccaagttctaaaccaattgagaagtaagacaaaagagaaaagtgtatggaatcctaaggtcatctttattgccaattaaggcctggatgggttgcatggacacagtgggctccataacactgaactttacactttgacagactgacacaccctgtcacaagtgctctagaccccacaggccgagagcagagcctgcccccataagactgagagcctggaacagaatgtgtgcttccagctggcgtctggctcccagaagggaagaagcaggcagcatttgagcctcacatgcccatttcttttattgaagcctccattcagaggagtcacttcttttccctggggaagagtggatgaagggatagcaataggcctggtctgttgctgcagggggttctctccacatggaaggaaacactgggagtgggaaatgagtatctccctgttggaagcagccctctgtattgcatgcttcatttgtttactttcctttccagactgggattcgtgaagcagagacattcccaacacccatcccagggcctggcacatagtagatgtttaggaaggggaggaatgaatgaactcccatcttctaatgccagtgtttttctaaaggagcaattttctggggctaaaaaggatgccttttccctctcattttatcctcctcattgcacccaacatgcctttatcgtgttttccatgtcctctcccttttctgtattatggaggacagacaaggagtgaggtattgctggatgattcagggaacattcttcctcaggtcatgctgttcttcccaccctgcccaggccaagccctgtgtatgaacaggtaaagggagttgtgggtgctrcatgggaagaggcagccctcagccctcgtcctgatgccccatctgtgatgaatgacaacgcctgctttacccaccttggtgagacttgctgagagcagaattgggaagtcactttggaaagtggaaagtactttgtcggcataaagcagtgggatctgtggaaatgtgttagaggacattcatgtcagtaaagtggtaaaagatggtccagaccccaccagggtggcagaggagggcagtgcctctacaggcattccctggtagtgttccacatgttttttttgtttgttttttgggggtttttttccggtgaaattggagggtatgtcccaatgggagctagattcccaggctggcccacaaaagcctgtatgactcatcacataataatatgtgtaagtatctactaagttctaggtatgtgctagacaaatatatcaactcagttcttacaataacccatcaaaggataattgaccccctttttacgagcaaagatgttgagacttatcaagatcaaattacttgcctaaggtcatgcagctagtgagtactggagctgacccacagtcagggatcataagcatgatgctatagcatccttctggtggaggatgggaagactgtgagcaccagggatggggagagctgaggagcttggagggacttcagatcttccatagagatcatctgtaaagtcagctgcttacagtcacctggctttgagccacccctacccagagagaggagtggcttcttcactcccagccctttctgagttccagaaggaggtcagtgctggcctagagatgccagtcttgtcttcagagattctggatgaatgaagcaaacaggatcctgactgaggcaaggggggttctccagggcgctggctccagtgttggaagccctgtgactccaggccactggcccagsggcattaatatgccatcaatgctgaccctgaaaattggcaattttttggaaatctttcagcctaaccaagggcctgaccactgtagtcattcagttagaatttaatacatgtatatggaaagttgaaaattttagrtactaggatgaacatttggatattcaatgcaggaagatcttttttctgtcatttttgtttatccatacgccacaggtttcatggacaggaaactgagagaacaatagacttaaggttccatataggtgagaaatactaaacaggaattagacttggtagagaatgattgatgtgctgttcacctttgggatttgttgctgcctttggggatttagggtctgtctctggagatgtgttgcagtaattctccctagctgagattctacctatgttggaatcaacttttggggaaatgrtttttgttgtgtcaccaactttcaagtgccagctcctcttccctggcagggttcaccctgttccctctgtaccctagctctggctgtgcrgaactaatgggagttaaggtcatgactatccattatgcatttattgggtgccaggtactgtgctaagcccttgatcttcatcacctcatttgtcctcgtgacagaggaaggctattatcaggccaccattaccwgactccaccaccacctttctcaccaccagtctcagctcagctgtgtctccttcccggcccttttaacctttgattaatctctccctcctctgtgttttagtcacactcatatgtatccctggcataacacacacatcttgwggcactgtgataattggtctgtatgtttactcatccattcttttgttcaacacattttattgagtgcctcttatgtgttgtctgttgccctctttggacttggagttcctttacagcaagagactatgccttgttcttgctgtgttgccaacacataccactgtacctggctcatagtagatcctcaggaaatatttgctaagagaaggcctctatgtgaggtctagtcctagaacaatcttctttcagtccttccagccccaggcattggaaaatgggaaatatgtcccttagctcttagcttggtggagaaacacagctgggattctgggtgcctgactctcagtggtccaccttactggagttacagttaactccaaagagccaataatatcaacatcatttctcatgagctgtgggtgtttattcattttttcagtaggtgttgaacactttataggtatcaggctatgtgctgggagctagagtcacagagttgaataggacacacacacacacaagacctacaacctaaagagatcatcagcctagatggagaggtggtcagttaaggttgaaacgggttaagtaccatggttcattgagaacactgctggggagatttttaggagaaggtgagattagagaaagctgcctagagaagatgtcatttgatctgagccctgaagargagtaggatttggacttgaggaagtaggtataaaaaaaatgtctgtatgagcaaaggtataaaggtggtaggttgtgttttgagggagcacaaatgtcattcggataattaatttgtcagtaattggcaaggtgaaacaagggtgaccctcattgccatgggcatatcactatgatgtttttatttccttcttccacttcttcctcttactcaaaaaatagttctgctattgacacactttgtcccttaaagaacaggggtgggagaaccttctgtggagtgaagccctgtccagacagtcacatggggttcttagtccttcagcccacactgcaaatgcacacactgggaccccctatataaaggcccctctacatctcagccatgtgctgagaaggagcccacagaggcctcccagcccaccygtgagtttctagaagatggagatactgaaggcagctgcctcactccatcagcaggaggaggccagggaggcagattagtcactcacatcattttatctgttgagtcaacatctatttttaggcatggaacccataaagggacctggcatgtctgtcatggaaagggggagagtgccatggatgagggttctgctcatccttcatcttctttgctagaccyattctctcccctgaaggtcacagaagcagggtccacattactgctggaggtttaggtcttaatgtcaaaggtctggtttaatgtgttcaattccttttgcacacatgcttttgtgtgcacgcacacacacacacacacacacacacacacacacacacacacacacacactctcacccctacagtcttaataggtcttatgaatcagttgtatggattaaatagaacttccaactgaaaaacgctaaggcatataggtctcttcctgtccaacgttgtcagatgtgctctgaaatgactgttttcatcatctattctgagccataaccaccccagaaatagctttagcaggaaagtgcttttgttagactagctgtaaattatatttcaaatgtctgatgttgttttcttaaaaaataaataaataagtaaatgaaagtctaaaattaatgactgctggggtttgctttgcttatgtgtactgctacagatttggcttcttgcagatggaatttcagatctgtttacacttctgtgttagcttttggggggaagaaaagcagttgagagatctgggaggacaaatttacaaagtcgaacttattataaccattggtgaggctctcttctctctctctactgccctttccctccctcctttccatcttgcccccattttatttgttgtggtttttatctgccctgcttcaaagttagaggcgactggtccttgcagatgtgacgacaaggtcacatatccagtttcgcaagcagatgttcattcagccctatttcaccagcactttgtcatttggtgagagcagacctcatgggaacagactggagcaacacaaaggatggaacataaaaaaatcttgcagagaacctgattgcttttatgtattcaggaagaaggggatgggggtagggagggtggcaaggaragaaatgtgcagagcagaatttcatgaggtttttttttttttttctggtttattcaaagattattatgtgytggatacagtaaatcatctatacacccacttccaggaggtaaatcttcagaactccatgtgtgggtagctctgcatttaacagctgccatacagtagctattttgttctgcacttagagacccttatctgtgcatttgttttaagttattgtcaactctcctgttgttcctctattgttgttctcctggttctcattactattacaagggtagctaaaaatctgaactactgagtgatttaaactgacaccatgagttgtaacggtagatgaggggctgtcatcttggttgtggactcagcatctactctgagggtgattgcctataatggaattagctcctcttgccttttcctaggtctcatatgcccgtccgagctctgcctcaatcagggatgctaacctctatgttagcggccttcccaaaaccatgacccagaaggaactggagcaacttttctcgcaatacggccgtatcatcacctcacgaatcctggttgatcaagtcacaggttaagtgtttctttgtaatttctttccttgtatatcartgtcatcagccctgttactcataagagcagaaggctgatggctgcttaaagcagatgatatggatcatgaatagacagatttttgacttggaaraaagacttcttatcggtcaactgcccaaatttaaaatgggccatcttgggaggtaggagttctccatcatgggacttgttttagcagcagctaaactacttgccagggttgtaaaaaggattcaggcatcaggctgagagtggaactgtatgaccttcaaagtctgattcagccctcaaccaaataacattacttttgtatgtgaaaagaacctgtatgcatagctgtaactccaattcatagcattatagagttagaaggaattgtcccatttcacacttgaggaaacaggttgaaagtgggggatctgactccccaaagctagttagtagcagtacaaggatctgaaccgaggatctggtactggtgttctttgtccataataaagaaaggcagccaccacctctcagtaagaaatgtcaggtactctgggttgcacttttaatgacaaggtgttttcgcctacctccaatttgattccaatttagaactcaccccctgagaatagtttagcacgtttatcatgtgattcatgagacaaaccttcacagaagtctgctctgccctagacattgtgcagagggaccctggagaccaagaaagaagcaggcactgccccacccttacaggactccagtgtggagtccaaatacttgctagaagctgtcaagtgcccctgagagctcaggagaaggtgtgccatgcctggtgggaattgctaggagggccccattgaggaggcaatgtttgaataggagtttggaggatgtttcagaggtatccagcaaaaaggagggacagagcagtgtaagtggagaggagagcatatcccaaggcatggaatcgaggaagaacagtctattcgaggaggatcaggcagttcagggtggctggtgtgagcctcaatagggaatttggggccagattgccagaggcattgaatgctgtgccaagaagtctggactttatctgggtgcagaatggagccatggaagggtattttgtaggttttgtttgtttwtcattttagaatgggagtcagtgaagaataggtactatgcacaaggtacaaaattcaaaaagtacaaaagagatacagaagatgtttttaaagcatatcatgtggtcagagttcacttttcaaatagattgcacactagctacatgtggaggacacatgagaagactagaaactggacagtgagtgatcagttatagtaacttttgggaggtgatgatggggcagagcagtgrtagaggactagaggggccagatgcaagagagccctgtgttctstggctgggaggcatcagtccagagccatgatagcaggaatgcaggtaaacgtgttttgattggtgagagagatcagggagctgggctcagccctggcaccacaggtgggcttaytcctcacacaatatccacaggacccatctcttcccaaagatgtttaccagtttggtgtgttcactctttacaaaggctctttctctttccccaggagtgtccagaggggtgggattcatccgctttgataagaggattgaggcagaagaagccatcaaagggctgaatggccagaagcccagcggtgctacggaaccgattactgtgaagtttgccaacaaccccagccagaagtccagccaggccctgctctcccagctctaccagtccccyaaccggcgctacccaggtccacttcaccaccaggctcagaggttcaggtaggcatgcccaaagaggaagaagccctgctacaggggttcatagctgggcaagagccagggaagcccatggtcctgacaaatggggcaagggtaaaagcttccacccccaggaatcactgtgcaaaactccccccgagcctcagtttccattcctgtaaaatgagacagttggagcagatgcccttctaagccctcttccaatttactactgtgactgtataaacttyagattctttggtagaaacaaaatgtctgtatttaaccaaacatgaaggttcagtttcaacaagagttaatcacagatcagtgaccacattcagcagattagacttaaggctggacagtggcttttaataaattcaaaaaatagaccataaggcagatccttgccagaaggagttgtttttcctatcttcttttccctcggcaggtaactctgttgagttcaggggagggggaagtgcctttggtgttaaccttattatgttaagtcagtagattctgggaagatagggaggaagatcctgtccaagcctgattagtgtttccttcaagtacccaacccccaggaagctcctggggcaggggggcattgcccttctcctgggacttttctaaaagacaggtttctctccatgaaggcagtatgaccttgactggtctctattatacaagagataaaaatatgtttgacttacccatgataaattctaaacaattactttattccacaccacagcccagcttccctttgatgaaaatgtttttctctttgagaaacttcacatgggaaatagtaggtccttctatctaggatagtatgctccatctggctacatgaggagaaaaatcatcctctttcgtgtcctcctatgccctgtgaatttgaaatggttaatgatttcatgaagagtccaagtcatctaatttttattttgcttgagagcacatgcagtatttatgtaaaaagcctctccagcagacttctaatggtggaaactatcgttactactgccctatggtgtgaatagcttgtccccaagtaaggtagtgaatgtgaggaagattatagcgtaatggcagtttgctgggaggtgctatcaggcagtaaacagtaagccactttttaaaaatcttaacctgcaaactccccctgcctcccaaaaatgtgtgtagtaagatgattyagttaatgtagcaaggctaacagaaaagatctgttctgatacatattgtgtgcctgtgtattgttaatctggaacagagacctttatttacaagtttaattatagtaaaaaggtgaacaatttaagaagcccccgctttgaacaatttcactacaatataaaacaaaatccacacaaatgttctgagaggtggggggaatggtattaattcagaccttgaaagaaagggagactcattagacacttgctttaaactctagcaatgacctgaacatgaattacttgcagttagagacagaaaagggggaaactaccggtggatagactcctaagcagtggggaaagttgttgagcttttcttctttgaaaatggagcattcttattaatagttccattgagcgatcttgccatctgtgaggcattaacccagagaccctccttctctttgcaggctggacaatttgcttaatatggcctatggcgtaaagaggtaattaaaactccacagattgccagatgtccatgttggcacagactggggctagaattttttttttttaattcactaactttactttaaaagaaaaaaattcttcctttttcttccaccagcatgtcaaattcttaattttaatttcggacctcagttgattttgtttcttttagggcacacaaaatgtatttgtgtgtttcactttttcttttatttgcaggtgggcttctcctatggttcaggtgccacagctaccaagcccttaataatctggtcctttgaatggctcccctaaggggaaaggctccgactctttgctggctggttttgcaaacttgcagagcaaactgttttgcattagcaatgccaagattcagttaagagggcagattccagcaaatcagaattagaacattttgctaattgtggttgacaatcttatgatttttcagtagaaaaattagattttggactaccagctctggccaaaggataaacaaacacgtggatgactttctaactcctgcccccacttcagtgtgcatttcagagcacatcctgagaatgaagtgtatctgtgtgcacctcaaccaggggtttcttttgttacaggttttaacagttcttataaatcctcccttggttatatgttatgtgtgttttaaacttgctgttcctgtcactgaaaggctttttgtggggttgggggcccagagtcaaggcttttggggctctctgaatgcagattcaaagttttccagacccagtatgaaatctgaatcttggaaagttgggtgtgtgatgtcactgtgtccatgagattcccatatgtgcttctgataagctccactgcactgctagggacatagtgtcttcatcatcttgctcagtagagctgcacactttaattccccttcctacagtcaagggaaagagatgtagtctttaatagtccacatcacacycccagttctttcactggccatccatggtaagtaccctgactctgggaactggtgcatggtagaggaagtaacctgactgcagacttcactatcagaggaccggcctttcaaatctcaatcccagcatcaatgaggataactatgaattatctccacatttccagcacactgtttgcctgttcccagggattttacatctttcctagctctatctcattcctttgctcctctctgatgttagtgaggtagtgctaaatgttgtgaaaagagaaatgcttataaatagataagataggggaagacacagctgtagtaggcctgccaccacctcctccactgccccacccagagtaaacatcactagctgataatagcattctcttttcctattgaacccagatttggatttagaacgcttcctaccaaaatgctgcaattaactgtcaccaactaggatagaggctgtacttgcaatctctttgctggccctgacctttgacttayaataaatacttagctgttttctacctataaacagaaagaggtcagttcaccagggtcaactcacttggttggaggatagaatattaaaaagacaatcttcagaaatgatacaagttacaaatagacatggatttgcacgtctaaggatctacaccatgatattttttggctttttcttgttaattgtttttaaacaagagggaagattgacttagtgaataatagcaaaaatattgtctattgagttgttatatttagcatatattcagtagccatttgattatccaaattctagttagatacagaactattctttaataggactttcaaatctccaagaatatttgcttatttttaaaaacagttgtagctcacactttacaccatgctcttccctagtttttgctttctctccttttcctatctcccccagtaaaaccctggccaaatgaaaagcaagaaactattcagtgtatagcatcaaaaatccgtatataagctcatgcctgtaatcccaccattttgggaggccaaggtgggtggatcacctgaggtcagaagttcaagaccagcctggccaacatggcaaaaccccgtctctactaaaaatacaaaaaaattagtcaggcatggtggtgcgtgcctgtagtctcagctactcaggaggctgaggcaggagaatcacttgaacccgggaggcagaggttacaatgagccaagataacgccactgcactccagcctgggtgacagagtgagactccatctcaaaaaaaaaagaaagaaagaaagaaagaaaaaaaaagaaaaaagtccctatgtaagtttgatatgaaacaaaacattaacaaatattgttctgctataggcactggtaacctaattgtttcatctggtacatccctcacaaattacacaaggatttatttcatcagacagtgaatagaatttaaagggtcattttttcttttcaggattgcacaaaaactgagaagatttctaaacctaatacaaaagcagttgtaatagggcaaataacaattctatgcttttctaatgtatagcgattcaagatatataaatgcacaaaccacttgcagtcttgcttcagtgatacttaggaataaattccagataacatagcataaaggagtaatacatctttattattattgcttgagtttgtgggggaaacccttttgaataaatgctaaatgaaacatgaaccacccatctgtttaatagcaagaaaggcctgttcattgtcacgtatctccatcctcaccaagaaacatttgacaaccgtaggtcaagggagtgcaaaaatggtagacttaagcactttagggccatctcctaatctgcctttaaaaaaaaaaacaatgaaatttcccaagcactggccaaagtgagtcacttattcaaccaataaatatttattgagcattttctatgtgtcactatatctgtgagattcccatatgtgctccactgaataaacaaatagagccacagaatgaatgaaatagaccctttcctccaagagcacattgtctattgttggggtggggtggagtcggggtggggtggagtcaggttggggtgcgctatgagcatatactgtgatagaactgttacagagccttgctctgggagccctgggagtcccttatggtttttagaaattgacctaggtctttctctcagcatgaacatgccctagccagtcaagccattcccatcagaggaaatgacatagacattagtttttacattttggtttttgaaccctgaagactctcctgtaaacactcactcagccctctgccccatgtctgtgtctgtgcatctgtgtgttatccttggtcagactgatgtctggaccagtccccccttctgcttgtycccccaggttctccccaattaccattgatggaatgacaagccttgtgggaatgaacatccctggtcacacaggaactgggtggtgcatctttgtctacaacctgtcccccgattccgatgagagtgtcctctggcagctctttggcccctttggagcagtgaacaacgtaaaggtgattcgtgacttcaacaccaacaagtgcaagggattcggctttgtcaccatgaccaactatgatgaggcggccatggccatcgccagcctcaacgggtaccgcctgggagacagagtgttgcaagtttcctttaaaaccaacaaagcccacaagtcctgaatttcccattcttacttactaaaatatatatagaaatatatacgaacaaaacacacgcgcgcacacacacacatacacgaaagagagagaaacaaacttttcaaggcttatattcaaccatggactttataagccagtgttgcctaagtattaaaacattggattatcctgaggtgtaccaggaaaggattttataatgcttagaaaaaaaraaaaaaaaaaaacaaaaaatacctttgatgcattgaatgttctttcatagctgtcgttgttgaatataatatacatagatagcgatgtgcagggatttttacccagccagctaactttactaccttccttgaaggtggatctttttaagatgaccattcgctcatttgaagaagaaaaacaaaaaacaaaaaaaataataaaaataaaacaatttttacaaagtaatgggattcaaagaaaggaaaaaaagatttttcttttttgtcaaaatatcgatccaatcagattggtaaaaacccccacacaaattaaagaggaataataaaaattgcaaaaataaaaaaaaacttttgcaaatttttttatttttccttctttcttttatatcatgtgaactaaaacagtcttctgttaggggatgggggcaagggggatacctgatgacattaacaatttaataacattaacattgttgccaaagaggtggtctctttgctgaaaatgggtttcaagaaaaatctatttttataaaatataaagaatttttacaagagaatctggatttgagaaaaaaatattttgactggctaatttaggggaaattgacaactttgtcgcgttcatactgcactggtaactttttagagatcaagatgtgtgttttaaactggattcgtagactgttttttgaaggatgggctataaacagatgatcttcatatcttttcatagcatgtaataataattaaaaaacaattattaattactaggggaaaggagtgttcgttctacccagggtaccacagttccccacagtcaaaacccaaaagcaaggagatgagttgaaagacagtttttctttaagtcatcagtatgggatgtcagcagaacaaaaattaaaaagattaattttccttttgatctaaaacttccttagtttgagcagtaggtgctacaaaattatttacatatcttagtatcatagttaaatgtaatgtgtttaggagaggaaaacaaaagatacatttgctttaaattcattaagaaattttcaaattcactttgtagcccatgctgatagaattgggctgtgttggtacatttgaaacactgtttatgttgcttgaaacacttatttatttaatcgccgatgtgatgatgcctatggccgagatcaaatatagctagattggctagactacttatttgtttacttaaactatgggaagaagcatattattgtgtcattctgttgtgtgtgtatgtgtatatacaatataaatatatatatataaagttattttttctttgggttaatttattataagttgtaacacttggctagttttgtttgtatatgtcttaaaatgttttcttatgatatttaagtgacagttaaagaggtatcaaggtaacttgtgtagaactattctttgatatattgtcatgtttgttgtgaatattttttcttactgcacagtagaaaaataaaaacaactgagtctttattttaatgtaactcagattggggaaaacaaaacagagctaagggaacaaaatgactgagggagcactctcccacgtccagtgcactgatcattttagtatgtttgtgctttgtacggttatatatttaaaacgaaaacaaaacaaaaaaatacaagggttcatgctcttccctgggtaatagaaacagttactcgctatgcataatctagttgatagttaaatttgctattgcttttcttgtcttgttatataaaatcttttcaatacaagtttagtcttaatggtaataaaacgttatggttatttataacttgtgcttattttgtgcattttttcccatgctgaacccactaagtgcatgtagacaggactgttgttttcacactgaaaaggcaaactttgtagtagtcgttgtagtggtagacagataacgaataccaaggctgcatcatagactcctcctttaaattttttttctgtttttttttcctcttttcggttttggatataacaccagatttcagttcagagaacactcgttcaacattcagggaaagctttttacgtcacctgctatgaatgaacgtagtttgctggcaaagttttgatgcatttgctaagcattagtgggaaaggcatgccaaaatcttctctataatgtgttcaatcttgggggaaaaaaaaaggaaaaaaaatcttaggaccaggcagttgtatactttagttattaatgaatgacttcatgttaatcttgctagtttagatgatttccaagggaaagtattgtaaatgtttttttttcataatcttgttgtgtttgaattatttgtactttatctgtccagacaataaatgaaagtgtgtagaatggatttgacttcccaaatttttaaatgtgtttatttaaactttttttctgtaccatcttcagatttccccaatatttttatcattaaaccagggaaaagaaaaggcagagtaaaattttattttacagcttagcccagtctcttaaagtcagctcgatattcagaagtcactgttctggttccatgctattaaaagtgtggtggtccccaaccagcagtatcagcatcatctgggagcttgttagaaatgtagaatctgcatttaaccagatccccaggtgaatgaatcactggtactttcaagtttaaggagcactgccctggttcataagccagaacacttggccttacctttggtgttatgatacattagcacctgttattcatttataagaaggcttgtgacttgttcagaggacagggagccaccatttgcagagcacctattatgtaacgggcaggctgtatggtatcctctatattctctcactttatcctcagcaacccgaggagtgtagacaaccttatcctcatttcacagatgacaagactgagactcaataagaatagtaacttgacaccataagcaaatttccagctgggatttgaatccaagtctgattccactgcacagcacctcagcattaaggttgcagaacttgagcattaagaaatattaagaaagcagaccatttgtattgaaagtgacagctaagcaagaaaggtcatctttttattttagcactcatttctgtttaaaagtaggaaatatttggctttcttacctttgaatagaaactcaaaacaaggaattactcataatgtgtctaaagaacatgatttaagctcaacctagggagaaaaatactgcctacattatcatgaagtcacattaaaatatgccctgaactttacagattagctttttagtgatttcctgatacaatcactcactgattatctactgtctttcattttcatttcctcactaactgaaaatttatactctataaaacattgccatccataaactgacacttcatgaaatgcccccactgagccagatgaacaaatagtcagattctcttctatttctaattaacctcttttttattattatattaagttaccacattagttggaataattaaattcagggcaaagaatgagatttaattaaccaagctaaatattaaacttctaagtcaggctaaacctcatatagttgaacttaaaggttcttattatagttttatcttaaagacaagtccctacgtttcttttctggagaaaaaaaaaatggacattcaaaagaacagtttcctacagggataacacagctttacaaccgtgtttgtaggtctaaaaatgttgctgccaaacctatgatagttgccagtcatcaccacccctgctccttaaaggtgccattttagtgtactttaaatggacggctgcattattttggaatatccaaagttagtagaatcttcccagttcataaagttcattcactagcctcctcctacagatctatgcagaaagttttacaaatagatgtaggtatttaaataggtcttgacaatgtccatagaagacattctgcatatactctctcagaaacactttctagcatcagcacaatgtgtctgcctaacatctaataaaaaattcatcttgttgcgaatataagcctgttaccttaaatctccaggcaaacatatatagtttctgtaggtgtttgtggaaaacgtctaacaaatcacaagaatactgagattattacatttctttgaggtcctaggtacattgtattttgcttggttgaaaaattgcatgtcatagaaagctgacggcatttacttagtgttatttttgtcaacgtgataggaggagtgaaaaaaatgtgtttgtgtctaaaaccaccccacatcatcaccatcaacatcaaaactttacttacttctattaccgaagatcaaacactgaccaaatgatggttactgccagaaattttgatcacctggggtcctgtttatcaagatcaatcaacctttgttcatttgtaaataaaacattttaacccccaaagaataacatttaaatgtacgtttgaaactcacaaggtcttgtggcgcccatactctccttgagtcactatttgggtgtagatacttttaaccttgtcaaaatgcagcacacaatttcctttgccataggtaattccggaaactcccagtccttgaaattattttgcccttacttcctgtaggcactatgcatttgttccttaacagacacacacaggcaaacatacaaggcaagtatttgtataattatgaattttttaactttcatctgtgaattcaaaaatgatacctgataagatagcgttaacagcaagagtgtgttttctaaaccaaagagtcattaaaatcttaatttgaggccatcctgcctggatccttccacagccttcatgaaagctcacagaacacagcttctaatatccttgcacccttgactgcctttgttctacctgaagaagagaataataaaaggaaattacattttatttccatgagctgaaatcaagttttaatattgtccagaaatgactcgtaccattcccttatcttattagctttttggcgtattaggtaataagataatttctcatggtacagtatttatgtaagaatcatatttctctctgtgcagatcacttacagaagtgtctgttaacaggagagaatgatacataatcagcacttaagattaaaatagacctgagaacataaaagtgttccttcaattaaaggaatagcgtttttcccgtctcatcctttttgtttctgcaacagaatgaaaactggtttaaaatcacccaaccccaggttaattcccagaaggcttttctatgcgagttcagcttaatctactagtggttcaaatgcaaagtggactcacatgacattccagtatgccatgtaattatttcaaacaattttcggcaaggtccctaaggtttaagaaattgtttctagaaagaccactggcatttattaagtttttcctatggcaggcactctatatgtatatagcgttagtgaggggtatcatcccccttttacattgaacagaaagaaactcagagagattaggtattttgtgaaggtgtgtaagtaccaggtctgtctgatccccaagatccccagttacacaccgtggctccaagtccattatgctagaattagagccaaaataattaccacatggtccacacttcaactaaaggtgagatgagtcctattatgtaggaaataaaggaaattacattcatgtactgtgcctgagtctaaccctctccccaaatctttaatggaaaaacagaccaaatatcaatggtttacaagcaaattaacaaagaataactaaaagtgatagtttttaagcactgttgctctgcagtatttaaaaatgaaattagtttgttaataggtctattttaaccaccacaaatcattgaggtagaaaggagttgaggataggacagacaggtaagaatgttaacaagccaacttaaggaccatcagagctggccccatgggtctccccaagtgatagctcccactatgacacacagatgggtccattgtgtggaccaatagcaccatagtggccactcctttcactatctgtattgcctctgaatcctcagaacaatcctgggaagcatataaagtaatcctcattttacatctaacaaaaacagagaagttaaataccttgcctaaggttacacagcatgttgcagagtgggaatttgcacaaaagtcatccggttccaatacaatgtctttctgctaaaccatattgctggctttcaatgtgacaccatttgttgatcatctgcctaggtgtgaggtatggcagggtgggggwtgaggggaatcagtctaagccttgtctacactagaatccttactctgaacccctgccatatgccagatactgagctaggggcacggcaacaaataaacatgtctagcttcttttttttttttttttttggtatacctgttttgtgcatgaaattgtgcagtgggttatgacagaaaaccaaaaaagcaggaaaggaaatttagagttctattacgaagacaagacctgtggagcaatgatctggccacagagatgtagcacaggtaacttttgtgttggagggagaatttcagattgtgaaaatctgtggggaatgcaaggagtattctgggatccaggaaggaaggagagtttgccctgatggaaagaggactagctttagtgaaaaagttctgggtttgggtccctgggacaaaaatttaatgtctctgaaattcctgatcagagaagggaggattagaagtaaaatatgccaagttcctggcactgactgaagagtagcaggaattaaacaatagccagaaagagttcccagaagaagaaaactttggccaggccctttggcagggagaggtgggtttagtggatgcccctgaatgtaaagaaccaagaaatcctgtttggtcacttcaagtgagggagggaagaaatagtaggaatacacgtgggaataagttgctgggaatctcacttggcctcatggaacttaagctgcttttgaaatacagtaagtccagccacttggcagcaaaagctctgattgccctcagcaaccagaggccctattggtccctcctctggtgtctggccattacagtgactcagccactccatctcattcacccctgagaattagaccgctgggagcatcatggaagagtcacagagacttcccctcagggtaaaggagtggaggccacactaaggagcttaggtgggcagcagtggaaagggagagcacaggaataagaggaaaagggttggtcatgcaggctgaggcaggaaacatctttaggtaag

SEQ ID NO: 12280 - DNA, 85668 bp, Homo sapiens
gggaagcttgtttgagcccagtaggttgagactgcagtgaattgggattgcaccactgcactctagcctgggtggcagagtgagaccctgactcaaaaaaaaattgctgtttaacaccaccggctcacccttaaattctttcctgggcaaagccaagatccttcccagactaagccccagttttggggctcgcctgcctgtctgcatctaaaccacagccctgcacaaaaaccatcacaaccttacacaaaatactactgtgaaaacatctgcccagtaactgcctgtccaaccttggactgatgcttgttattgactaacccttgttactaattcttgtagcaagggataattgttccaaaacaacttactatgtgtaacgattctcacttttcctttaacccccgccccccctgctttttttttcaggtcaggcatagtggttcatgcctgtaatcccaactctttgagtggccaaggcaggcggtcccttgagcccaggagtttgagaccagcctgggtaaaatggtgaaacctcatctctacaaaaaatatgaaaattagccaggtgtggtggcttgtgccagtagtagtcccagctacttgggaggctgaggcaggaggattgattgagcctgggaggttgaggctgcagtgagccatgactgtgcaactgcgctccagcctgggcaacacaatgagaccctgtctcaaaaaaaattaaaaaacaaaaaacaactcttgttttcctttacctcctcatatgcccgtaggttaatatggtaccatattccacattgcaatgcttactcctgaattaattgattatatttggataatctcttttatttagtttgacaacagaactaaggtagaaagaaatcaactataaatataagagtggaaatcaattacatataaaagaaacggaggaaaacaacaaaaccgaaagctagtcctttgaaaagttcaataaaatatataaacatctcattagcctgataaggtacaaaagagggaagacacaaattgccaatatcagtaataggggacatcactaaggatcctataaaccaaaggtcagcaagctttttctgtaaagattcagggagcatgtttggctttgtgggccacacatgatctgtggagcaactacttaactctattgcagtggtaaaggagccataaaaattatgtatttatatttcaaaaacaggctgcaggatgaatttggcttgtggctgtagtttgccgccccatactatagacattaaaaggataataatggaatattctgaaacactttatatgaagacaatcaataccttagatgaaatggacacattctttaaaagactaaaattgttggggctgggcttggtggctcatgcctgtaattccagcactttgggaggctgaggcagggggatcacctgaggttgaaagttagagaccagcctgggcaatatggtgaaaccccgtctctactaaaaatacaaaaattagccgggtatggtggtgcgtacctgtaatcccagctactcaggaggctgaggcacaagaatctcgaacctgggaggtgtaggttgcagtgagctgagattgcaccactgcactccagcctgggtgacagagtaagactctgtctcaaaaaaagaaaaaaaaaagattcaaattgtcaaaaccaatgcaagaagaattagaaagttcaaatagctctatattagggtttctcaacctcagcactgttgatatttaggttggataattgttgtggggaagggctgtcctgtgtattgcagggtactgagcagtatccctggcctctactgactagatgccagaatgaccacccagttgtaacaaccccaaatgtctccagatgttaccacatgtcccccaagggagggataaaatcaccactgccctatatcattaaagcaattgagccaggcacggtggctcatgcctgtaatcccagcactttgggaggctggggcaggcagatcacctgaggtcaggagtttgagaccagcctgaccaatatggagaaaacctcgtctctactcaaaatacaaaattagccggatgtggtggcacatgcccgtaatcccagctgctcgggaggctgaggcaggagaattgcttgaacctgggaggcggaggttgtgatgagccaagatgtgccattgcactccagcctgggcaacaagaaggaaactccgtcacaaaaaaaaaaaaaaaaaaaggccaggcgcagtggctcatgcctgtaatcccagcactttgggaggccgaggcaggcggatcacctgaggtcaggagatcaacaccatcctggctaacatggtgaaaccctgtctctactaaaaaatataaaaaattagccaggcgtggtggtgggcacctgtagtcccagctacttgggaggctgaggcaggagaatggtgtgaacccaggaggtggagcttgcagcgagccgagatggcaccactgcactccagcctgggcgacagagcgagactcctcaaaaaaagaaaaaaaaaaaagaaattgagaagttggttaataggtacaaaaatatggttagagagaaggaataaattctagtatttgatagtaaagtagggaaattataattataaataatttagtgtatattttaaaatatctagaagaattataatgatcccaacacaaagataaatgtttgtgtttgaggtgatggatatcccaatcccttcataattgatcattatacatcatatacatgtatcaaaatatcacatgtactcccaaaatatgtacaattattatatatcaataaaaatcaccagcctgactttgggaggccgaggcgggcggatcacgaggtcaggagatcgagaccatcctggctaacacggtgaaaccccgtctctactaaaaatacaaaaaattagccgggcgaggtggcgggcgcctgtagtcccagctactcgggaggctgaggcaggagaatggcgtgaacccccgggggcggagcctgcagtgagccgagattgcgccactgcactccagcctgggcgacagcgagactccgtctcaaaaaaaaaaaaaaaaaaaaaaaaaaaaaaaatcaccagcctggccaacatggtgaaaccctgtctctactaaaaatacaaaagaaaaaaaaattagccaggtgcggtggcgggtgcctgtaatcctagctactcaggaggctgaggcaggagaatcgcttgaacctgggaggcggaggttgcagtgagccgagatcatgccattgcactccagcctgggcaacaagaaggaaactccaactcaaaaaaagaaaaaattaaaaaaaaaaaagaaaatagaagtgaagggacatttcctaaattcattttatgaggccagcattaccctgatatcagaatcaaacaaagactttataagaagaaaaaactgcaggcaaatacgactcattaactcagacccaagaatcccaacaatctgggaggccggagcgggcggatcacgaggtcaggagatcgagacaatcctggctaacacagtgaaaccccatctctactaaaaatacaaaaaattagccgggcgcggtggcgggcgcctgtagtcccagctactcgggaggctgaggcaggagaatggcgtgaacccgggaggcggagcttgcagtgagcagaaatagcgccactgcactccggcctgggtgaaagagcaaggctccgtctcaaaaaaaaaaaaaaacacacacacacacacaaaaaagaatcccaacaatatttaaaaagaatactgtatcatcggctgggcgcagtggctcgtacctgtaatcgcagcactttgggaggccaaggtgggtggatcacctgaggtcaggagttcaagaccagattggccaacatggcaaaaccctgactctactaaaaatataaaaattagctgggcgtggtggcctgcacctgtagtctcagctactcaggaggctgaggcagaagaatcgcttgaacctgggaggcgtgggttgcagtgagccaagattgtgccactgcactgcagcctgggtgacagagcaagactctgtctaaaagaaaaaaaatactgtatttgtatcatgaattgatgtgttttttacaagaatgcaaagttggttcatattgaaaagtcagtcaacatgatgcatcatagtaatggaataaagaagtaaaactggctgggcgcaggggctcacacctaatcacagcactttgggaggtgggcggatcacctgagatcaggagttcgagaccagcctggccaacacggtgaaaccccatctctactaaaaatacaaaaattagccaggcgtggtggtgcatgcctgtgataacagctactcaggaggctgaggcagaataattgcttgaacctaggaggcggaggttgcagtgagccgagatggcaccactgcactccagcctggtgacagagcgaaactccgtcaaaaagaaaaaaaaaaaaaaggagtaaaactgtatgatcatcttaacagaaaaaaaaaaaaaacttaaggaaaatcaacaactatcatgattttttaaaatctcagcaaactaggaacagaagggaactttctaaacctaagaaaggacatctatacacatgcaggtacacgcacacacaaaactacagctaacatcatatataatggtgaagtactaaatgctttcttcttaagaatgggaacaaggcaaggatgcctaccatcaccacttacattcaactgtgtactggaagtcctagccagtggaataaagcaaagaaaaaaaaaagggatatagatagaaaagaaagaagttaaagtgtctttatttacaaaagacatgaccatatgcatagaaaacctgaacagatttccaaaaagttaccaaaagtaataattgagtttaggaaggtctcaggatacaaggtcaacagaaaaaatcaattatattttaatatactagaatttttcttttgagacagagtctcactctgttgcccagcctggagtgcagtggcatgatctcagctcactgcaacctctgcctcctggtttcaagttattctcctgcctcggcctcccaagtagctgggattacaggcatgagccaccatgcccaactaatttttgtatttttagtagagactgggtttcaccacgttggcctggctggtctccaactcctgacctcaggtgatccacccacctcggcctcccaagtgctaggattacaggaatgagccacagtgccggccagcctttttcttgaaaaatgaacaaagtgagcctgtcacttcaaggaaaataactgacagtatttgttgccaataagaaaattccaaaattccacattcaaatgccaaataagaaaaagctttcggctgggggcagcgtgagccaccgcgcccggccaagttttgtattatttttcttaactatgtcttctcaaattgcggaagcgttaggccccacaacatttgacatcaccagtagggatccagtggagaggagggacatgatcagaaactgtgtttttaaatgatcattcaacagccaattatcagggtgggtaggagtgaggcagggagatcaaaaggcagggagattggctgggattacaggcattgttaccagaaaggggtcccgatccggaccccaagagaggttcatggatctcgcacaagaaagaattcagggcgagtccgcaatgcaaagtgagagcaagtttattaaagtacaagaataaaagaatggatagtccatagatagagcagctccaagggctgcttgcccatttttatggttatttcttgatggtacgctaaacaaggggtgggttattcacgcctccactttttttttttttttttttttttttgagacggagtctcgctttgtcgcccaggctggagtgcagtggcmcgatctgggctcactgcaagctccgcctcccgggttcacgccatccctcagcttcccgagtagctgggactgcaggcgccagcaacctcgcccggctaattttttgtatttttggtagagacggggtttcaccgtgttagccaggagggtctcgatctcctgacctcgtgatctgctcgcctcggcctcccaaagtgctgggattacaggcgtgagccaccacgcccggccaggtcccgaaacttaagcttcatttgtttcactgcaaatctgcttctgcctacaagcctrgtctcattttcctctacctaaggatcttcctccatgcaatttcggcctaggaggcccttcccgccccttttcgcctagctaactctttcggtactcaaccaccaactcctaatcctccctggtcccccaagtgggctaggggcttcttkggagtccctcgcactgctctaagcatccaggcagagtcattattccgggtgccaggttgctctttttccagcagccttcaggggactcctggctgggcggagtctgtagaggcgcgcggagtcctgggagagcgtcagatgtatttcctttcccttttttcgctcgtgtcccgccgggtggcgctcaccacctccccggaacacgcgagtctcctgtcgcggttccggtcggaattaccccgtggagcacgccgatatggctgcgctgacactgaggggtgtccgggagctgctgaagcgtgtggacctcgcgacggtcccgcggagacatcgatataagaagaaatgggtaaggtccggctgggggcgcaggagggaaaagtgagggtggaaacttctccagtctttccgtttcccggccctctagaacgcctagcgtctttcccaagcactccacggaacgtccttaggcacctccctctctcgtcttttccgtcaccgcctctgtccgcactctatgtcccgagcgttagtgtcttccacttgttacgtctgcagtctcctgactccgcccaagttgcgtcatcaccttcgccttcattcttttagtgatgtcactgtctcttgttccccagctgtgtccacctacctttctgtcccccactcccccttttacttccctccctcccctccccctttcccttgcccattcttccyccacatgacttctcctttcctcattgattttccagcccggtcgccctcacccctcggaaaataccatagcgaccttgcctgcactcctgggtctccgccgccttgcaggaaaggattcagccccttcctcaacctcgagctgcctctggcgaccgggcaaggttacagcgaccaccctgtccatactgccggcccaaaccctggcaaaaggtgcaacgaatcctctcatcctctggactctccttgcttctccagagaccctttttcttgcctcactggaagccctggaatttcttctatgaccggcacgcccccctgcccaccccagccgattccctcgccacctccaccatctcttccacccccacaaccttcctcgcactcagggagatggtcttttgagtcctcttccccactcctggaaaggacctactgccgctagccctgccactcgggttccccactctccagcccttattttgagcagttcagcattccggggtcaccccctctctgtcagcggacaccttattgcagctggatgagtccctccagaatgcggcgtccctgtcttcaaggcacgtactgtgaccagcacactaatctctgttactctagcggatggccttcagcttttrgaaccagcccggcaacctcctttccccttgctcatcagtccccgggaacgagcccagtgacctcccctcagctcactcatgtacccttggaaactggacccatgatttcgcctcctcctacacataggaccccgggaacttgcctcacgatttcacctcctcttgctcgccggccggtggaaactagtcctatggcctccccaaccctttctcacagagttttggaaactgggctgatgatctctctgccctctcactggttctcagggagaagttataatgacccccttctctccccagcatcttccccacctactggcagcttttaccatggcagccttaagcctctagactcttgtgaacccaaaccacagcttgacctgccccttgagaaaaattgttgtggcttcccactctcttctcaggcaggcatgcctggctctcycagctcacctcaggagggctcttatcattactcccatctttcctcagaggcctacatacctacccctgggagtccttgctatgccatctgcctgtgccccgggagtactgattctccttgctcaccccagtcccaggctcccaggaaggcttgcattgagtcccttctctcctgggaggcaactgggaactcttacctcatcctaaccccggacaccacaacttctggtcccccctgttcccaggaaccatctcgtccccatggtcctcattctgtcctttccttcccttcacccctgggcaaccagtttatatctccaccccagtcacttccccgcagaagctataatgaaccccctcttcccactccagtttccccccaaccgaagtcccctaagtccccagagttaagacagtcacatactccccacaaatgtctctccctagtcaacactccccagcacaccccttctggccagcccaagcccgctaaggcccacacctgtcccccacctccctcctgcctctctggtccttcttgtatgcagccatacatcacaactccttcaaattccagccccaaagaacttcccccagggactaccttactgactgtggtccctagagctctcaaaagtgttatccccacttcttttcccctctgccttccttgtgatcctgtctcggccaatagttatgctcagagcagccgccatggaccctccatagggcccccctgcaatacccatatatgctctgtggttccctccaccccccatccctgcccactgtctggctccctcaatcattcgacaggcccccctcccattgtgcccctgtgtgacacctatagcactcccaggggcccaccccaacctcgttgtcagcctgtgatgcctccttgttctacccacatctattcttttatccctttgagaacaccctttgatcctcaaagtttacccattgtccccygagtccgggcctaccctgatactgtcccctgtggcctccatatctaccctgtggcctctcaaggcccttgcaaagagcctctgcagatcccctacagctgccctttgccttcatccaaggattccagctgtagcaccaatcccagctgtagttcgactattattagcaaatgccagagtagtgacagcgagagcaggagttcccaccaaagccaaagccggagccaaagcaagagtccccatgatggcagaagtcagagctggagcaagaggcatcatctgagcagaagtccaagtcagaaaagcagtccctatcctagcagaagctggggccggagcagtaatcctcaacaaaacacaagtcagggccagagtgagagtccccaacttagcataaatgagcaccagggtgagagtccccaaattagcagaggtcagggcaagagcaagagtctatgatggcaaaagtcggaaccggagcaagagtccccaacatggcaaaggtcaaggccagagcaagagtccccaacatagcaggagccagagcaagagtcccagcgaggcaaaagtcacagagcaagagtcctcaccataacaagaaatgagggccagagcaaaagttctgaccagaccaaaaatctaggccagagcaaggcatagatagtaacaagattgccagctatagcaagcatcccagctgcagcaaccaggaccgacttgtgcactcctcatctgaagtcttcatttctcttttactctgcctccttgttcttgtcctcttgtcccctgctacccccatagcagtcatcctagaagtccctgttttggttcacacctcaagattctgtgggccctccttatccaacctttctggggtctgggaactctcccagcatgaccctcaamcctctgattctaagcatggtggtgctagtcactgtgtgacgctaggtaagttacccayatctcttcatcaaattgaaatgttgttaatttttttttgtatcttactgagctatcagttgtagtgctcacataagctagtagacatgaaagtgctttgaaaatagaactgttcagaagaaaagggccttttgcttttaagttcaaagcttcccagagcctccatagtttctcctaatcttctgcaggctctcctcaagagtcctctcctgagctcccatattcctaagttcctctttctccaaggtcccccttcttgatgacccccgcacagtaccgtgagagttacatctttatctgacaaccctgggatgggaaggcccactctccactacttttccctctcacacttctctggcaggcaggcaggatgcaaaagcaggagtgggcactagctggatccaagtttgcccctaggctcygaggtgggggtcaggtagtagggggtagagtcaagactgggaaaaccaataagcctgtcctctctcttttaggctgccacagagcccaaattccctgctgttcgactggctttgcagaattttgacatgrcttacagtgtgcagtttggagatctttggccatcaatccgtgtcagtctcctctcagagcagaagtatggtgcactggtcaataactttgctgcctgggatcatgtaagtgctaagctggagcagctgagtgccaaggaytttgtgaatgaagccatctcccactgggaactgcagtctgagggtggccaatctgcagccccatcccctgcctcctgggcctgcagtccgaamcttcgatgcttcacttttgacagaggggatatcagtcgcttccctcctgccaggtaggatctggagccatgactggagyggtcctgagtgtctgctggaagtagacatgttgagacccagcttctaccctctgtaataaggaccataatattgctaatatttatggcatgtttatacaractaggcatttttttgaggtgctgtacatatgttatctctttttgttctgtcagcagccttatgaagtaggtaatattattgctsttttacatttggagaaactgaggtacagagaagttaagattcttacttgctttaggtccctcagatggtaagtggtgtgactaatatttagacccagaacctgcactttgaacccactctgctctgtgcctctggtagaaaacagccaccttttacatgagcactcactgggccctctcaagttgaaatgtgttattcacagcagtcttctcattttgccctcacagccacccatcaaagtgaataggaaaagtaacttcatggtagcaaagaggtagtgggactttcctaggaaatagggctggtctaggggcacaaacttggtattagactgggaaaaagaaaggagaagttcagtttcttgattcaatcctcatgtatatgaagttgaatgagaaaagactgcagaatcaaatgctgaattatgctttaacaattaaggagagctcaatgttagttgtagggtatgggaattgatttttgaaagactgatttatttattaaaaaatattggccgggtgtggtggctcacgcctttaatcctagcactttgtgaggctgaggcgggcggattgcctgagctcaggagtttgagaccagcctgggcaacatgatgaaaccctgtctctactaaaatacaaaaaaattagctgggtgtggtggcgtgcgcctgtagtcccagctacttgggaggctgaggcaggagaattgcttgaacccaggaggtggaggttgcagtgagctgagatcgtgccaccgtactccagtctgggcgacagagcgagactctgtctcaaaaaaaaaaaaaaaaaaaattatctaccaaatgctaggcatttaagtgccttgatgaacaagccctcatagagcttccagtttagtgaggaagacagctatttaaaaacaataattggccaggcacagtggttcacacctgtaatcccagcactttgggaggccgaggcgggcagatcatctgaggttaggagttcaagaccagcctggccaaaatggtgaaaccccatctctactaaaaaatacaaaaaattagctgggcatggtggcacaagcctgtaatcccagctacttgggaggctgaggcaggagaatcacttgaatctgggaggcagaggttgcagtgagccaagattgcgccaccgcactccagcctgggcaacagagcgagactgtgtctcaaaaaaaaaaaaaaaaaaaaaaattagccaggcatggtggcgggcacctgtaatcccagatattcaggaggctgagacgggagaatcacttgaacctgggaggtggaggttgcagcgagacgagatcgtgccactgcgcttcagcctgggtaacaaaagtgaaactccgtcagtcaatcaatcagtaaataaataatcattctggctcccgtatagatgaatgaataagtgaataagtaagtgtgggtctgaaaaatgagtttttggtgattggagctcaagccccagagggcatagacttggtggcctagactcccagtgggtgtcctgacctggaatttaacaataaagtggtctcctcttttccagacctggcagcctgggtgtcatggagtactacctgatggatgctgcctccttgctgcctgttctggccctcggcctgcagcctggggacatcgtgcttgacctatgtgcagctcctgggggaaagacactagcgttgcttcagactggctgttgccgtaagtcagggtgctggtgtgttgggcagagagagctccccacctcacctagtcccaggtacatttaatatggtaggttcggccaggcgcagtggctcccgcctrtaatcccagcactttgggaagccgagggaggcggaycacctgatgtcaggagttccagaccagcctggtcaacatggtgaaacaccatctctactaaaaatacataaattagctgggtgtggtggtgcactcctgtaataccagctactcaggaggctgaggcaggagaattgcttgaacccgggaagtggaggttacaatgagctgagatcctgccactgcactccagccttggcgacagagtgaaaccctgtctcacacacacacaaaaaaagaatatggtaggttctctagtcccaaagtcagagtggagggtagtacttactttctaagcttgtgtattttttcattagttcctctctttctctgtcaattggtcaagaaagattgctgagcaagttctctgaagtcagaytgaagtagggctctgatcagttgatcacatgatacacactcctcttcatctgtttacttttcctctaagattaagcccatttctttagcctaccaactaaaatgataagatctgcctgcagccaccatttatatgctttatatgtcactcttctaggctttatgtgctttaaccttactctgctactctctgttgcctttgctcttgttaaattttctccctggaattccctcacccttggctgtccaaatccttttgactttctttttttttttctttctttttttttctctttttttcgagatggagtctcactctgtcacccaggttggagtgcagtggcacgacctcggctcactgcaagctccgcctcctgggttcacgccattctcctgcctcagcctccctactagctaggactacaggcgcccaccaccacgcccagctaatttgtttttgtacttttagtagagacagggtttcaccctgttagccaggatggtctcaatctcctgaccttgtgatctgcccgcctaggcctcccaaattgctgggattacaggcatgagccaccgcgcccggccccttgtgtcaagtactcacttcagccatccactggctgatatcctgcctgcccagtcatccttttgactttcaagcctcagctcaagtgtgccacctcctggacgtctgtccttacgacctctgctggccggttcagaaatgatgcctgtctcctacgctcccacagcatgggtatcgcccttgcaacattagccttgccttagggctttactagttatatatcttctccctcttaaagatgatggattctggccgggcacggtggctcacgcctataattccagcactttggaaggctgaggcgggtggatcacctgaggtcaggagttcaagacaagcctggctaacatggtaaaaccccgtttctattaaaaatacaaaaaattagccgggcctggtggtgggctaatcccaactacttgggaggctgaggcaggaaaatcgcttgaacctgggagatggaggttgcagtgagctgagatcacgccattgcacttccgcttgggcaacaagagcaaaactctgtctcaaaaaaaaaaaaaaaaaaaaaaaaaaagtggattccttggggataggcccacatcttatttgtctcagtaaagtagcccagcgaaggccttgtgcactgtttttttttttttttttttttttgagaagaagtttcgcttttctacccaagctggagtgcagtggcacgatcttagctcaatacaaccttcgccttctggttccaagcaattctcttgcctcagcctcctgagtagctgggattacaggcacccaccaccacacccggataatttttgtatttttagtagagatggggtttcaccatgttggccaggctggtctcgaattcctgacctcgcaatccacccacctcggcctcccaaagtgctgagattacaggtgtgaaccaccgcgcccagtcttgtgcactgttttttttggtttgtttttttgtttttttttttttgagacggagtcttgttctgtcacccaggctggagtgcagtggcgtgatctcggctcactgcaaactccgcctcccgggttcatgccattctcctgcctcagcctcccagatagctgggaccacgggcacccgccaccatgcccggctaatttttttgtatttttagtagagatagggtttcaccgtgttagccaggatggtcttgatctcctgacctcgtgatccgcccaccttggcctcccaaagtgctgggattacaggcgtgagccaccgcgcctggcgccttgtgcactgttaagtactcacttcagccatccactggccgatatcctgccttaaaatagatagtttttttcctttggcccctgacaaagggccgtaatttacacacctaacctggagctcagccaggcttctcttgccgtgtgcccaagcccttctgttggacctagacccttcttttccaggtcttgtcagccagcttgcacagtttgagtcagcatccagccttatgataggcattggttgattcagagagatatcacattcggtcatagccttctggaagtccagagggagagaagaaaaggtggggtcatgggcttaatgaatccaatgcaagagagcccagcctgtgtgctggacmattcttatctgactgaatgctgtgggaatccattagaagggagatgagtaagggtagggttacttggaggaggaggaacttgaactaggaggaggaagaagggcaaagaagaagtaattgagagttgttcttctaaggcatgcttaactatcagcacctcaccttcatcccagctcctcatcaagcgacaactcttgatccgaggaaaacgggatcacagaatttgtataagaagggaaattagtgtttacttagtctagccctcatattttayggagggagaaattgagttctgtggagattaaataaataatacaagaatkggaggtagagccagaactggaacccatctttctttttytcagttcatatccttctgcaaattcctctagagcagagaatacmatttttacttctttgagygccctcaaaaatggagacattggccggggggyggtgactcacgcctgtaatcccagcacaagctaggaggcygaggcaggtggaatacttgagtccaggagttcgagactagcctgggcaacatagacctcatcttcattaaaataaaaaaaaaggagacatttatttatgggattactaagctggttcatagtagtgaccactattagataaggtggacacttgcatctcgcattctttaccattcccaccctaccttgttgttctttgactcagaggccaggtatcaagtgtcatttatcatcaagcttgcaatatttttctcatagtagcactaagagcaaagtgagatatttcttgaactcatgtctaccaataaagagaaaatgaaaggtagatggtaaatcagaattaggtttggttgcatttgatagaaaacctractaattggcttaaagaggaaacattaatttatctcttacataagagaagctgagatataggcactccaggtatggaggctccacaatyatcagggacttaagctccctttttccttttgcaacrtattttgttgctagtgtcagccttagcctccctccctttaagagggagaagatatgtaactagtaaagctctaaggcaaggcctcatggtccagaatgactgctggaagtccagccatcacatccatatttgagtcaagaggaaaggattgggcaaaagagactcatttcatctcccaattatgtcagccttttaaaaatatcttcccagaattcctatccaatacttatgcctacaactatgaccaaaagttagtcatatagtcatacttagttgtaaaagaaaggcttagccgggtgtggtggctcacacctgtaatcccagcactttgggaggccgasgcaggcagatcacctgaggtcgggagttcaagaccagcctgaccaacatggagaaaccccgtctctactaaaaatacaaaatttgccggcgtggtggcgcatgcctgtaatcccagctactygggaggctgaggcaggagaatcgcttgaacccgggaggcggaggttatggtaagccgagatcgcgccattgcactctagcctgggcaacaagagcgaaactaaagaaaggttgagaaatgtagtcttttggggcaattttccccttccaaaaaattggggttctattaataaggaggaagaggagaatgattttggstaaataaactgtagtatctaccaaagatgaagagagccataggtttccagaatagtgggagagcatatttttttagaaataaatattcttggctgggcatggtggcccacacccatcatcccagcactttgggaggctgaggtgggagaattgcttgaggccaggaattcaagacctacctgggcaacatagtgagacccagtctctttttttttttttttttttttttgagatggagccttgctctgtcgcccaggctggaatgcagtggcgccatctcggctcactgcaagctctgcctcccgggttcacgcctttcccctgcctcagcctcccgagtagctgggactacaggtacccacccccatgcccggctaattttttgtatttttagtagagacggggtttcaccatgttagccaggatggtctcgatctcctgaccttgtgatccgcctgccttgtcctcccaaagtgctgggattacaggtgtgagccaccgtgcctggccttccagtctctttttaaaaaattatttaaatatatttttatttttgtagaaatgaggtatcgctatgttgcccaggctggtcttgaactcctgggctgaagcaatccacctactttggcgtcctcccaaagtgctgggatgagaggcgtgagccactatgcccagactcagagaccctgtctttaaaaaaaaaaaaaaagaatgtggctgggtgcagtggctcacacctgtaatcctagcactttgggaggccaaggcaggcgggatcacctgaggtcaggagttcaagaccagcctggccaacatggtgaaatgctgtctctactaaaaatgcaaaaattagccgggtatagtggtgcacacccatagtcccagctactcaggaggctaaggcatgataatcacttgaacccaggaggtggaggttgcagtgagctgagagtgtgccactgaactccagcctgggcgacagaatgagactctgtcttaaaaaaaaaacaaaaggaaagagagggagagaaagaaaaggagagaaaggaaagggaggaaaggggagagggaaaggagagaagaaaggcraaagtaatggggaaaggaaaaggggaaaggggaaagaaaggggagaaaggggagagaggacaggaaaggagaaaggaaaggagtcttacttggtctgctttattcattgacttaaataactttgatactttctggcccatttaggtgtttgccattgtacccccactcagaatgactgatgctgtgccatgcacataataaatgttcctgatgctggggtttgcattggctgggactrcctgagaattggtctgactccatcagygccattgctggtggaatgtttcrttgggycatggcctctgaagtatctttatttccataggcaatcttgctgccaatgatctctccccgtcccgaatagccagactacagaagatccttcacagctatgtgcctgaagagatcagggatggaaatcaagttcgagttacctcatgggatggcaggaaatggggagaactggagggggacacctatgaccgggtgagtgattcttgatttargacaygcatccagcttaatgcggcctccccatcctggttctagggcctgaggggttaggatccagcccctatgtttgagcatgtagagctgtttctggactggccagttctacattggtgatttgaccaaaagaaaaatcagcttagatgactggttattatctctattaaagatagttggcagcaaaaaagaatttgaaactatttgagtaggggaaaaatttactaggcttactttatttctcaagtcacttggttgctcagaaagcctcatgaaggtaagtaagaataagctcatttatttatttttgaatgttagtacagcacatggtacaaaattcagaaggcacaaaagagtatccaatgaaaagtgagtttttctcatctggcctgtagccccctacttccccaccctatagataacgattgtttcttttttttttttgagacggagtttcgcttttgttgcccaggctggagtgcaatggcgcgatctctgctcactgcagcctccgcctcctgggttcaagcaattctctgcctcagcctcccgagtagctgggattacaagcgcccaccaccacgcccggctaatttttgtattttttttagtagagacggggcttcaccatcttggccaggctggtcttgacctcctgacctcgtgatccacccgcctcggcctcccaaagtgctaggattacaggcgtgagccactgcgcccagccggtagtatattatattatactcactattctgaactttgtatttttttatttaataatgtgtcctggggttaaatccttttttaattttgttgacattgtggaagtatagttgttgaataacagtttacatccatttaagattttgatagcgattgctaaatttctctgtggaggttaaaccagtttcactcctactggtaatgaatgagtactgatttcccacatgctgccaatattggtgctatcaaacttaatttttttgccaaatggatagtatctaatttacaatctcttattaatcatgttgaaaatctccatattaatttttttaaagttttttttttttgagtggcaggttttcactttgtcacccaggctggagtacagtggtgtgaacacggctcactgcagcctcaacctcctgggctcaaggggtcctcctgcctcagtttcccgagtagctgggactagagtgtgccaccatgcccagcaaatgattttttgtagagacggggtctcactatgttgcccaggctggcctcgaactcctgggcttgagcagtcctcccaccttgtcctcccaaagtgctgggattataggtgtgagccactgtgctgggccagtctcttcatgtttttaagttatttattttattttaaatggcatactctaaaaatatttgtttagaacacatatttctaaaaatatataaaatatatagctgttgtctctgtgttgtcacctgatttacctaatctgtctagttctcaccattctgcctcaaccactctaagaaactgaaagaaagaccaaggcttatggaatcttagataggcttgagacttgctttctgcctgtgtaggaatcccctactcatttttttcttttttttttttgagacagttttgctcttgttgcccaggctggagtgcagtggcgcaatcttggctcactgcagcctccgcctcctgggttcaagcctgggttcaaagttcgattctcttgcctcagcctcccaggcagctgggattacaggtgtgtgccaccacgcctgactaattttgtatttttttagtagagacggggtttcaccatgttggtcagactggtctcgaacacctgacctcaagtgatccattagcctcagcctcccaaagtgctgggattataggcgtgagccactgcgcccggcctattcatttttcttgatatgagagcagtggaacatgatggagagagcatgacctctcctgtcagcctaaccagtttctacattacaggggtgctacttactaaccttaggcaaactgttgatcttgctgaacttcaacctcttcgtttgtgaaacagggtaatcctaccacttaggattattgtgaggattcagtgagagtatccagggaaagcacttagtatagtacctggcggtgaagattaggcaagcaggacccattatcattattcagcctatgcttaaacacatccgttgatgggtgcacactgagattctgttgttgaacacttacaatgttaggaagttctgcctcttactgcaatctgtagatagcatggtatatgggttagggcaaggattctggagtcagactgcttggattagtcctggttccattacttatcagccagagaagtttcggtgagttacttaactttcagttaagcttcagcttcttcatctgtaaaatgaggataatagtatagtgcctatcccgtaggtgaaaattaaataagaatgcatttggcacaatgtctggaatatagaaaacattcagtagtagtataatcatcacaatccttaccattattattattatttccattcattgatcctagctacttattttagaacaatatagaatgagtgacctgctatttcacttgacagctttaatgtttgaagatgtctttgttaacttgtttgttgaaaaactagttgtggccgggcacggtggctaacgactgtaatcccagcactttgggaggccaaggtgggtggatcacctgaggtcaggagtttgagaccagcctggccaacgtggtgaaaccccgtctctactaaaaatacaaaattagccgggtgtggtggcaggcacctgtaatcccagctacttgggaggctgaggcaggagaattgcttgaacccgggaggcagaggttgcagtgagctgagatcgcgccattgcattccagcctggggaacaagagtgagactttgtctcaaaaaaaaaaaaaaactagttgtgtacaatatactctgtggtaggcaagtgttaagcacttttatttatttatttgagacaaggtcttgctctgttgcccaggctggaatgcagtggcgcaatcatggctcactgcagtcttgactttctgggcttaagtgatcctcctacctcagcctcccaagtagttgagactacaggcatgtgcaccatgcctggctaattttttaactttttgtagagatgaggtctcactatgttgtccaagctggtctcgaattcctgagctcaagtgatcctcctgcctcagccccccaaagcattaggattacaggtgtgagccaccgtgcccagccgtgttaagcactttagatgcaaagaagaatgctacttcaaggctgggcgcggtggctcacgcctgtattcccagcactttgggaggccaaggcgggcggatcacgaggtcaggagatggagaccatcctggctaacacggtgaaaccccgtctctactaaaaatacaaaaaattagccgggtgagatggcgggcgcctggaatcccagctactcgggaggctgaggcaggagaatggcgtaaaccctgtggggcagagcctgcagtgagccgagatcgcgccactgcactccagcctgggagacagcgagattccgtctcaaaaaaaaaaaagaagaagaagaagaagaatactacttcagggctctacatactcttggtaactccatccttctcccgctccacttgtccatcagctggagaagggacaggacctcagagctctgcatgttcatggaagacactaacccccccatgtcacaactttcttttttatgtgagctcaagtttatttcaaataatacaatgtttatttgaacatgtttctatcttcccttataatacaatattatacaaattgatattaatacaaataatatttgttagacacttgcccagggctgagattcagtgggagcactatcctggcacgactggttatttatgactgacatccatgccagtgcctgatgtgaagatgcatgtgccatatctgatgttgagtggtttgactaccctccctaaatgtttcctaagtgtagtgcaacagtacaacttccttttctttcttctgtgactgagtgagatcaacatatttttttatttttgagacagggtttcactcccatcgcccaggctggagtgcaatggcacaatctcggctcactgcaacctctgcttcctgggctcaagcaattctcccgcctcatcctcccaagtagctgggagtacaggcaygtgccagcatgtccagctaatttttttggtattttttgtggagacggggttttgtcatattgcccaggctggtctcgaaatcctgggctaaagccatccgcccgccttggcctctcaacatgaacattttccacagttaacactactgaaacaatattagaaatatattagaaccaagatattcagatatattgccatcgatttatagtccccttgaaattacatagctctgctgtttctctgcattaggggctcaggagtccagcggtcctaagtataccttgcagccatcttcctaaaagttctgaccatgactgaggacactgagaaggagtaaggaaagagtctgtagacatttcctcctttttgggttggggaaactcctacagcttttttttttaaaggattgcagttatacctttgctcatccctttatatttaggtcatttccttttaggtgtatctcttatatgctgcatagacaggttttgctttgtgagccaatctataaattttattcttttcattgctgacttaagcaattgatgccattgatgattttggtctcagctctgtcaaattattatcattttatttatttattttttgagacagtctcgctctgttgtccaagttggagtacagtggtgccatcttggctcactgcaacctccaccttccgggttcaagcaattcttgtgcctcagcctcccaaatagctgggattacaggcgcccgccaccatgcctggctaatttttgtatttatttatttatttatttwttttgagacggagtctcgctctgtcacccaggctggagtgcagtggcgcaatcttggttcactgcaacctccgcctcctgggttcaagcgattctcctgcctcagcctcctgagtagctgggattacaggtgcccaccactgtgcccggctaatttttgtatttttagtagagacagggtttcgccatgttggccaggctggtctcgaactccttacctcaggtgatctgcccgcctcggcctcccaaagtgctgggattataggcatgagctactgctcctggcctaattttttttttttttttttttttgagatggagtctcactctgttgccaggctggagtgcagtggtacgatctcggctcactgcaacctgtgcctcctggatttaagcgattctyctgcctcagcctcccgagtagctgggactacaggtgcgtgccaccacacccagctaatttttgtctttttagtagagatggggtttcaccatgttggccaggatggtctcgatctcttgaccttgtgatctgcctgcctcggcctcccaaagtgctggaattacaggtatgagccrctgtgcctgacacctgtcaaattattttactgtgtttatttaccatgtttctttcactgtggggtctctgtccttgctgttttgtttttcttttaacttcttttgttatttaggaaggtttatattaatattttaattctacattggataattcctatatcaaaactattgttgacaatcagttacagatggaacttcgtctactctttctccccttctcactcctgctctttctccctttctcactccagcagttgactagtctcattgaaaaaacaaattggggccggccaggcatgatggctcatgcctgtaatcccagcactttaggaggctgaggcgggtaaatcacctgaggtcaagatttcgagaccaacctggccaatatggcaaaaccccgtctgtactaaaaaaatacaaaaattagctgagcgtggtattgtgcgcctgtagtcccagctacttaggaggctgaggtgggagaatcgcttgaacccgggaggtggaggttgcagtgagccgagatcgtgccattgtgctccagcctgggtgacagagccagactccatcccaaaaacaaacaaacaaataaactgggaatttagttttactggttgctgtttctgctgacttgctcaaggagtcgtgtttccttttaagttttgtggttatttttgtgtcctgtagtaagcttttttttttctttttcgaggcgaagtctcactttgttgccaaaggctggagtgcagtggcgcggtcttggcttactgctacctccgcctcccaggttcaagcaattctcccacctcagcctcctgagtagtagctgggactacaagagcgctgccaccacgcccggctaaatttttttttttttttttgagatggcgtcttgctctggcgcccaggctggagtgcaatggcgcgatcttggctcactgcaacctctgcctcccaagttcaagcgattctcctgccttagcctcccgagtagctgggattacaggtgtgtgccaccatgcctggctagtttttaaattttttgtagctgggactacaggtgcatgccaccacgcccggctaattaaaaaattttttttgtgcaggtggggtctcactatgttttccagactgtaataactttcctattggagtataatacagaagtgaccaaatcataagtgtactgtttaaagaattatcttatagttagtctgggcaacatagcaaaatgctgtccctacaaaaatacaaaaattaggccgggcatggtggctcatgcctgtaatcctagcatttcaggaggccaaggcgggcagatcatgaggtcaggagatcgagaccatcctggctagcayggtgaaaccccggctctactaaaaatacaaaaaattagccgggcatggtggcaggcgcctgtagtcccagctactcgggaggctgaggcaggagaatggcgtaaacccgggaggcggagcttgcagtgagccgagattgcgccactgcactccagcctgggcgacagagcaagactccatctcaaaaaaaaaaaaaaaaaaaaaaaaaawatatatatatatatatatatatgtaaattagtctggagtggtggtttgcatctatggccccagctactcaggaggctgaggtgggaggattgcttgatcccagggagtttgaggctgcaatgacctatgatcacatcactgtactccagtctgggcaacagagcaagatttgtctctaaaaattaaaaaaaaaaaaaattatagttacttgtgtgttagttttgggtttttgaccagccatgaatattcccaaatatactattttccactcattatttcacaattgtctaccaagttaaaatgaagaactttgtcaggtactctgcaaaggagggatgggcagagggaatatttcacaaacttaggccaggggcctaaaacatctctggcctaaggaagagaagcctataaggatctttaatactttaccctttaacactctgggtaggtgctggtggatgtgccctgtaccacagaccgccactcccttcatgaggaggagaacaacatctttaagcggtcaaggaagaaggagcgacagatattgcctgtgctgcaagtgcagcttcttgcgtgagtgacagatttttaaactcaggactttgtgccagagtgctctgggagactgggggactggaagctcttaccaagaccataacmcacacaagaatcttatggctggagatctgcctagaggagacagaaatgggatcatctctggaacataaaaaccctatttgaattagctgggtgtggagatgcacacctgtagtcccagctactcagggggctgagggaggagaatcacttgaacctaggaggtggaggctgcagtgagctgagatcgtgccactgcactccagcctgggtaacagagcaagactctgtctcaaaaaacaaaaacaaaaacaaaaaagcaaccctatctagtaggatatatatactagagtgggctgcacagattgactcatgctatttcatcctcagtaccagtgagtagcacatgtttgaaaaatagctgctagagtaaggactcattctatagccagcatagcaatttggtccataaacaagagctcagggggtcattgtaaggagacttcctagtgaagagctcatggagtaaggttgggttgctatctgccttgagagtgacttttcagacagtgtcattgtggaagggacttgagaggcagtctaaccagctacccwtcctgtagtagccttcccttatccatgtttccagctccttatgttgctcttctactgctgggaagctcactagtmactgcttctgtctctttctggtttcagggctggactccttgccaccaaaccaggaggccatgttgtctattctacctgctcactctcacacttacagaacgagtatgtggtgcaaggtgccattgagctcctggccaatcaatacagcatccaggtacaggtggaagatctgactcacttccgaagggttttcatggacacattttgtttcttctcatcctgtcaggttggggagctggtartaccaaacctcatggccaattttggcccyatgtacttctgcaaaatgcgtaggctgacatagtatcacccaatccctgaagcaagaatacaaagggtatactctgttggatgcaccagaaactggaaactgggaccagtggcagagatgcactctcggtcctgtctccatcctgttcgtgtctttctgcagttttcggcaataagaagtagaagatttgctgtcctgctgtccaattgtggagcatcagcaggtttccaactcactcattamcccctaccccatctccaggcctgtactaaagtttgctgccygcttaggggcttagaaggagaagccagtgagcaggctcacactaagttgtaaacataggagaagcatttggccaataaagttgttgaaactctatagacctrgggctgcagttggggacttcatgtcagtgcaaatgccattagttccatttgtaccagccagttactgagcccctgtcacccttgaagtgagttccacctgaccagtcttgagcagccaacaggctcaattaagcccgcctggtttttccatatggctcatgatctaatttaaggaacaagtaactaaaaatgttaagccagtgcaaaataatctgcttacctactcacattggaaaaaccctctgagctgaataattctggccattcctgctgtcaacaatactgctgcccaaatgtggcttaggaggctgcttctgccacaaaaccgtcatactcttgtgcgtgccttgttctttgttcattcatctagcaggtattcccagacctcgtgtatgacaggtagctagggagctcttggagatgtagcagttgggattgtgggagattactgggcttcctcatcctttagaatggtaactctccttttgctttctgaacacctaggaatttcctgatgttttgttttgttggattccagactttttgttgtttctagtctgcagctgagctctggtgcctgttctttggcccaccccctaatccctaactcttccctcagcatcacagggcttcactgcacacactgtgttcagggcaagatttcatcatttactgactgcatactcgatatgttgtttttgtaactttagccaaaagaaagtaacctttagtggcagggatataaaaaattgctcagggtcacttgcagatattttatttttaaactttttttttttttcctggaaaacatcctgtgcagaaaagggtatataattttagaatacctgaaggcttcttggcttttccactttccttattcctcctcttcctgccactctttttgtcccttctgtctttcctgctcatccttatttgggtattagaggtgtcagttgaggagggactttagctgaggttaagccttcttttgggatttgcattgtaattgagggccctggaagatctctgagactcaaaatcaggtgaagctaggaagatggagctttaaggagcatggctagtgctctgagtaggaccgtaaccgcctccgtgcgtggcatatggtccctgcatgctgttcactctgtatagtacttagtattcgctgaggctaagaggcctcaggtgcctgggcttctgcccttggactcctggatatccagcctagtgctaattgaatgctaagcagtggtaattcaaaatgagagggtcccctgcctctagagtcatcatctaattggggacaggcagacctagataagaaaagcagagaactactttggaaaacagtttatctgctgtaattgaacattcagctaccctataacccagttaatccaatactggggataaatcctagagaaactcatacatgtacaccaggagatgtgtacaagaatattcatagcaaccctattcacaaaagcaaaagcctagaaataacccagatgcccatgagcaagagagtggacaagtaaactggaatattcacataatagaacattatacaattgtcaaatgaactataatgatacctaaccatatggatgaatctgagcaataaaataattaagtgaaaaaagtttaatcccagaagagtaaatgtagcatgatgccctttctaaatgaaaggttttttcttttctatggagttattctttacatacaatatagttcataaattttaaatatattgtttaataaattttgataattgtatataatagtatagtcaccatcaagatgtagaaaatagaaaataggctaggcacagtggctcacgcctgtaatctcaacactttgggaggccaaggtgggaagatcacttgatcccaggaattctagatcagcttggacaatgtagtgagacctggtctttaccaaaaaaaaaaaaaaaaaaattagctgggtgcgctggcatgtgcctgtggtcccagctactcaggaggctgaggcaggaggatcacttgagcacaggagtttgaggctgcagtgagcagcctgggcaagagagtgagactccgttttgtgccactgcactccagccagggtgacagagtgagactctgtctcaaaaaaaaaaaaaaaaaaaaaggcattgggatttataatgtgctgtttaaagtctgaagctcggccaggtgcggtggctcacgcctgtaatcccaaaactttggaaggctgaggcaggtggatcacctgaggtcaggaggagttcaagaccagcctggccaacgtggtgaaaccccatctctataaaagtacaaaagggcatgatggcaggtgcctgtaatctcagctactcagtaggctggagcgggagaactgcttgaacctgggaggtggaggtttcagtgagccaagatagcgccattgcactccagcgtgggcgacagcaagagacttcatttcgataaataagtaaataaataaataaagtctgaagctccactggtcactccttttattgattatttgcagctggtctaaccagttacrtatgtctggcttgattmcatggccagagcaacataaaagccctgctgggaacttctgatttgagctcttccaaaaccaggatggatgcctcacatagatcatgatgattcaatccaaaggcactttgcagtgcagtccacatgtgcataaggaccatggggagcttgtatttgggaattctgagattcctgatgtttacctacctagtctttctcttgctgccctgtatcctttgcctttaaataaaaatcttaagtgattatgctctgtgaagcctggataatcctttcaaatatttggtcttggaaaatttttgcatatatacatggaatcatacaatatgtagtctttggtgtttgacttctttgacttagtgtaatgtttttgagattcagtttgttgtgagtattaatgttttgttcctttttattgctgaattgtattccatggtgcagacataccaccatgttgtttatctgttcaccagttgatggacatttgagttgcttccagtttggggctattattagtaatgctgccaataccttttgggcatataattttgtgagtacgtgttttcttttctttttttattttttgagatggagtctcactcttttgcccaggctggagtgcaatggtgcaatctcagctcactgcaacccccgcctcccaggttcaagcgattcttctgctgcagcttcctgagtagctgggattacaggcacccaccaccatgcctggttaatttctttgtatttttagtagaaacggggtttcgccatgttggccaggctggtctcgaactcctgacctcagatgatccacctacctcggcctcccaaagtgctaggattacaggtgtgaaccactgtgcccagcccatgttttcttctgagtaaatacttaggggtagaattgctaggtcatatggtaaatgtatgtttaactttataaggtaccaccatactgttttccaaagtggatctaccattttgcacggccatcagcaatgtatgagaggtccatttgctccacatcttagtactaacacttaggattatcaacgttaaactttattgtagtgggccgggcagtgtggcttatgtctgtaatcccagtactttgggaggccgaggcgggcggatcacttaaggtcaggagttcaagaccagcctggctaacatgggaaaaccccgtctgtactaaaaatgcaaaaattagccgggtgtggtggcacatacctgtgattccagctacttgggagactaaggcatgagaatcacttgcacccaggaggtagaggttgcagtgagctgggattgcaccactgtactccagcctgggcaacagagggagactctgtctcaaaaataaataataaataaaaacttcattctagtggatgtatcttgatacctcgttgtggtcctaatttgcatttctctaatgagtagtgatgctataaaattaaatacaattaagaatttaaaaacatgtaaaaagaacatgtatgcagtaaaaccatgtaagaaggaaagaatggttctcactatggaattcagtataatggttcttagaggtagggggataggatggggctggagggaacataaagttagattattgttaaggctctagcttttatgtttggtgcttattgaattattaaaagcagctaagttaataaaaagttatacataaaaatttgttattcatgacaaaagtgataaaagtatgttataaacaaagattatgattaattcaattttgtacatctgaggtctccctaaaaaaagagaagggggttggctgggcatggtggcatggtggctcatgcctgtaatcccagtactttgggaggccaaggcaggtggatcacctgaggtcaggagttcgagaccaggctggccaacatggtgaaaccccatctctactaaaaatmcaaaaaaaaaaaaaaaaaaaaaaaaagtgggtagagaaccaagcccacagagaataataatgcaaaatatggcttaatgtaggagggatcatattgagagacctggaagcttagcagtattgcctcagtcttgttcatgagctcctctttccttgtgatttgcaacagttgaaccacagcagagggtcaggtattggggcagttatgggtcaatatacattgatagcttggatctatggttttcaccttttaggagtcacaaatctgtttgagagactggtaaaagctttggccgttctcagaaaaataaagacaaaaaacaccatagcattttacatataatttcaggggctttggtacttcctaaggcctatctcccccaagttaagaacctttggattagaagatctcagatttgagggtctttagtggaaggcaagggggtcaagcagagaccccagtaacaactcaaatcaccactctcacccctgccaatctgcccttcttcccatctgcattcttcatctccaaacttaacaccaccctttaccctgctgcccatgccagaaactgcagctatccttgatgcagtgacagtaatcactactgtatatcgaacgtacctgagccaggcccatgtgaaaaaagcattgttttacttacatcattgtttcttactttcacagaaaccctgggatatgctcttttttgttgttgcctatttattataaaactttgaaagagttattcgttaatttgaacattttcatccattttgtggcttttctttgcactatttttatggtgtgtttttattgcagggcaggcaagcctcaaaactggggcttagcctgggagaaagccaggaaagaattcaagggcaagctagtggtgttagacagcaatcttttattgaacagtactgctccttgcagagtaaggctaactcataggcagcaaatccagagtcagctgatatactctttttagtcccattttatagagaaggaaacaagcttagattgcttaagtaactcaaaaagttacaatctgaaatttcttttttttttttttttttttttaagacagggtctggctctcaccagggtggagtgccgtggtgtgatctcggctcactgcaacctccgcctcccaggctcaagtgatcctcctgcctcagcctactgagtagctgggactacaggcacatgccaccgcgcctggctaatttctgtatttttagtagagatggggtttcgccatgttgcccaggctggtcttgaactcttgagctcaagtgatcagcctgccttggcctcccaaagtgctaggattacaggcatgagccactgcgcccagccacaatctgaaattcctttcttgaaatgtcgcttatatttctctccttcctagcattcctaccttaggtagggccttatcatttctcactgatcaaaggcagtagcctcaaaactcatttctattactccaatcagccctaaattcttccattctcccccatcctctcatgccaccccttatctgttgtgtgatcgccgatcacaataattcctcccatcctgtcccagtacaatgtgactttgctgcttctgtcattaagagatggagtctgtttccccacctcttgaatctgggctgatcttatgatttgttttgaccagtaaagtctggtggaagggatgctgygcaacttctgcatgtaggcctcaagaagcctcgcaacttccacgctcattttggagctcttctgcggctctgtgaagaagcctggaccaayctgctggagacatgtgctggaagctgtcttagacctcctaagctcagttaaacggttaggtgacccaaacagcatgagtgaccccagccaagaccaacctaaatcgctgacctccagaatcatgaacaaataaagtagtggttgttttaagccagtaagttttggaaatggttaagtaaatttaaataaaattttaacatatgtcatttgtgttagtaagtaacacaaatctgagtgtcattcatctgcttataattctttgttctttaggctgggcatggtggttcatgcctgtaatcccggcacttttggaggccaaggcaggagggtcgcttgaagccagaagtttgagaccagcctgagcaacatagggagaacccatttttacagaaagatcctttgttctctctccattgccagcaggatcaagtccagacttttgccctgatccctggttgttgatgctgttttatctgtgtctgtcatgccttgctgctccccttttgcacaaattctttgtctatccatgcatagcataccccaatgcttctgggtcaggacaaattgtctcctctgtctaaatgccttttcccttgtgctttcttgctagctcaaatgtccacccctctggaagctttctctaatccttctaaagctgggttgatcctcttctgtgctccccaaccttctctataatacaatgaatatagcactttccatggccactttttcttctttacccatctccaaactaggaattgttagggacagtaagctggtatttatttttgcatccctaacccccaagtaccaacatgcttagtacctatttggtagttagtatatatttgagtacctcctatgtgctaggcttaactgtagacgctagagtggtgaacagagcagaaaaaagtccttgttctcatgggatgtacaatctagtgggcaagatagacaagtaattacaagtaaattacaagcaattacaattagttataagtaaattatgagtgagccaagtactgagagaaatgtaaagtgcatatacctgagggacctaacctcgcctggaggaagagatgtttaaacagagctgaagataaagaggagttaaattagtgaggcagaggaggatgttgggagtgccctagcagagggaacagttcgtgtgaatgtgaagtcaggaaagaggacattctagattctgaaagaggtccagtatcctgcagtgtaaggagaaaggaatggttgtgaaacacaaggctggagaagcaggcagaagccaacctacaacagggctttctgggccacttgaaggaataggtattccatcctgagtaactggaagccattgtcggagttttaaggtggaaaatgatctgatcagatttcatgggccccccagtgggaatatgattatcagaatttactgaatgaggaagttaaataactggctctacagaaattgcttctgaaagtcagtcctgtccttaagtttactcagccttatctctctgagtaaatgggaacttttgagctccaagctgttcagaccatattttgaggtgacactttaggaggtgtactggctgaagagggtgactgggatggagaggaaactgaaagtctcattctggggagaactgggggaattgggagtatttcgccaggagaaagacagacttagggaagagagatgttgtctccaactaggactgttctgaggcaggggaagcagatgtgttttgagtatccccaggggcagagctgggaccagtagaaggaagttgtagtgagccagactgtaggttagcatacgaaacctttcaatgagtgttttctgaattatcgctcacaaccatgaatcattagtggtcatgaagtcaatttgtgggtatgataagccttaggacttctcacaaaggagtacttagttactccttctcttggacatgtagtaggcttgccttccccactccctctgcaggtaggcatagccacgtgacttgctttagccaatgaaatgtgcacagaggtgctgtctttttttttttttttttttccagattcatttcacttttgttatgaacaaacacaatctcagatcagtataactaacttcagagttgatattaatagaaattattccaaaattattcttaggtcacaaattactagtatgccacataaaaagggaaaaatcccacctcatcaaagaaaaggtgtcctgtgtatgtttccatgggaatgagtttaagcattctcaaattttctccggctagttatccaccacttctccaatggattcattcagtctcttagagaaccatatagactaatgatagcttccgggacacacagacagatcaagttcatggtggacattgttattataaaaaatactcaggtcttgagaattcctttgctgaaggatcccaaaatgctttataaaaagcattagtcatgcctcaaaactgccctttgaggtagctcagtattattatccccattttaacagaagaaaactgaggcatattagagttaagtgacttgcccagggtcacatagcaagtcagtggcactgtggtaggagaggctctgtccttaaccaccagcataacattgccaccttgatttttttttttttttttttgagacagrgtcttgctttgttgcccaggctggagtgcagtggtctgatcgtggctcactgactcccaggttcaagcaattatcctgcctcagcctttcgagtagctgggattacaggtgcctgtcaccacgcctggctaatttttcttttttactttttttttttttttgagatggagtcttgctctgtcrcccaagctggagtgcagtggtgcgatcttagctcactgcaagctccacctcctgggttcacgccattctcctgcctcagcctcccgagtagctgggactacaggtgcctgcctccacgcctggctaatttttttgtatttttagtagagacggggttttaccatgttagccaggatggtcttgatctcctgacctcgtgatccgcccacctcggcctcccaaagttctgtgattatgggcgtgagccaccgtgctcagcctaatttttgtatttttagtagagacggggtttcaccatgttggtcaggcttgtctcaaactcctgacttcgtgatccccccgcctcggcctcccaacaatctgggattacaggtgtgagccaccgcgcctgaccagggagctttcaatcatgatgaaggtgaagggggaacaggcttgtcacatggcaaaagcaggagcaagcaagtgggggtggaggtgggcggggggtgccacacactttgaaatgaccagatctcatgtgaactcagagagcaagggtatgcttatcattgaggagatggcccaaaccattcatgagggatccgcccctatgattcaaacacctcccaccaggtcccacctccagtagcggggtttacatctcaacatgagatttgggtggggacaaatatccaaactctatcagagtccttctttccttgtcttgataatcccttctctctgtactartctctttagcaaactggttgctgggccatacccttggtttcctctcccaaacatgcctttttactgtttttttttttttttgagatggagtctcgctctgtcacccaggctggagtgcagtggcgcgatctcggctcactgtaagttccgcctcccaggttcatgccattctcctgcctcagcctcccaagttgctgggactacaggtgcccaccaccrcgcccggctggtttttttttgtatttttagtagagatggggtttcattgtgttagccaggatggtctcgctctcctgacctcgtgatccacacgtcttggcctcccaaaatgctggggttacaggcgtgagccactgcacctggccgcctttttactatttacatggccaggctgagtcttccaaatctttccactttacttcccttttgattataaattccatctttaagtcattttccccttctcacaacttaatataggtagttaaaagtagtcatgcagcaacctgaatgctttgctgcttagatattcctaatttctcccaccagatggcctaactcactgctcttcaattctgcattccatagagccctgaggcatggacacaatctatcaagttctttgacagttttttgttttgttttgttttgttgttgttgttttgagacagaatctcaatctgttgccaggctggagtgcaatgacatgatctcagttcartgcaacctctgcctcccaggttcaagcaattctcccacctcagcctccgaagtagctgggacttcaggcacgtgccaccacgcccagttaatttttgtatttttagtagagacggtttcgccatgttggccaggttggtctcgaactcctgacctcaagtgatccgcctgcctcggcctcccaaagtgctgggattacaggtgtgagccactgcattcagcctctttgcccatttctaacaaggatggcctttagcttccattaccttgttcttcaggtccatctgagacctcattagaatggcctttactgtccatatttctatcagcattctggtcacaaccacttaaataatctctgagaaattccagactttccctaatctttttgtcttctgatccttcaccagcactgcccttaatgctccagtcatgtcaatacagaccatgctcctagccaacctgctcctccaaattcttccagcctctgcccattatccagtttcaaagctgcttccgcattttcaggtgttcatttttagcaacaaccccactcctcaacaccaatcttgtgtcttagtctgttttctgttgctatgagtgactacctgaagctggttaatttataaggaaaagaaatttatttctttcagttctggtggctgggaagtccaaggttaaggggtcccacctagtgagggccttcttgctggtggggattgtctgcagagtcccaaggtggtacaggacatcaaatggcaagggggctagagcatgagccaatctggcttttataacacccactcttgtgataacttgataaaagctggaggctgccctcagatcaggcccaggaggccatcaccaataatccattaccatgataacccatgaatccattaaccaattaatccatgaatgaattaatccactcacgaaggcagactccttatgacctaatctcctcttcaaggccccaccccttaatactgttacattggggataaagtttcaacatgagtttcagagggaacaaacacacaggacacagcaaagaggaatctgaaaaagtggaagtggaagtagagaatagaatggtggttaccagaggtgtggggtaaggcgttgggggatggggatggatgggggtggggagatgttggtcaaaggatacaaaattaccgttagaaataattttaagagatctagccgggcgcagtggctcacacctgtaatcccagcactttggaaggccgaggcgggtggattacctgaggtcaggagtttgagatcagcttgcgcaacacggtgaaaccccatctctactaaaaatacaaaaatagctgggcgtggtgacacatgcctgtaatcccagctactcgggaggctgaggcaggagaatcgcttgaacctgggaggcggaggatgtggtgagccgagatcgcrccattgcactccaacctgggcaacaagagtaaatctctgtctcaccaaaaaaaaaaaaaaaaaaaaaaaatagagatctrttgtggccaggcacggtggctcatgcctgtaatcccagcattttgggagtctgaggcaggcaggtcatgaggtcaggagttcgagatcagcctggccaacatgatgaaaccccatctctaccaaaaacataaaaaattagctgggcatggtggtgagctcctgtaatcccagctacttaggaggctgaggcaggagaattgcttgaatccaggaggcagaggttgtagtgagctgagagggcrccactgcactccagcctggacaacagagggagactctgtctcaaaaaaaattaaaaataataaaataaaataaaaggggatctattgtataacatggtgactagttaatgacaatattgtattcttgaaaattactaacagaatagattttaagagccgatgggcttggggcacttagtcccagctacttgggaggatgaggtggaaggattgcttgagcccaggagtatatgagtatatgagtataagctatagtgagtatatgagtatatgatcatgccactatactccagcctgggtgacagcatgagaccccgtctctggaaaaaaaaaaaagaatagatttgaagtgttcccaccatacacaaaaaataagtatatgagtaatgcatatgttattacctcaatttattcgtatttcaaaacaatatttgcacaccataaagatatacaatttttatttgtcagttaaaaattaaatttttaaaaagggtaataatagtttatttgaacaatcaacataattgataaacccctgactaaactgaccaagaaaagagaaaacaaattaccaatatcaagaatggggccaggcgtggtggctcatgcccgtaatcccaacactttgggtagcagaggtgggtggatcacctgaggttgggagtttgagaccagcctgaccaacatggagaaactcattctctactaaaaatacaaaactagccaggcatggtggtgcatgcttgtaatcccagctactcgggaagctgaggcaggagaattgcttgaactcaggaggcggaggttgcaatgaaccaagatcacgccattgcactccagcctgggcaataagagcaaaactcgttctcaaaaaaaaaaaaaaagggccgagtgcaatggctcacgtctgtaatcccagcatttggggaggtggaggcgagagtcttttttgagcctaggagttcaagaccagcctgggcaacatagtgagtccttgtctttacaaaaaataaaaacaaaattagccaggcgtgatggtatgcacctgtagtcccagctactctgaaggctgaggtgggaggatggcttgagctcrgcaggcagaggttctagtgagctgaaatcatgccactgcactccagcttgggcaacagaatgagactctgtctcaaaaaaaaaaaaaaaaaaaaaggaagaatgatattcacaataggtctgatttatattaaaagaatagtagtaaataggccagtgcgtggctgggcgcggtggctcacgcctgtaatcccagcactttgagaggccaaagcgggtggatcacctgaggtcgggagttcaagaccaacctaacgaacatggagaaaccctgtctctactaaaaatacaaaattagccgggggtggtggcacatgcctgtaatcccagctactcgggaggctgaggcagaattgcttgaacccaggaggtggaggttgcagtgagccgagatcgcgccattgcactccagcctgggcaacaagagcgaaactaaaaaaaaaaaaaaaaaaaaaaaaaaagaggccaggtgcggtggctcatgcctgtaatcctagcactttgggaggccgaggtgggtggaccacctgaggtcaggagtttgagatcagcctggtgaacatggtgaaactccgtctctactaaaaatacaaaaaaatagacgggtgtagtggtggggcacctgtaattccagctactcgggaggctgaggcaggggaattgcttgaacctgggagttggaggttgcataagacaagatcacaccactgcactctagtctgggtgacagagaaggaccctgcataaaaaaaaaaaaagcatagtagtaaagatgtattatgaataagtttttgccagtgaatttataatttagatgaaatggacaaattacttgaaaattttcactgactcaagatgtaagataaaatttaatagcacatccttagataatagattagtctgtctctctaaaaaaaaattaaaggaaccacaacaagcaagttaataaattagatggccacctttaaatgaaaggatagaatagaaaacacgtgcatcacacatagtaaaggtaagtattatattatgaagcatttgctttagagagcatgtgtgtgtgtgtgtgtgtgtgtgtgtgtgtgtatagaaacacacttactaggttttttttttgagatggagtcttactctgtcacccaggctggagtgcagtggcacgatcttggcttgctgcaacctccacctcacagattccagcaattcttctgcctcagcctcccgagtagctgggattacaggtgcacaccaccatgcctggctaatttttgtatttttagtagagaaggggtttcaccatgttggctatactgatctcaaactcctgatctcaggtgatccacccacctcagcctcccaaagtgttcgggttacaggtgcgagccactgcaccggccttttttttttcaagacaaagttttgctctgttgcccaggctggagtgtagtggygtgatctcagctcactgcaacttctgcctcccaggttcaagcaattctcatgcctcagcctccagagtagctgggattacaggtgtgtgccaccacacccgagtaatttttgtatttttagtagagacggggtttcaccatgttggccaggctggtctcaaactcctgactttaagtgatccacccgccttggcctcctgaagtgttgagattacaggcgtgagccaccatgcccaaccagagttctttaaataataatagacttaccttaggatttgatttgcctacaacctaccaagaatatattctctgtgaaatatgacataaatgtgggataatgacccaagagtgcttctcaagacgagagacgtgcttttctgcatgtctgattttcaaaaactggtttgccacccaggagatgttttctcccacaycaacttggatagaagagcttatggcagacaagctgactcaacactcagactgatgtcaccagatcaaagtgaaaaatatgtagctctcatgatccaaataaaaatgttttcgtaataaaattgccattgctgtggatcagttttagtcacacttttattttatctaatgatatagtccttgctatatgtcaggcactgttctaagcatttcccgaacattaagtcatttaattcccacggcaaccaatggggtagtacaacatccccattttatagatgaggaaattcaggtaccgagtaaagaaactaaccccatagtttcaaacaaattataggtgggagacagcatgtatttcatgtgtatccaaagaaggcatgggtgaaaacaggttgaggaaaacagatttaaggtgaggtatggctgatgggtttccaagttaatgattgggaacctttaataacaattctacagtctagttgtaggtgtccatgttacagaggtagcagggctttttaaaaatttttatttttttaaatagagacagggtctccctatgttgcccaggctggtctcgaactcctgagctcagtagatcctcggcctcccaaagtgctaggattacaggtgtgagctaccatgcctggccatagcagagattttttttttttttttgagatggagtttctctctgttcaggctggagttcagtggtgcaatcttggctcaccacaacctctgcctccctggttcaagggatcctcctgcctcagcctcctgagtagctgggactacaggtgtgtgtcaccacaccccttaatttttgcatttttagtagagacgaggtttcatcatgctgaacaggctggtcttgaactccagacctcaagtgatcctcccgccttggcctcccaaaatgttgggattacaggcatgagccactgtgcctggccaagggattttgagtcttgaagatccaggtgtgattcacagttgggccctccactgactgtgtagcactgagcaagtgactggttgtctgtaaggcctcggttacttatctgggcaatgaagatcaggagatgtatcagttagctattgctttgtaatgaaccaaccttcaaagtggtggtttaaacaaccatttattattgtctgagtctatggtttggtgggtggttccgctgaccttagttggcttggcaagactcactcatgtatctgcagtcaggtggctctgctcatcttggctgtctcgcctgtgtaagggcctgaccaagggcaaatgggctgagcaggcttttctccacatggcttctagtcctccagcaggctagcttgggctttttcttatggcagtggcagggttccaggagagagagacaaaacagttctcttacagcctgggctaagaagtagcacaaaattccttccactactttccattggttaaagcaagtcacaaagatttacatgggtagggaaatagactcttctcctggggagaggagttgcaaaatcactttgcagagagcacagatacaaggggtcctggattattggggtcatttatgtaatcaacttagcagaggagacaaactctccccaaactcagaggagggtgtagaggttggtagggggcccagatatctgcattcaaagtcctgacagtgctttgtaaattgtcagcaccctaggcagtgcttctgagtgtggaatcctccctcctatgtggggctgtgagttcctgtcttagtccagtcatgcagctataccaaaatacttgagaagggccaggtggggcggctcacacctgtaatcccagcacttttggaggcagaggtgggcagatcacaaggtcaagagatctagaccatcctggccaacatggtgaaaccccgtctctactaaaaatatgaaaattagctgggcgtggtggtgcgtgcccatagtcccagctacttgggtggctgagacaggagaatcgcttgaacttgggaggcagaagttgcagtgagctgagatcgcaccactgcactccagcctgggcaaccaagtgagactctgtctcaaaaccaaccaaccaaccaaccaaacaacaaacaaaaacaacttgagaatgggtaatttataaaagagtggaacatttatttcttacagttctagaggctgggaggtctaaggtcaaggcactggcagatttggtgtctggggaaggcttgctcattgctttatagatggtgtcttatggctgagtcctcccacagcagaagaacagaagggaaaaggggctgtgaacagctaccccatacctcttttataaggtctttaatcctatttatgaggccagggaccttttgacttaatcacctcccccaaaagctccaccttctaataccattaccttggtgatcaggtttcagcatgaattttgagggacacatacactcaaatcatagcagttccttagagctggactgcatcctcccctttagtaggcccctgggaaaggctcacagaagagaaaggaaatgaagaagcagagcatttactgctcccatccctggaacaaagacagacttcacaccctctggaatctgagaagctcccttcccttcttctctcccttggacagccctgcccccacctcagagggtgccagggaaggtattacctgtcttcccactcaacagctgaagacacataagaataacttaccatcaccagctgactgcggatgctgacagggaaacttaccagggtctgctagaggggctgtgggcaggagtaactcttgcatgaatgacctgacagcagattatggctcacagaatggtgtggtgttaccttctggataacacaggtggagccctggaaacccacccccattggatctttgcatccacctgctcttctagtccatgaccttagcttccagcttgcctctcccaaccctcctccatactgccttctcaaaatactggttggattgcatacatctctgcttaaaataaagtgagctaatatttattgaacacttacagtggatgaggtgctgttccaagctctttgcttggattaacttgcttaatgttcacatcaattgtgtgagatagtcaccagtgttatccccattttacagataaggaaactgaggcacaagaggttaaagaggcttactccaggttacacagtaagtggcagagttaggatttgaactcaggcagtctggttcctgagcttgggattctcagcccataaaacccctctctgtgggcctctatttttctaataataagtaataacaacagcaataataataatgattaacatgcatggattttttactatacatatgctaggccctgttctggttgtgttacatgcattaactcatttgattcatataatagtaccagagtatttgctgtggggggatactattattaccattatttgacaggtaaggaaatggggacacagagagtcacacaacaaggatgggttactagctagttctactctacagccaagctctaaaacacttgctctgaatcatgtgccatcttgcttcccccaaagactctccccaacacagtccaagggcccagaatccaaggccctctgggttatgcagcacgatctctgcatttccaccaaagcctgtcttggtctatgcaatcttttttcttcccattcaggccagatttttggtctactattcgtttaagtttccctagagcacagcatatagtagcaggtgtcagtggatgtctgttgaattgaatcactggatgtcagaagggtttctggatcctctctcacaggaacaaagtggccactcactgtgacttgaacattagagtcagtccaggacttgctgcactggcctccaaacccactcctaacccctagaccctttttgtaaattaagttatatttaatatgcgcccagggagctttctgtttagagaagccatcatttcagcaaacacaagtgaatgctttgcaactggagtccctaaagtagcaaatcttggccctactcacaacaggttacaaacttggtgattaagcctcaggaatgaccagtgtttccctaggactatatattattttccctttgagaaggagagagggtctggaaaaatgcttctcattttgcaaaaggaagaattgagttacccaaggtcatccaacaaatgaatggtgagttgagggctagaatcctattcttttactcaggaaatggggtgaggtgacctcataagaatcacttcagattgctgtttctgtcatcagcacctgtcagctccctttttctagggaaactgaggtctaggacttgaaacttgtaaagggttatcagtgctgagtaggaacagaggcactcaatcctcactgaagacagaaacgcgaggatttgggaccttgcttaacatactcaagagcctgactcaaggccctcaggctgggattcttccattaccaaccaagtctttccataggtgggcctttcactccattcataatcatttatggagggcctactaagtgccaggcagtgttgctaaccatcttgcaaagtaggcatcataaccagcccccttagaaaagtaaaggcacagattcagagacgtaaaaacaaccaggatccgggactgcacctccacccgggagcccctccccatgtttcaggagacagtgtttccccgcacaaagcacttacctgtgccccatcatactttaagtaaaaaagtcgttgggacaaatagggccactatgcaatgaaaaaagctacacgtcaacccaaagatacacacattctaaacttttacgacccattcccaggggcagtaatggtggtgctgacggatagggaagagctctggcttccggcttcccagtggaatccccatccactcagccacctgtgtgacccacaaaagttacttttattttttaaatacttaatttataaacatcagttctatgggacacaagttatttaatgccatttgtcttcagttacttcatcagtaatatgagcataaaaatgcttctttttttttttttttgagacagtctcactctgttgcccaggctggagtgcagtggcatgatctcagctcactgcaacctccacctcccaggtttaagtgattctcctgccttagcctcccaagtagctgggattacaggcacaagccaaaaygcccagctaatttttgcattttttgtagagacagggtttcaccatgttggtcaggctggtctcgaactcctaacctcaggtgatccacctacctcggcctccaaaagtaatggaattacaggtgtgagccactgcactgggccaaaaatgcttttctcataaagttgttgggagaacaactgagataaagcacgtaaagttctgtgagagaggccaggacagcagtagggaacctgtgtgtgtgtgtctgtatccgtgtaattcatccccctctgaagcggaccaggtccccagactccccctggtctggcattccttctgcttcttggatgtaaaatccagaagtacccaggactgggacagggtgaccctggggaggccagtctgcaggaagtggctgagccaaaggacaaataatgggtggattgggccatgaagaagagcccagggtgagagacccggtgtcccgggtttgggaaagaggaggggcagggggtggacgccccagagactcttccagtgtttgtcctgggctggcgcaccggaagccccatgctggggagaggtgggcaccctgtggtgcatgaccagcctcctggttctccaggaaagatactgctacagggtttgtggaggttaaagaggtctgtgaacccaatctgtcactgctcctgatcttgttggctggtgtttttttttttttttttttttttccgagatggagtctcgctctgtcgcccaggctggagtgcagtggtgcaatctcggctcactgcaagctccgcctcccgggttcacgccattctcctgcctcagcctcccgagtagctgggactacaggcgcctgccaccacgcctggctaattttttgtatttttagtagaggcggggtttcactgtgttagccaggatggtctcgatctcctgacctcatgatccgcccgcctctgcctcccaaagtgctgggattacaggcgtgagccaccgtgcccggccaggctggtgttataaataaagttttggtgccacaaaagaaatagcactcaaatataaaattttctttttttttcttctcagcaaggcaatttacctctatagaagggtgtgccctcacagatggagcaatggtgagtgcacggctggacaagggaggggaaggggttcttattcctgatgcatgtggcctctgctgctgtgtcgttcacctattggctagggttagactgcacaggctaaactaattccgattggctaatttaacgagagtgatggggtgagtggtttggcgggaaaaatggttatggcagagcaggagatcggaatgggtcagggtggagaatgagtcagggcagagcaggtaattggaatgagtcagggtggagtaggtaatcaaaaaaggttgctttacaaggaagttaagtttaaaagtagaaggcaaagaattgaacatactgacatagtgattctttgaagagaaatttagaactcacatctagtaatccctcctcttgaatttccttgcagctctttctcttcaaacttctttaacatgtcttggcttagttgttctgcttgattttccaaaagaagaagcttctctggataaggtggaggatagttaagggaggttttagtaagtgctgtttttatgagcctctgcaccaacccatggatggatgtatgacacagcacctgataagaataagtacacccattacggctgtgagggaagttagaattgaggctattattcctttccatttaccaaaccactttttagccatgctgtaaagggatcatttacccctgagttgttggctaactattggacagagcagtcagaccttgcaatgtctttgttacagatagacagactaaacttttcttagctttaatttggtagggcttgatccaggaacaatggcccatgattctgatgataatggcacttgcttgactcaggtgtgatgtgtccatccctttccgctgtatcaaaagcagtcttggtggttagcagcacaaagtagagtccttcccaggctggcttgagtttcccttctttccaccctttgacgagaacatgatccccaggctgatgctgatgtcctggcaactccaaaggtggcccctgtgctaaaagacctcttgttttaagggaagagaaggtggaggataaaccaagtgtataattcctaagaaattgatcttttggttaaaatgtggggacatcagcagtggacttcatagtccttggtgccttcttgctgagaaattttctttagcacctatttttattagtttttagaccaaagaaagccaaataccattttatatttaacaatgcttcctgtatcatttttataccagataaactaaatttcacctttatattagtgtgttattaatgttaaattgaattttaataaaatcttgtagacatatttatctaattttaatgtctgaccataaggtaagatttttatagattgttttcaatcttttataatttttgttaaagagcaggttagtgctttaagaaaaacctgttgtgttttatttcaatgtcaagttcacagaaaaactggatgatacccatttaactttagccaatgtttacacacagaatttcctttataattgttttcaaaacttgcttaaacctttaaaacaattttttaaccttttaatgtagataaaaatccacattcttatgcttccttataaccttttaccaaggtataatttactttccttacacaccttgcacataaactgtttcttcaatagttttacattcaggaggcctcattacttttaaattatacaacatttcttgcataaattcccttttataactttttttccatgacttttacagacaattcttcgacatgcctcaactttctgacttgttgcaaacatccctttatttaaacagccagttaatttattttaggacatgaatttaccatataacattctttttacataaattctacccgccccccccacattttttttttcagttgcaagatttaatagagtgaaaacagagctcccatacaaagggaggggacccaaagagggtagacattgctgactcgaatgcctgggtttatatcccaatcattgtccctcccgcgtgctctcaggcgatagattttttgctatttctttacctcctgtttttgcctaattagcattttagtgagctctctttactacctgattggtcgggtgtgagctaagttgcaaaccccgtgtttaaaagtggatgtgatcaccttcccagctaggcttagggattcttagttggcctaggaaatccagctagttctgtctctcagtaaccccctcaacaggaaaacccaagtgctgttggggaggttggccgacgactgctctaactgcttcctgctgaattggggtgagtaggggtcgtgcagatgagatttacttgggagggstgcctttgatgtcatcaacattggagcgtgggctagcaggctggtccaggggtccacagtagatcttagtcatgggctgcatctggggctccatttgaagaacaatttgtagttttacagctttgattctggaagagacaaacttaacgaggaggttaaagatrcrgggattgaaatatatggcctgcagtataggggattatttctttggcacactttacaggccctgaatatctgcttgatagttttaaaaaggcctggtccagtaaataataatttggccacctgatgggtgctatcaatgcctaagtgaaaggtttggcgaagggttttaagtagttttcattggttagctgcaggcaaaagtatttttcctttgttggctagccatcctgagggggggaaactatgtccttgtaaggttccctattctatttctcctgttgagtactggggcttggtttcccagaggggattaccccatactaggggtccttctataagcatttttaatggagggtcctgccttgtggctcttttggcttcaatattcgcttggcggttcccttctatttccctttcctttcctttctgatgaccccagcagtgtaagactgccacctctttaggtttctgtacagccgataataatctcctgatggcttcctgatgtttgatagatgttccctcagaagttaggtattccctttctctccatattgctgcatgggcatggaggactaggtaagcatacttagagtctgtatatatgtttacccttttttctttttctaattttagtgcccragtaagggctattagttttgccagctgagcgctagttcctggagtgaggggattattttcaagtattccattatcactgaccactgcataccctgcttttcgaagtcttttttctacaaaggaacttccatcaatatacaagttgaggtcaggatcagtcaaaggaacctctagaaggtttcctcgagcggcataggtttgagcaatcacctgttgacagttacgttctatctttttttcaatgtctggaagaaatgtggctgggttaagagttgcccaagtgcacagttgcagcactggcccttcaagtaatagaccctggtatttaagtaaatggctgtctgacagccacaggtctcctttagcagtgagtatgctgttcacatcatgagatgtccacacagtaagatctctttcctgtattattttaactgcttcagatactaagattgctactgccaccattacccataaacaatgaggccaaccctttgccactacatcaatttccttactcaggtctgccacgggttgcaagctcgttccttggacctgtgtaaggactcctagagttattcctgtttttttctgtgacatataaagaaaagtcttgccccgttggcaagcttaatactggggcttgggttagggccttcgttagggcctggaaagccacttctgctttaggtgtccatcttactaaatgggtattggctttctgagtttccttaattagcgtatataatggcctggctatttcgccatacctgggaatccatatttggcagaagcctgttatgccaaggaaccctcttagttgctttagggttttgggatgaggataagccagtatgggctggatacattccttactgagggccctggtgcctttggataattttagccctaagcatttaacctgttgtgagcagagctgagccttttgtttggaaaccttgtagccacaggtggcgaggaaattcaagagcgcttgggtagcttgatggcacaaggtttctgaatgggtggctaaaagcaaatcatmcacatactgaaggacaagagtgtcaaggtatgagaactggctcaagtcttgggttaacgcctggccaaatagatgggagctatcccggaacccttggggtaaaacagtccaggtgagttgagacgttgggttcgaaggatcttcaaaggcaaacaagaattgagagttaggttgtacagagatgcagaaaaaggcatccttaaggtccaggactgtaaaccactctgcttcctctggtatttgggaaagcagagtataagggttaggtacagctgagtatagagggacaatacctcatttataatcctgagatcttgcactagcctccactgcccgttgggtttctgtactcctaaaattggagtactacaggggctattgcatggttttactaggccttgggcttttaggtccttaacaatcttttggagtccttgttgggcctcaggtctaaggggatactgcctttggtagggaaaggaggcggaatcctttaatttaacttgaatgggacgggcattcttcgctcatccatatcgtccttctgttgcccagacttcaggattaatttcttccttaagcaggggacaacaaacgggtgttccttttcctatgttcaggtgtataatggcccctgcttttgctagaatatctcttcctaacaaggatatggggctttcaggcataattagaaaagcatgtgaaaagagtaaagttccccagtcacaacttagtggctgggagaagtatctagtgactggctgtcctaggaccccttggatagtgatagatctggaggayagttgtccgggacaggagagtaagactgagaaggccacgccagtgtccaggagacagttaacctcctggcccttaatggtcaagcatacctggggctctgtgagggtgatggcatgggttggtacttgcccygggcaccctcagtcctgctgctggatcatctggttagtggcttctgactcagagggccttcgtcccctggggcagtgggccttccagtgattcccttgacataaggggcatggacgaaggggtggcttatttctacttggacaatcttttttttttttttttttgagatggagtcttgctctgtcgcccaggctggatggagtgcagtggcacaatctcagctcactgcaagccctgcctcccaggttcacgccattctcctgcctcagcctcccaagtagctgggactacaggtgcctgccaccatgcccrgctaatttttatatttttagtagagatggggtttcactgtgttagctaggatggtctcgatctcctgaccttgtgatccatctgccttggcctcccaaagtgctgggattacaggtgtgagccacctcacccggcctactttgacaatctttttaaaagtgtccttgtagactgcactggaagcaagccctattaggcattcgatttgcccagtttttcccttttccagagcctccaaagtccacttgcctgagggccatgactaaagtggtggcctcttttttatcctgtttgtcccattccacctgctcctcctgatctttattataaaaaaccaaggtttccaagttcaatagggtttctaagttttgctccaggcctaaggcggacttttgaagtttttttctaatgtctgcagctgactgagtgataaacttattcttcaagattagttggccttcaatagagttaggtgacagagaggtatgctttctcaatgcctcccttagtctctccagaaaggcagtaggattttcttcctttccctgtattatagtggacatcattgaataattcataggtttcttcctagttttccttagtccttctagcacgcaagttagcaaatgtctgctgcaccaatctccatgttctgattctgtgtcccagtgagggtctacactgggaactgcctgctggcctgtggggaatcgttctttcctctgttgtcatcttgtcattgacctgactgagataccagagatcaccaaactctcgggctgcagttatggcagcacttctctcatttgggtttagtgtctgatttagcaataacattatatctttccatgtcagatcaaaggattgtcctaacccttggaaaacatcaatatagccatcagggttatctgagaatttacctaggcctattttaatttgctttaagtctgagagagaaaaaggtacatgcactctggctgggccgaattctcctcctcccattgcttggagaggggcataattggggaatattagcactctttggttcattgtttacccctttgtctatctccttttggacgtttgggttgaaggggggtcctcattagttggggaaggagtcggggggacaccagggtagggaggtagactctagggcttcctgtaggacataaatcacactttttacataattgcgagttgtctcttaatgaaaagaaagtttgtacatatggcacttcattccatttgccttcttctctacaaaagaggtctcactgtaagatggtgttataatttatatttccctcaggaggccaggtttctcccccttgaagaggatatcatggccaggtggtactgcagaaraatataagtcatttctttcttagcgtctgagggtcaaattggtcccaaatctccagaatacatcttaggggcgtttttgccttgtggggaacrtttcccattgctttggaggtcccttcgtggtcgccaaatgttactggggggtccttgctcccagagctcccaagatggtggcgggccgcttccaagatggtggcaagcctggtgttctctgacctggggttcttggcctcacgaattccaaggaatggaatcttgggccatgcggtgagttttatagctctattagaagccgtgggtcatggaagagaactgtggaacccagtgactagtgttcagcttgattaggatgaacctgggcacttagccgtgcaggaacaatggcaaacctttagcctgattgggagcggcaatgggcgcctcgctggatcaggagcacagtagacaccctgccggatccagagggatggaagtcggcggcgggtctgcgatggcagcaaacagcagtggatgtcgagcgaaagctcagctccagccatagcaaacacggaccagaagagagtgcagttgcaagatttaatagagtgaaaacagagctcccatacaaagggaggggacccaaagagggtagccattttttcactttttttttttaacttttgttgaaaacattttaagtttggaatttcaactattctttgctattaataagacctcattcagtccatattaacttagaattggtatagatgggtccttcctgattctgtaagtgctttaaggcttggctgagtgcaaacagctctcacatttgaacaggccaattattaggcaattttcctaactctgcttctacaagagtttccttatcacttactgaatacccattgtgtctttttccctcaattacccaggaggaaccatctatcatcctgtcctgaagggagttcttcctaggtctggtcggacctttgtatggtaattaattaagatttagatcccatgttaggaaacctgctgggttaagggaattttcagtggttaatattaaatcatttttttctaacagaacagcctcatactttaaggttcttgagtcagtaagctacctttttttttttttgacttaggatagttctgacctgatgaggtgtgctcacaatgaggtttcctctaaaagttgtttttctactttcttctgttagcaaagcagttgctgctacagattgaatgcatttgggccatctgccggttactgggttaaggagttttgattagggaggttacgggttgtcagtggcctcagtgcttttgggctacatccttgtttacactgacaacaaggtggtattggagtgttatagggtcatggagaagaccttcaattatcaattacaggttttgaattttatcctggcttttaaaggaatagggtacactgttttctctttactacttctatctctctttctctctctctctctttgactctctctctctttccctgtctctgactccctctctctctctctttttcttttgagacagagtctagctctatcacccaggctggagtgcagtggcgcgatctcggctcactgcaagctccgcctcccaggttcacgccattctcctgcctcagcctcctgagtagctgggactacaggcgcccgccaccacgcctggctaatttttttgtatttttagtagagatggggtttcacggtgttagccaggatggtcttgatctcctgacctcgtgatccrccggccttggcctcccaaagtgctgggattacaggcatgagccaccacgcctggcttctgtctttctgtctctttctctctctgcctctctttctctctctttgcctctctctttctctccaacttcctctcccagtttctctttcctctctgctggtctttccctgcctctgccagctgcttatgctgctgttctcccctctccttccccttcccctagggaagggaccgtcaggagtgcagctactttttcttccccgagaagaaaggaaaggggaattctgaatatttttcttactaccggaggtttgtgtgaggtttttgatcccctgaaatttgtggaaggctcaacacctcaaaccagggggtatcttgccttgcctgacctggaaggctcaacccctcaaaccagggggtgttttgccttgctgccctggaaggctcaayccctcaaactaggaggtgtcttgccttgctkccctggaaggttgacctgtttcctccctttccccctctgaaggtcctttgcacacttcccactcgtgttgtcctctctggctgctcccccaagggagaattaggcccccctcagcattggcattccrgtagaaatcccacygcaggatcctccctaagccatatgaggtagctacggaaacgtggagaggacccactcactccgtccagcagtaggacttgtcatcatccacacgaacaacaccacaggtagggttgtttgtgatcattcacgcacacacacatttagccctccagaatttgaccaccaaggaagtaccttaccggctccctcggcttcttcctttgtctgtgcacagagttgtctctgcagtgtgtgaggatgctttaccctaggttgcctgctggtttcttttcacattgctgagagctcaggttatttcttgcactgggtgagtcctgatttctcacccctgaggccatcacaagagggtggggcatacctcctcaggagagagaaccagagactgcccctgaaggggaatgtaatcacgagcaagcccccaaattgttataaataaagtttccccccagtgccgcaaaagaaatagcactcgaatataaaattttcttttttttcttctcagcaaggcaatttacttctatagaagggtgcgccctcacagacggagcaaaggtgagcgcacacctggacaagggaggggaaggtggttcttatgcctgacccacgtgattcctgatgctgtgtccttcccctgttggctagggttagacctataggctaaactaattccgattggctaatttaaagacagtgagggggtgagtggtttggcgggaaaaatggttaccgcagagcaggaaatcggaatgaaccacggtgaagaatgagtgagggaggagcaggtaatcgaaaaatgttgctttatgaggaagttaagtttaaaagtagaaggcaaagaattgaagatactgacatattgattcttttaagataaatttagaactcatatctaacagctggcatgtctggcatggggctccggctggggcgcagtcttcagcatttggggctctggggtgcagggggcagaggacggccggggctgtggtgcccaaccrgtgctaaactcaagcttgggaggtcgcccacgagaaacagtcgcccttccccacccgcctgctcggcttggcggggagcgggatgtcgctgggggcgatgccaggcgggccgcctctgatagcctctaggctctggcgcgcttccccgcccctcccgcgcaggcgggcgtgggatcccggctgatccagtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccaggtgactgccggagcgtagtgggatgggcgcggcctgagggtactcgcagcggcactttcagccgccggacccgccgagggacaggggatggggcgggcagagcagatgtgtaactctccagaatctctccttgccctaagatattccgcactttctgagccaggtagagcacgggggaagaaaggaaacggtagtgtcaaggcaggtggtggaaggcctttccctcactgggtcaaagaggagttttgctttgtgccaaagaatctcacgattgctgcctattggaatgcgaaaacgcaagcgtgacaaccagtgggatgccaggggttgaggactttggaatcgcagagtgtaatggccaaggggatctggagagcttagagttttgttttttgtttttttttgttttgttttgagacggagtctcgctctgactcccaggcaagagtgcagtggtgcgatctcggctcactgcaacctccgcctcccgggtgcaagcgattcttgctgcctcagcatccccagtagctgggattacaggggcccgccactacgcctggctaatttttgcatttttagtagagactgggtttcaccatgttggccaggctgatctcaaacgcctgacctcagttgatacacctgcctcggcctcccaaagtgctgggcgtgagccaccgcgcctggctgagttcaagcttcttgatttgtgcatttggatcctaagagggagccagaaagaaacctgccaagtgcacagggagatcttggcaaagccaggctagaagggaagtctctctggctcctgctgtggtgtccaacccctggcaagccctttccatgagcaggtttagttccagccctccgtgggtggtctgtcaacaagcttttctccctgcgctgcctttggatcacctcagtatgtgggtttggaggcgtggaagggcctggctgagggtttggaagatgtggcttgaagaggggcttttcctctgggtgtgtgaaacactgaccccagttaaagccttcttatgtgctgagagagggagggcttgctgtatctgtgggacctgacaggtgggaaggctttacaggttgggaaccgcaggactcaggagggtgtgcctgggtgggagacagaaagagtcacagaaaattgtgttcagcagatgttccgcaagtgatttttgagttggggcagagctggaactagaacctaggtgcccgctgcactctgcagccacactttcgtggagaggaacaggagagagatatgaggaaggcaccttgcatgccagcccagggtgtagccctgcatgttgaagggggccagcccctccacacctgtgggtatttctcctcaggtgggacaagagactgagaaaagaaataagacacagagacaaagtatagagaaagaacagtgggcccaggggaccaccgctcagtatagggaggacccgcgccagcactggtctctgagttccgtcagtatttattgatcactatctctaccatctcggtgagggggatgtggcaggactatagggtaatggtggggaaagggtcaacaggaaaacatgtgagcaaaggactctgtgtcataagtttaaggaaaggtgctgtgccttgatgtgtatgtaggccagatttatgtttgactttatacaagcatctcagtgcagtaaacarcagtattgtcaccagcatgtctcacctccagccataaggtggttttctcctatctcagtaaatagaacgtaggatcgggttttacactgacacattccattcccagggacgagcaggagatagatgccttcctcttatctcaactgcaaagaggccttcctctttcactgatcctcctcagcacagaccctttacgggtatcgggctgaggtatggtcaggtctttcccttcccacaaggccgtatctcaggctgtctcagtggggagaaaccttggagaatacccaggctttcttgggcagaggtgcctgcagccttccgcagtgcattgtgcccctgggtactcaagacgggagaatggcgatgactttttgccaagcatactgcctgcaaacacatttttaacaaagcacatcctgcacagccctaattaaaccttgagtcaacacagcacatgtttctgcgagcatagggttggggctaggtttacagattaccagcatctcaaggcagaagaatttctcttagtacagaacaaaatggaatttcttatgtctacttctttttacatagacacagtaacagtctgatctctcttttccccacacatgtgttgcggttttggctggctgtaatgtatgaatttactccaaaccatccctggggccaagatatctcatatttatttagtaagataaaaaatatatctggttccagcctccactcaccaagctggctgaaaagtccaccatcagtcagtttttagggtttcttccttccagagtgagagggccctggtggtcaacccaaattggccatctcccctacacaagcacaggttcttcactgtctagttgccctctctggctgggcgctggaggtcctccttagagatcctcctgtttatccctggctctgtgcagccagctgagttctgccagctccaagagcagcgtgggcagcactagcagggatctgctcacagctcttgcctgcagaactcccctcctggttgcaaggaatccacctggctggcaggggtgtgggatggtagcaggatgggtcttcctgcacttcggctccaaacagcagcatctatatggttttcctctggagcaactgctcttcattatttttacgaacagattattccaggacagaagttttggctctgaaagcttggctctttcaggaggagaagcgggaaattacctttcaggtttccagtgattgtggttttgagtaatcagcaaaggggtggggtcctgattgacaatagctttgtaggctttgsgggggagtaggatttttttttggtttttgttatttttgttttttgtttttgagacggagtcttgctctgtcgcccaggctggagtgcaatggtgcgatctcggcttactgcaacctctgcctcccaggttcaagcgattctcctgcctcagcctcccgagtagctgggattacaggcgcctgccaccatgcctggctaatttttgcatttttagtagagacggggcttcaccatgttggccatggctggcctcgacctcccgacctcaggtgatccgcccgcctcggcctcccaaagtgctgggattataggcatgagccaccgcgcctggccaatgcctggctaatttctgtagttttagtataaacggtttcgtcatgttggccaggctagtcttgaactctttttttttttttttttttgagatgaagtctcactttgttgccccagctggagtgcactggtgcaatctcggctcactgcaacctccacctcccgggttcaagcaattctcctgcctcagcctccctagtagctggggttacaggtgcctgccaccatgcccggctaatttttgtattttttagtagagatgggatttcaccatcttggccaggctggtcttgaactcctgacctcaggtgatccccctgccttggcttcccaaagtgttgggataacaggtgtgagccacctcacccggccaggacgtgggagttttagctgaacccagcccaggcttgggaacagctctttcccccgcctctcctcccttctgcctacaactcctaaggcacccttctgtttggctctggagtccttgaatgatgggcaggtaggatctgtgactgtctgggcaacctttcttctggggctcttagcccagccctgaatcacaagggggcacctgagataagcagggctccagcaggccctgggagaacacagcgatttgtagtaaagctcctgtctgatagattctggacaaagcgatttggcaaccaagattcttttttttttttgagtcagagtcttgctctgttgcccaggctggagtgtagtggctcaatcttggctcactgcaacctccgcctcccgggttcaagtgattctcctgcctcagcctcctggagtagctaggactacaggtgcctgccaccacatccagctaatttttgcatttttggtagagacagggtttcgccatgttggccaggctggtctcgaactcctgacctcaggtgatccgcctgcctcggcctcccaaagtgctgggattacaggtgtgagccaccactcccggattcttrgctgtgtccaaggaggacacagctggatgaaggggtacctaaacaccttctgaattttcacaaaatagttcacctctctctaaactcttgagcaaatctagagaaaaatgtgtttctggtaattctgttgacgcttcacccattttttcccaccctgccccctgaataagttttgatatcttttctagaccgaagagaaggaccaccatcaatagaatagtatagctgggagagacatcacagaacacctatttatgcccttatgcctttgtacatgcagttttgttttaccctgaatggtttttcctacatctcttacaacccgcttatcaatcccactggcattgtggttcagaaggagaaaacaaaacagatggaggaggggcaatgcctcctaagtgattggtagagtatccctctcttgaaaaattgtgcatgcaggtggccacaggtttagatgttacctgtatactatacttccctgcattctccgcaaaatcaggtttccgcatgttcactgattggtctyctggaggtgcagacttactttggtgtctaggagaaaatgtctcagctgcctgacactagttgaagatttaaaaatagctgttagcagctgtgtcattaactgtcaacaggcaagaacataggaaagaatgaaaatgtgtgctgagcgtggaggggagcacattgctagctgctagctgccgtgcacaggcactctgtgggcgccttgtagcgaggtcgggggagttggtgaccggactgtcaggtggcagttattccagggtggtgaatgctctgctgatttcgatgtccttctccatactcttaggcattttttaaaatacaatgaacctgtatttatataatgaraacaaaaataaagcaaaatttgattttcattgtgagatgggaaaggcaagatgcagtactgtgtgtatagtatgattcctttgtgcaaaaaagaatatatatagacaactgttgacatggtgggtttttcataaatattttcttttcctgtaagagtacaccagaaactgttaattatagttttcctttatagaggagggactgtgcaaggagaaccaggggtggagggaatgctcacttttcattttgtatacctttaaagaatatatcaagaggattatctrgtgtgtttggggagaagtcttgaacccattttttcttctttgtagctccttgtgttagaaaaaaaatccaaagtaagtactctatcagttcaatgaattcagggaagtgctcctgacactgaggacatcagggggcagaggctgtggcatgtgctcggagagggcaggcgccaggctctggggtgtggggggtgggagggggcagtggtgcctgggtggggagaggtgcacatgagtctgagaggaccacagcttggaagcacctcctggaatatgctctggagcctgtggtgtgatgagatggggattttaaggggagaggcaaggccaggttgggttttgcactgtctggccctagtggaaagtgtgggttggaggtgcaggacctgggcagggcagcagttgggtggccgcgtgtgacctaggagacaaggatgagtctgaggcccggtgagggccttggtagaggggatggagaggtgaccatttttcagagctacttagcttggtgactggatgcaggtggtggtgggaaggaggagccagaaagacacctgtttcatttcctgaacacctggatggatggcggggcctcccctgagtacagggtacaggatacataaggaggagctggtcaaaagtcgggcaggtgatgagcttagaggaaggacagggaaggtggacaggtgacaggaatagcccagtgagctggtttgggctccattgcctcgggctgggtaggggatctgggggatgtgggatgagtggagagcctggagtcagaggtgcttaggggaggagtggaagccagggtaggggaggagggtaagaggggaggggaggaggggaagggtagaggggagaaggggaagcaaggggaggtgaggaagggaaggggagaagggraaggaaggggaggggaggaagggaagggaagggtagagggggaggaggggaagcaaggggaggggaggaagggaagggtagagggggaggaggggaagccaggggaggggaggagggaaagggtagaggggaggagggaaaccaggggaggggaggaggggaaattggggagggaagagggggaagtggggaggggaggagggggaagcaggccaggggaggagggggagtagggggaggggagtagggggattagggggaggggaggagtagaagcagggttggaggggtgggaggaatggaagcaggaggaggggaagccttctcccagaatcagagagggaagagaaggtacccagagctctgtctctccccacatctggcatcttcttatccttcaaatcacagctgaaatgtggtttcttcagataggcagcctttaagaactggaacactcactgtgagggtctgcggcttcattcttgaagtcagtgagaccaagaacccaccaattccggacacagaatgaatgtgtaaacccttccttttgggtgtggccttcagtcacagacccagcctcccaagatggggtcttcttgtttttgcccttccctgctagaggttggcaaccccctgagtagtgttcagagctgctctgtgggtgtggggatggcatggggtcaggtgcaggcagatggctggtgggcaagaaggcacctctctctcagcctcagtttatctgtgcaatgggaatggcagtaagacttaatcaaaacatggatgacatcagcgtggtgttggcacacagaaggcagccactgctggtgtatatttgtagtggtttaatcatcagtctggagctaggcacagtagcatgtgcctgtagttccagctactcgggaggctgaagtgggaggatcacttgagcccaggagttcaagtctagcctgggcaacacggccagacactgtctctaaggaaaaaaaaaacctacttgggcaggtcggctcgctgggcaccccttcaacaagcttctggaggagacagagctgcattctctagggatggcaagggcctgcccaggctgggccatgtcagagctgctggggcatgggccactggtgtctgctgcaggcccatgagacttcggcgagtaggggactgatccgagtttgttccccacagaacccagacctggactcagaggcgctgctagccctgcccctgcctcagctggtgcagaagttacacagtagagagctggcccctgaggccgtgctcttcacctatgtgggaaaggtaaggccagccaaggccagcccctccctgggaaaggtaaggccagccaaggccagcccctccctttcccctccctctgtccgcacaggctgtggggaaaacctggcctggagttagtcctgctgggggccatggtgggacctacagtgccagggactgccagggagggaaggagccagagcgtgtgcgtgtgtgtatgtatgtgtgtatgagacactgagcatgctgtcttagctagtaacctggcttttagcccagacttccctctccctcctgcctccaccccattgggcaacaagtctggtctgttcccttctttttttttgagatggagtttcgctcttgttgttcaggctggagtgcaatggcacaatcttggcgcactgcaacctccacctcctgggttcaagcaattctcctgcctcagcctcccaagtagctgggattacaggcatgcaccactacacccggctaatgaaaagaaaaaaaattttttttttttttttgagatggagtctcgctctgttgcccaggctggaatgcagtggcatgatcttggctcactgcagcctccacctcctgggttcaagtgattcttctgcctcagcctcctgagtagctgggagtacaggcacctgctaacacacccagctaatttttgtatttttagtagagatgggattttaccatgttggtcaggctggtctggaactcctgacctcaagtgatccacccgcctcggtctcccaaagtgctggggttacagctgtgagccactgcagctggcccccaactaattttttgtatttagtagagacggggtttcaccatgttgatcaggctggtctcaaactcctgacctcaggtgatccacccgcctcggccttccaaagtgctaggattacaggcgtgagccaccatgcccgaccccgtctttttttttgagatgggagtcttgctctgtcgcccaggctggagtgcagtggcatgatcttggctcactacaacctccacctcccgggttcaagtgattctcatacctcagcctcccgagtagctgggattatagacatgcacccccatgcttggctaatttttgtatttttatttggccgggctggtctggaactcccaacctcaggtgatcctctgaaagtgctgggattacaggcgtgagccaccgcgcctggcctgttctcttcttttacccagccctctcctgtctccatcccctttggccaccctggcccgccaccaccatctcccgccatgcccaagcaccagcctcctggtcaggtgccctcttgtgtccccagctcttcaggccatctcttgtactcctcctctgtgtgtggcatcacctctggccaaggccttctggagcttgggtgtcagcagctctgcactggcttgggtggggctcctttacctggaaggctgtttccctcttctttgcccctgtccgtgccacgggctcccctggctgagccttcggggctcagagcaggaggcaccgtcttccattcgccacctgaggtagggtttcctcttccaggcctactctcattctaatagcacatttctcatcacagtgtcaggcttgtcttctctatctctttcccatggggggtctttgtggacagagcttgtctcatttgtctttgaaccttagtgctcaacatgttgcatttcacgtaataaatgctcaagaaatatgtttgaaaagaaagggagggagggaggaaagaaggagacaaattgtgctttgagtgtggcctgcatgatttcttgaaagggtgtgggacagtgagtgtgacccctaggcaggtgaacttgtctgggtgcagtgtatgtgacaatgctgtgggggctgcagctgaggaagcgagcgcatgctgggctggtgtcactgagagggggcacgtacatagtctcagcagatggtcttgcttcttccctgtcaatgtccctgaaaggctcctgcccttcctagttaatctagtctatctggttagattagccttctctgttcctgcctcgggtaccccggggacagattttgcacatgcctgaatatggcaacacagcccaccctgtttcccccagatactccccaggagcaggaatatttactgaaagctgcatctcactctgccstcacctttccttctgtaggaccctgtgtggtgaggtttgagcattctaggcagatttccactattagcatgttcttcccttttgtcaagctcctactccacatggcttgattatcaaattcaagatttcctgggtaaggggaggcttgactgggctacatgtggggaaggcgtggggttgaggagagactgctgggctccgggaggcaggagtctggtctagtcctgctctgtggttgcccttcagtgtgaccagtgatggggcgctgcccctgtctggtttctgtctgcctcactggcagagatgtggcttgggggaggtgagggagtggccagtggtcatcttcctcccagctcaccccctacctggggggcacctgaggccagtatcttgctcccttgagtgtcccggttgtgccctggtcctggttgaaggccagagacagccaggatgaggcctgggccaaatgtccctagtgaggcagatgctgagccctaggtcatcctctgtgccccaggctctgggccatgttgctggttacccctctccctgggtatactttaaaaggccagttctacatgatgtatatttcaccacaatttcttaaaaaggccagcctccttttatcttatgtctacttccccttcctcaggcctgggaagtgaacaaagggaccaactgtgtgacctcctatctggctgactgtgagactcagctgtctcaggccmcaaggcagggcctgctctatggcgtccctgtgagcctcaaggagtgcttcacctacaaggtatgctctgcctcagcgccaggcctccatcgtcccctccatccctgccagcctgctctgcatcttgggtcattttgggcccttagaggaggtatcaggtccagaggccttccgaggggacactggtatacctgttttggcctgtgtgacagttgttggagtggacccttggctgcccacgggccctgactcactcccttctggtgcccatccctcctcccagggccaggactccacgctgggcttgagcctgaatgaaggggtgccggcggagtgcgacagcgtagtggtgcatgtgctgaagctgcagggtgccgtgcccttcgtgcacaccaatgttccacagtccatgttcaggttgggtcttggggtggggcggggcggggcaggggcaccggtcccagcatggcacgggctgacccattcttggctcctccagctatgactgcagtaaccccctctttggccagaccgtgaacccatgraagtcctccaaaagcccagggggctcctcagggggtgaaggggccctcatcgggtctggaggctcccccctgggcttaggcactgatatcggaggcagcatccgcttcccctcctccttctgcggcatctgcggcctcaagcccacagggaaccgcctcaggtaaggtgggtggagggcgcttctgggcccctcgctgtgtgaccttggcctagcttccaacctctctgggctccaggcggggattcggtctccggggttttgctgggaggaagcattacagtaccactggccgggcgtgggtcctagtttccaaagcggtgagtgttcagagctgctctgtgggtgtggggatggcggcgggtggccatttcctgtttccagcatcttatgtttcttatccagcaagagtggcctgaagggctgtgtctatggacaggaggcaggtgaggtccgtggtgctctcagtgccccgaggagggtgggggtcggcctgacccgcttccgcccgtgcttctcaggtggcagggcagtgtctggcccccaggctgctctaggtctgggttcctcrctccttgtctgcttacctccctcacctctctgccccacagtgcgtctctccgtgggccccatggcccgggacgtggagagcctggcactgtgcctgcgagccctgctgtgygaggacatgttccgcttggaccccactgtgcctcccttgcccttcagagaagaggtgagcagggctgggtgggcatgaatgtggaccgctgaacccagacagccaccccaggccttgtgggcaggccttggagcccctgtctcctgagaaccgtcccccaggcctctgaggccagggcgggttgctcctccacagacggccaccagatggagcccttgcctgcatttggaaatcctcaggctttttttttttttccttttctttctttctttttttttttttttttgagactgagtatcgctctgtccctcaggctggagtgcagtggcgcgatctcggctcactgcaagctccgcctcccgggttcacgccattctcctgggttcacgccattctcctgcctcagcctccygagtagctgggactacaggcgcccggcaccacgcccggctaattttttttgtatttttagtagtagagacggggtttcaccgtgttatccaggatggtctggatctcctgacctcgtgatccgcccgcctcggcctcccaaagtgctgggattacaggcttgagttaccgcgccggccggaaatccacaggctttcaaaggtgcccagcctcagctgctggcaccagggatgcaggaatcatttcccagcctgctgaccttcagcaaacagcagcctttctaacagtattcctgtccacrttttgggagcagcacgccacgctgcctgcagaccccagctcatgtagcctgttcctgccagacttgctgctacgtgagccagggtctgcaagcagcgtggtgtgctgctccccaaaataccaccacagcagcctgttgctgagacaggctgggcttgttgctttctgtggcgaggcagcactgtcttgcaaagccttaggatcatctcagagggcaggaagggtggggagatctgctgagattttgaagtctggtttaaggtggatctttcaacatgggggttggttaagattggtttaagttggttaagattggttaagatccttaatccccatgttaaggattggtgggcacagcagggtgtggattttgaggcgagaggtgtcaaccgatgcttcctgttgaagagttggaatgaatcggaaggttatttgtgttatgtgtgttatttggaggaggtgggggagtggccagtggtcatcttcctcccagctcatcccctactgcggggcatctgagaccagtattttgctctcttgagtgttctggttgtgctctggtcctggtactctctctctctctstctctgtgtgcgttggggttgaaggccagaaacagccaggttgaggctggggccagatgtccccagtgaggcaggtgctgggccctaggtcatcctctgtgcccactccaacagagtgcaggagctgtaaagttagattggtgcagacagaggaagagtgaagtcacgttaatgtagacagtaagctgtgtgacgtaagccccgtttctcagcagtccagcgattgtctatcttgtacagacctcttgccctcgccccagccaaggttgccttggaaaggctgagggtttgtggacgggaaggagagtgggccttggtgtttcttgggagtggggcagcagggcagatctgggctgggtagggtgaactccccctccccaggcagagggagatattctaaccgaacccacggggataggcagccgtgaagtccttcctcggaggagaggaggagatgaggtccctgtctggaagtctggaacagtttatcatgagagccaggacaggtggtggagagcctcagctcagaagacaggatgcctgcattccagacctgtcttgtcactctgcattgggtagctttgggcaagtcccagtcccacctaatctccctattgagacytcaagcctcagtttcctcatatgaccagtaggaatccttatccttgctctgcccacctgagtcactgtgaaggtgttttatgaaagggtcagatgcagaaggggctggcctcgctgactgcagcctcgcagctgtgtctggggctgagtagtttctctgatctctaggggtcctgcctagkgttgtcttctcctgacctgcccctgtcccctgtgttttccctccaggtctacaccagctctcagcccctgcgtgtggggtactatgagactgacaactataccatgccctccccggccatgaggcgggccgtgctggagaccaaacagagccttgaggctgcggggcacacggtatgactgcagggtcctggaartactggcatctcctcccctcacgggaagccttcctggtacccatggctactccatccctggcatcctggcactctgacgatgttgtcgtcggggtgaactgtgrccctgtgggacaagtatatagagggctgatcaagagtattggagtgagtgattgatggagaactttagccctgtgctgtgtgatgtgtgagcactgcatgtggggaggctcttcagctctaaacagtggtgcacagctgtccagaggctcccagggccagtgggttttggtctggtcattacacaactttatgtgtggctccagacttctctcatgctgtgcattccacagtgagttttcatgggtcagtaaggctgcctttgtagctctagtgagagctatcttgtgggcagggttggtccaatccatcctcagggccgcccagacagcatggggatcatgaagccagttgttaggtcaggaggccttacacccctcaatccctgcagctggttcccttcttgccaagcaacataccccatgctctggagaccctgtcaacaggtgggctcttcagtgatggtggccacaccttcctacagaacttgtgagtgatagtgggctttggggtcttggtgggatcagacaagtaggcagacctgggggagcagcagggtgtggtgatgcctggatgggccttagctgaatccaacaaaggcctgagcactctgggcagggacctcgctgtccctccagctgggcacattgagcctggagatcccttgccagggtgccagcccgagkggaggctgggttgagtatctgtggcctacccctgatctgagcttgttgtgaggtaggaggtgggcaggaggttgcctctctgtttgggaaggatttgggccaagggcaggatccaggcaggagggtgggggtttggacttgatgctgtgactccaggctctgtctgacttgagccaagtcttctttttgagcaggacctcagctttctctcctgtaaagtgggtgggttggaccagactccctttaagggactttgcagagctcatttttagagaagttcgttcctctgggatgcttctagtcattaaaggtgtcaggggcagagaacaggcctgcaaaggtgcctcctggtgacatacctctgctggatggactggaacccttcagaacacagtcccccttcctccacttcactgatggagaacttggccctgcagcctggagcttggccctgcagcttcactcagtcaagggcccagcctgtcatgttcctttccttcccctagcagccaagtgtggtccaggcttcagtggaaggggtcactcctcactctggccctgggaatgagtccccaggatcagctgcctgagacctttccctgagatcttgagccagagatagcctcagagccctgcttcatgggcagcccaccctcgatttccccacctgtgcctccaggctgtacctccctaaggggaggtaccctcagggaggcctcatcagggagatgttgccctcagttcttagagctctgagctgggtttgctggagagggataccctgagtcctgccttggggagctcccgtggatgtgggttgcagcccaggcatcccaaaggatcagcagaaacaaacggcatgtttggaaggagggagctgagtctggtgaggaggaggtggacaggatccctgcatagagaatgggattgctgtgggccgggcgagcaagctgggaaggatgtggggatgggagtgcctggaccgagcattttgyttcccagcaaaggtgatttcgtggacccctgcctgggggacctggtctcaattctgaagcttccccaatggcttaaaggactgctggccttcctggtgaagcctctggtgagggcacaaggagtggaggggctaggatggctgggggggaacctagggcctcctatcgcatgatcccccatggcctccctcagcctctcttggtttgggcaggcatggcctcctcttctctccagtccccacccagactgctctcctcctctgtcccctgcgatcttcagccaacccgcatgctgaaaggggtgccgacctgggccctggggggaggcatggagggaggggtccccagtggcttggcctgaagaaggttgacgtctgccgtggcccagagctgagtcaccgaccctgcgtctgtcctgtgcagctgccaaggctgtcagctttcctcagcaacatgaagtctcggtaagggttcttctgtgtctagctgccggcccctgcctgtcctgatccgagtctgggtctgggtagtttctgacaggaaaggacttgagggaagtagcctctgaggctggaagtggcccaggcaggggggcaacctttgtggccttcagatgggactttgaagttgtcttggcaaggtccagttctggctggagagcaaaggcctgagggggacaagaggatgggggagttggaggggaggaggttgacctggctggggcatgagtggaaaggaccaggaagtgggggttggcctgggccaagggtggggcacccgggagagatgccactgttagagatctgagctgacctgagctgcgccaggccctacttgccccttagtggctggggctggaaaagcagggcgtaaacctccctgtttcatgccctgacgtcccatggactcactccttcccttaccaccaggcttcaggactggcagcagctatggcctctcccgtgtcctgagggtagcgaggaatcgggcctgggctagtcctggctctgctgtggagtcaccaagtgccagcctgtgcccctctggggcctgattttctcatccagacagtaggggtttgaacttccctctcagagctcccatggggttgtgaaggrtccacggargggtgagatctagagggttggcagtaggggtctgatgttgctgatctccgtggctgtgaccatcatggctggtgaccacactccttctgcccagttcggctggaaaactctgggaactgcagcacgagatcgaggtgaggccagagcctctggattggagcagggtggtggggggagggtggagttggacagggtacccgctagcagtgtctcgtggccactgcccccatggggctcctagactggcctgtcatcccccttccactccctggaccaccacttgggcccagctctctgacccttacttgcctagatgcccatcctttgaggctgggtcagccccaggctcctgtcctggccgcctttttgcccctctggagctgcctttgtgtggctccgcctcagcgggaagaggtgtatccacaattcattctggaggcagaacgactgatgccctctgagaggcagcactgcctgcccggaggacctgtgtcccactgtggctctgttcagatccaggggcaggtgmtggggccagagccaccccagccacagtccctgagttaaagagcctggggtgggctaggtctgagtgctttcacctggtgtgttgtgtcctcygcaggtgtaccgcaaaaccgtgattgcccagtggagggcgctggacctggatgtggtgctgacccccatgctggcccctgctctggacttgaatgccccaggcagggccacaggtgaggcccgacaccctgcctgtcccttctgtgaatctggccatgtgccctgcagggctgcgaggaaatggaagaagagccctctgggaggaccctgccctctcggggcccacagtctggctgactggagacatggcagtcatgtgggttgccctggcagggattgattttcctgtcatcagcactattcaagttggggatcttgagttacagaatctagtttggggaggtgatggtttgaagtccaggtgggatttagataaatcaagaaaataggggccagggcggtggctcacacctataatccgagcactttgggaggctgaggctggaggatcacttgagcccaggagctcaagagcagtccaggcaacatagtgaggctcctgttgctacaaaaaatagaaaaattagctgggtgtggttgcatgttcctgtagtcctggctactcggggggctgaggcaggaggattgcttgagcccaggaggtcaaggctgcagtgagttatgatcacaccactgcactccagcctgggtgacagagtgagactgtctcaaaaaaaggaaaaggaaaagaaaacaggaacagcattcccagtggagaaagtacatgggcaaaggcatggggcaaacatcagtgggttgtccagcccggccctgaaatctgaattcctgggctttgtcactcagacctcagtcctgggagagagcctttctctggctgtagacacagggtgccatttcatatgaggtttgactcaggcccggagttggcactgaagattctcagggcctgctgcagctgcctgtaatgtgttccaggggccgtcagctacactatgctgtacaactgcctggacttccctgcaggggtggtgcctgtcaccacggtgactgctgaggacgaggcccagatggaacattacaggggctactttggggatatctgggacaagatgctgcagaaggtgaggactgacctgcccctcaactggactcactccccaccctgactctggccgctgtggaggaaacagtaccagcactgcgggtttgccagcctttcttaagcaagacctgaaggactatggcctggccctacrttgtggcctctctctagctgggtgcttcctgggcctgggggtggggagtcctgccttgctaaccctatcctgatgcctgtatcccctatagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacagctcctcgtctgtgtggtttctgggcgtcatcgtgagggtggggtttggagcctgttgagagcagggctggcttgactgtgcatacccaggctccagccatgccagtctcctgctccacaacctcccctggtgcccatcacccacaggaggggtgcaggcttgtatcccccagcacttcggccgtgcccctcctctctcacctacactaagccctgctctgctggacactgcccttggtctccttccttcttctgcttctttccctgcctagaaagctctttctgttcctctgctttctatcctttgagacctgactcagatccttctctctccaggacacctttcctcctccctctgggccctggagtatatgggctatttcttcccagtctgccctgtgtggtgggcattggtgggtgtgtctgcctgccttagcacactggctttccttgacggcagggaacccattgccacatctctgtcttctgtggccagcacggcagcaggggaagcactgagttgggttgcagagagtccgaagtgctggccctgagctgctgctgtttgggagaggagcccatgggcctggggaggccggcatgagacaaggtgacctggtagagtgtgctctcagggctggccaaggcctggattgccctgggaaggtttcctgaaggaggtggacgtgtgttgagtctagaagttttccagagactgagctaggggttgaggacatctcagagagaagggacagtatgcccaaagatcagggtgggtttgctaaatggcaggcatgttgaatgggcacaggggaagcagagatataggtgaggacagatcaaggtggacttgggcagccaggtcaggaacttgagttctgtctcaaggacagtgggactctggaaagatcatagctcggcctgaggactagactcgtggggcaaaacctgtagaagggtaaagaagctgctccatgatccctaatttggggagaggggcctaaagcctgaaccttggcccaggggtaaagaggggccctttgggaattgacaggatggaggtgagctgtctcagctcgtctgctatccacctcttactggactatgtcacctggctggtagaaaggtggcatctgtagccgaccctaggagtttccttctttttttttttttttttagcagagtttcgctcttgttgctcaggctggtgtgcaatggtgtgatctcggctcactgcaactccgcctcctgggttcaagcaattttccacctcttgggttcaagtgattctcctgcctcagcctcctgagcagctgggattacaggcatgcgccaccatgcccggctaattttgtatttttagtagagacggggtttctccatgttggtcagactggtcttgaactcccgacctcaggtgatccgcccacctcggcctcccaaagtgctgggattacaggtgaaagccaccatgcccggctgaccctaggagtttcttaaccccattagcccagttgctttgctcttccctggccccagccctaattctcctgctggctggagatgtttcagagcctgagccctctaggtagggcaggtccacggctcctacctgtctgtctcagattctttctagaagagttgccttcccaagacttccttctccaccctggttttcatactcctccagaagtgctttgccctccaggttgccacacccattggcgcctgcaccatctcccagtgccatccctgcctctgtggggccattttcagggcagaggtgaggtcccaacctacatggggacacccagattgggacatctaggtagatgcygcactttgccctgatttcttgtaaccactgctgtaattttgcctttttcataaaaccactaccatctgccccagcttcctcctcctgccccatttctctctttcagttaccgatatctttgtgccttcagacacgaggctgcagagtggaggtgccttcactcgttcattgattcagcccttggagcctcagcatggccatgtccagacctcagctgacctgagtcaagcctgggcttctggggacgtggacattgacacaaacacatctgttcctcctgtgattagggctgggggacaggatagacaaggggtcaaatgctgccaaggggagggggaagtggtcactgaggctagtacatggccactgtgtttcatctccaccaccatgctctagtccaagccacctccctcatctggacgctgcagtgacttcccttctgggctccctgctttcaaccctggctgccctctaatccattctccacacagagctggaatgatcttttaaaagtataaatcaggctaggcgcagtggctcatgcctgtaatcctcgcactttgggaggctgaggcgggtggatcaccgaggtcaggagctccagactagcctggccaacatggcgaaaccctgtctctactaaaagtacaaaaagtcttgacaggcatggtggcgtgcatctgtagtcccagctactgaggaggcttggaacgtggctccaatgtcaccttccctgctcacccatttataaaacggcctcctttatttctttttctttttttgagacggagtctagttctgttgccaggctggagtgcagtggcgcgatctcagctcactgcaacctccacctcctgggttcaagcaattctcttgcctcagcctcctgaatagctgggattataggcaagcgacaccacgcccaggtagttttttttttttttttgagatagagtcttgctctgttgcccaggctggagtgcagtggcgcgatcttggctcgctgcaacctccctctgcctcccgggttcaagcgattctattgcctcagcctcctgagtagattgaattacaggcacgcgccaccatgcccaagctaatttttgtatttttagtagagacagggtttcaccatgtcaaccaggatggtcttgatctccttacctcgtgatctgcccgcctcggcctctcaaagtgctgggattacaggtatgagccaccacgcccggccttggtttcttgattatctcaagctgggccctgcttcagagctttcatgttagctcttctctctgcttggaacacgcagctccaatgtcaccttccctgctcacccatttataaaatggcctcccttgttactctcttttcttttttctttttttctttttttctgagacggagtcttgctctgttacccaggctggagtgcagtggcatgattttggcttactgcaacctctgcctcccggattcaaccaattctcctgccccagcctcccaagtagctgggattacaggtgtctgccaccatactcagcgaatttttgtatttttagttgggacggggtttcaacatgttggtctggctggtcttgagcttgtgatctgcctgcctgggcctcccaaagtgctgggattacaggggtaagccactgcacccgagcccttgtttctttctttcttttttttttttttgttttttttgacagagtctcactctgtcgcccasgctggagtgcagtggcacaatttcagctcactgcaacctccgcctcctgggttcaagcggttctcctgcctcagcctcctgagtagctggtattacaggcgtgcgccaccacgcccagctaatttttgtattttagtagagatggggtttcaccatgttggtcaggctggcctcgaactcctgacctcatgatctgcctgcctgggccttacaggcatgagccaccacgccctgccccttgttactttctaataggttaccctttgttctttttttttttttttttttattaagacggagttttgctcttgttgcccaggttggagtgtaatggcaggatcttggctcactgcaaactctgcctcctgggttcaagcaattctcctgcctcagcctcccaagtagctgggattacaggcatgcgccaccatgcccagctaattttgtatttttagtagagacggggtttctccatgttggtcaggctggtcttgaactcccgacctcaggtgatccaccctcctgggcctcccaaagtgctgggattacaggtgtgagccacctcgcctggccaccctttgttctttgtagcattatcactctctgagctctttgatgtttttttgtctcctccactaaaccataagcttcctgagagctgtgctttgtcttgttcatcacttgttcttggcttagaggatggtgctccacaaattctgggatgataaagtgtggctgtgtgaggggccaaggcactgtgctgggtgctggcagtgacaaatgaggcagccctggcccctgtcctcgtggagctcacattctggagggatttgttgaatgaacagaagggggacagagagttgtgctaatgaagacctctaaatatttaatgtctggagtgataacatgacttttgatccggaaaaaaggggaaagggaattctagaccacatttactgagtacctactatgagccatctactttctgggcacttcacagtcatgccatttaatcctctgtgaaccctatgatgggcatttttgccccccttttacagaaagtttacgtatcttgcccagggtcccacagctagaagttgggggcttggaaccgaaagctaggccagtctgtcagcaactgcatgaggtctttctgttgatgccaagccccagtgagtacgatggccagaagagtgagagcacaaatcagcctcctcctcatacctctctgaccaccagtgtgctggtggctactgcctgttttcatggcctttccccttctcaccgggtccactgccacagcttctttttttttttcgagacggagtttcgctcttgttgtgcaggctggagtgcaatggcgagatctcagctcactgcaacctctgcctaccggattcaagtgattctcctgcctcagcctcccgagtatctgggattacaggcgtgtgccaccatgcccagctaattttgtatttttagtagagatgggatttctccatgttagtcaggctggtcttgaactcctgacctcaggtgatctgcctgccttggcctcccaaagtgctgggattacaggcgtgagccactgtgcccggcctgccacagctttttgcctcgcttccctgggctccagactggacatctccaacaatctttcacatggcagttaggcaatctcatgcttaaaatctttggactcacttgtgccaagtccagaagccttgttatgacctgcaaggccatgattaacctgaccctgcagctggcccctgcggcctcatctcctgcccttcctcagtgctcacagcccggccacgtggcctgcaggtaatgttcagaacaccgagtgatctcccgcctccacgccctttgctcttggtgcttgctgtgcctggagtgttgttcctggggtctccacctaaagaccacctactcgtccaaggtgagggcaattgctcttccaactctgtcaggctgtgttgaaagagcttctttgtgcttctgcacgtggtcgaaagcaaggtctgtgtattaatagaacccaacatctgttaggctgtggagttgaatacccattatctcatttggaaagtgggcattactatttccatttaaaaaatttatttatttatttattttttgagacagagtctctctctgtcgcccaggctggagttcaatggcacgatcttggctcactgcaacctctgtctctgggttcaagtgattctcctgcctcagcctcccaagtagctgggattacaggcgcctgccactgtgcccggctatgttttgtatttgtagtagagatggggtttcaccacgttggccaggctggtttcgaactcccgacctcaggtggtccacctgccttggccaaagtgctgggattacaggcgtgagccactgcgcctggccttttttcttt

SEQ ID NO: 12281 - DNA, 12545 bp, Homo sapiens
acttagacatcatctgcaaatatttacagcgtctgccctgagtgggaactgcctgggcaggtctgagatcaagcactggaggagagatggggaaaaggcagatgtgaaaaaaacacttcttaaaaaaagggatgggggttgtctggaagtcaggggcagtttccttaatgactgacttgcatgaagggtaagaaagagattggtggtagaaggtcttaaaataggatagaagccaagaaccatatttttaaaagctgtcagtagtccaggcgcagcggctcacaactaggtaatcccagcactttgggaggccgaggcaggtggattgcttgagctcagaaatttcaaaaagaaaaacaaaatcagctaggtgtggtggcgtgtgcctgtagtcccagctacttgggaggctgaggcaggagaatcacttgagtccaggagccagaggttgcagtaagctgagattgtgccattgcactccagcctgtgctgacagagtgagactctgtctcaagacaacagcaacaaaaaagtccattactgtagcaatagaagagggagctcttgagttgagaaacgaataaagctatcctatcatctcctattcactcttcaattgggatggtccagaaaagaacaatccattcaaatatgacaaccaaaagagaagtttaaaatacaatatccatacaagataataaaccaccaagacagaaattgaagattgcaattaaaaaaaaaagtcacccgaaaattgttgctacaaatcaagggaaaacgtaacaacaatcaaacacaagaaagaaaagataagaaaagaaagaaaagagaagaaagaaagaagagaagaaagaaagaaaagagaagaaagaaaagagaagaaagaaagaaaagagaagaaagaaagaaagaaaaagaaagaaagaaagaaagaatgaaagaaagaaagaaagaaagaaaagaaaagaaaagaaaagaaaagaaagaaagaaagggaaagatccaccgaggcgggtggatcacttgaggtcaggagttcaaggaaggaaggaaggaaggagggaaggagggagggagggaaggaaggaaggaagtaaaaacttgaagcaattacaaattttgcagcagttataggaacatcacaggtcagaaatagggaaattcaaaaaagttacatccagacaacaggatggggttatattagagagtagggaatggggaaagataagaaagggacactggacgggcttctatttcttgacctgagtgacagtttcacaggttttactttgtaacaaacagttcattactttgtagaagctgtacttacattcacttttctgtttgaatgtcatttttagcaatatggtttaaaataagttagtattgctaggcacagtggctcatgcctatgatcctagctctttgggaggcccaggtggaaggatctcttgagtccaggagttcaagaccagcctgagcaacatagggaatcctcatctctacaaagaattaaaaaaaaaaaaaaaaaacaagccaggcatggtagcatgcgcctgtggtcccagccactcaggaggctgaagtggaaaggatcacttgagcctgggaagtcgaagctgcagcgagctgtgatcgcatcactgctgtccagcctgggtgacagagtgagaccccatctcaaaataaataataataatgctaaatttaaataggaaatattctatactaattcacaaggtaaaaaatatatatattttttctagctctgtccagtaaaatagcctatcgaagcatttgtgactctaataacaacgtgtgcctctagagcctagacttgtctctaattctattccttgctaaaagttagaccaagaatttcctgactccaagactgggaaaaggaaggtttaagggagactggtacatttcgtgccagaaaataagggagctttcaaagattaggactgggtcaaaaggagacaggaagtgacatcaaggaagatagcagggtaggaagcaccaggaacctgtatcctcagcaaggtaactatcacactggcagcatttgtctgttataagttttttggaacaatgaagggtattaaaggcttgtaacttccaaaggaaggctttgaaagtaaattgcagttaattttggtcaacctaaattcttaggtaggtagtagctaccgatacacaccccatgttcctggagcaacttgcatgcagcttgcaggagccagagtgggcaataaaaaccttgtccttggccgggtgcggtggctcacgcctgttatcccagcactttgggaggccgaggcgggtggatcgcaaggtcagaagatcgagaccatcccagctaacatggtgagacccatgtctccactaaaaatacaaaaaaattagccaggtgtgctggtggatgcctgtggtcccagctactcaggaggctgaggcaggagaatggtgtgaacccgggaggcagagcttgcagtgagccaagatcatgccactgcactccagcctgggtgacacagcaagactctgtctcaaaaaaacaaaacaaaacaaaacaaaacaaaaaaaaccttgtcctccaactattagggaatctatatcctgattgttatttgctgtttctgattatgaggtgcagacagaggttggcagccattatggcaactcaacccccaatgttacaaccccctccccttcccactgaagagacttccagatatgaatacaaatatccaagaagctcaacaaaattcaagtaggataaactcacagacctataccaagaaacattataataaaacagttgaggccaggtgcggtggctcatgcctgtaattccaacactttgggaggctgaagcaggtggatctcttgaggtcagaagttcaaggccagcctggccaacatagtgaaaccccgtctcaactaaaaatacaaaaattagccaggtgtggtggcgggcacctgtaatcccagctactcaggaggctgaggcacgagaattgcttgaatccaggagacagagtttgcagtgagccaagatcgcactattgcattccagagagtgagaccccgtctcaaaaataaaaaataaaactgtcgaaagcccaagacaaagagagaatcttgaaaatagcaagagaagtgactcatcacttataggggatcccacaaattaccagtagctctttcatcaaaaaccttggacactaaaagaccatgggttgatatattcaaagtactaaaggaaaaataactattaaccatcctatatacggcaaaactgtctttgcaaaatgaggaagaaattagacattcccaggtagacaaaagctgagagatcattaccactagacatgtcctgcaagaaatgctaatggcagtccttaaggttgaaatgaaatgacactagatagtagcttgaagccatgtgaagaaatctgtcataagaaaaatttctgataagggtaaatatatggacaattgtaaaagtgagtattattttaactttgatatataactccactttttgttttctacatgatttaaaagaatgcataaaatttatacttttattttttgacatacgatgcataaaaatgtaatttagtgagatcagtaactgaaaagaggtgggaatggagctatacagaagcagtttttatgtgctattgaagttaatctggtataaattcaaattagaatgttataaactaggatgtcaaatgtaatccccatggcaaccacaaaggacatagctagagaatacatacaaaaggggccaggcacagcagctcacacctgtaatcccagcactttgggagaccgaggtgggtggatcacttgaggtcaggagttcgagacaagcctggccaacatggtaaaaccccatctctactaaaaatacaaaaaattagccgggcgaggtggcgggcgcctgtagtcccacctactcgggaggctgaggcaggagaatggcgtgaaccccgggggcggagcctgcagtgagccgagatcgtgccactgcactacagcctgggcgacagtgagactccatctcaaaaaaaaaaaaaaaaaaattagccaagtgtggtggcacgtgcctgtagtcctagctactcagaggctgaggcaggagaatcacttgaacccaggaggtagaggttgcagtcagctgagatccagccactgcactccagcctgggcaacacagcgagactctgtctcaaaaaaaaaaaaagaatatatacaaaaggaaattgtgttttaaggaaatgtattttcactacaaaaaaaaaatcaaacaaaaagacaatgctggaaatgaggaaaagaatggcagaattaaatcattccttgaaagtaaaatactttggaaagtaaatggataatactttccaaaagacaatttggcagaatggattaaaaacatgatccaaatatatgctgtatatatatttagatccaaacaccacaataaaccaagtagatctaacagacatacacagaacactccactcaacaatagaatatccattcttcgaaagtgttcatgggacattcttcagaagaccatatagtagatcacaaattaagtctcaatagatttcaaaataaacttttctcttgccgcttttagaaaaaaataaaaaaaaaaaggtatcatacaaagtatcttctctgacccacaaccagataaactagaaaatttacaaatctgtgtggaaattaaatagcactctctgaaacaatcaatgggtcaaataaaaaaatcacaatgaaaattagaaaatacttagagaccaataaaaatgaaaacataactatcaaaactaatgggatagatacagcaaaagcagtcataaggggaaaacctactggtttaaatgctttcagtaaaaaagatctcaaaccaacaacctaactttataccttaaggaactagaaaaatacactaaaccccaaaccagcagaagaaaggaatgaaaaaaatcaatgaaactaaaagttcttaggaaagattaacaacattgccaaacacttagctagatcaactaaggaaaaagaaaagactcaaatgattgaacatgagaaatgaaatcggggacattattaccaattttacagaagtaaaaaggattataatacaatattatgaaaaattgcacaccaacaaattggacaacctggataaaatggacaaattcctagaaacacaaaacctatcaagactgttacaggctgagcattttgagactacgaagcaggtggatcgcttgaggccaggagttcgagaccagccagggcaacatggtgagaccccccatttctacaaaaaaaccctaaaaattgccaggtatagtggcaagtgtctgtagtcccagctactccagaggctgagatgtgaatggtgcgatcaatcatggttcattttgggctggaatacagtggtatgatcatggctcactgcagcctcacgtgacaaaagctcagctcttatcctaactttgaagattgctaatagaagtgaataaattaagcatttattctgcctctaaaagaaaaaaaaattcaaaattaccaaataattgcagttaaatattacttcctactttacagaagaatacaaactaataaatgtagaatgaatggtggaattagaaaatttattttgctgccaggtgcagtggctcatgcctgtaattctagtactttgggaggccaaggggggtggatcacttgaggtcaggagttcaagaccagcctggccaacatggcaaaaccctgtctctactaaaaatacaaaaaagtagccgggcgtggtggtgcatgcctgtaatcccagctactcgggaggctgaggcatgagaatcgcttgaatttgggaggcagaagttgcagcagtgagccaagatcgtgccactgcactccagcctgggggagagagtgagactctatctcaaaaaaaaaaccaaaaacggccattcatactgcagtcggtcagtattcggttgttggattcagtgtgctatcggacccaaagggtgatggcaccgctaggatgaagctcgtgagatttttgatgaaattgagtcatgaaactgtaaccattgcattgaagaacagaacacaggtccatggaacagtcacaggtgtggatgtcagcatgaatacacatcttaaagctgtgaaaatgaccccgaagaacagagaacctgtacagctggaaacgctgagtattcgaggaaataacattcggtattttattctactagacagtttacctctggatacactacttgtggatgttgaacctaaggtgaaatctaagaaaagggaagctgttgcagraagaggcagaggcagaggaagaggaagaggacgtggccgtggcagaggaagagggggtcctaggcgataatgtctctcaggattactgtttcaaagtcatacgggatttgggatattttttgtacaggttgtgtttatgtcagtttttaataaacataaaagtgggacaaaaaaatgaaaaaaggaaaagacataaaggaaaaggaaatttattttgccatccctaaggaaatttaattgaggaaaaatttaaatttggtgttaaaaccagtaggtgaatggctggtagggaactggacactggatacacaaaaggcagaatcacacagattactttctgaccacaaggtaaatttctacagagagatcaatgaggcttttcgctaccttaatacaagtatcaccaaatggtagccagatgtgtctcctgatgtaatgcaagatgaaacctaccatacacatgaggcattcttgccaaaaatcttgaatccagttaagctgtaagatctaatcataacttaaaggtaatacaagtgatagaagataaagctaaatgttatcatgaggaagcaatctgatatatcggaaaggaacattctataagacaaaagttagcatcatgaaaaactgaatcccaatcatgaaaaaataaaactattctaatttcagagactcaagggacataatcaccagatacagtgtatggtcttaaattctggtttggacgtaccagctacgaagtacattttaggaatagctaggagcatttgaataaggcttgcatctaagataatttaaaggaattatcggctgggcgtggcggctcatgcctgtaatcccacctctttgggaggctgaggcgggtagatcatttgagggcagaagattgagaccagcctgacaaacatagcaaaatcccgctactaaaattacaaaaaattagctgggtggagtggcacacgcctgtaatcccagctacttgggaggctgaggcacgagaattgcttgaacctgggaagcggaggtttcagtgagctgagatggtgccactgcaccccagcctggacaacagcaccaagaccctgtctcaaaagaaagtgtatatatatatacaattttgatacgtttgattatgtggttttggctatagagaaaaatgttcattttttaaaaaaaactctagaagagttgggaagatcttgttttattttttatttaattaattttagagacaggatctcactatgttgcccaggctgaagtgcagtggctatgcccaggtgtgatcgttgtggaccacagcctaaaactcctgagctcaaacgagccttctgcttcagcctcctgggctgctgggactacaggtgtgagccaccatgcccagccttatctgttttatttaccactatatgctcagcaactagcataagacagacatataataggaactaggtaaatgactattgggtgggcacctctggggtgctcagcctctcctccctaactctcagcaatggccctcttgttttcccagtccttcatggcaaattaagttgtctaaacatgccttcaccactactttgccttatgagtctcccaaatttgctctggcctctatctctccacagaaccagctttcataaaggtcaccactgatgacttccatcccactatgaccaagcagcactttccagactcctcgcttgaactctcaggagcttatacgaccactggccacacccttcttagaatgcttggcctctctaacacgcatggccacactttccaagtttttctccttcccttctctcagaccccctccttcacagtttcttttgcagatttccctttccctgctctctctgggcaagcttccccatgccagtggttttgtttctgtttacagtccaactattcctaaatctggaatcttcgctctggcgaagatggctcctgaattttccagctacctattgtttgagtcctttcggatggcccacatgctcttctaatggactatggccaaaattcactagcatctttgcccacctccctcaaacaacaaattaatcttgtccttctcatccttcactctctctcagaaaatgtcactattgtcacccaattgtgcaagcaagaaatctgttactctagatgtctccctcaccacccggggaccaatgattgtggtctctgcctccaaaacatctccacaatctatgatatatttagcttctccatctccactctcacttctgcaggtaggccgccatttgaattctcacctggattatcacaaaagctttctaactgttgccttgaatccagcccacatccaccagggcactcctttgaaaatgcaaatctaattgagacagattatgtttaaactcatcaatggcttcccactgttcttggaataaacaagccctgaatgatctcaatggtgtccctggggccacccttccatcactgtctaggccctggtctttcagttcctcctaagaggaagcatgcagcctgtggtctcagacctgggaacctttcacctgacgggttctttagtcccagaacagagtctcagctgtctcctaagcctcccaaatcgggtcaaacacctctggtatctgctcccacgcgcccctgacttcttcttcatgtaacgctgtacaattccaatcattcagttaacgatttattcatacaattttatatatatctgtttcatggtaaattcatcattgtatttccagggtctgggaaaagcctaccacttagtagggctccaattaacatttttggggttttttttttttttcctgttgtttcctgctcacttcctaacttggtctttgctgtcctgcctactcaagtccctcaccagaaagttgcctagaaccctcttacccgccacgcggccaacacaagctctactgctgggcgaacattgttggaataaacgacgtatgatttacaccctcaatctcacaaccctccctttccaatccctccccagtctcccatccctccctttgcaacccctccccaatctcccatccctccctttgcaacccctccccaatctcccattccttcctttgccacccctcccctcggatttctacccctcgggtttctgcttccctccgcctcacctctcctccaaggcctcccctccccgccgccccctagcctgggcccgcccggcctgccaggggctggcacctgactcacctgggcagcctggtgcgccgcctgccaccggctcagctccccagcctcctgttccatctcagcctgcggtcggccgtacatgaagactgggtggggtctagactctctactgaagagacagggaaccagccaccacggcgtcgcaggcgggtatcggtacatcgccacgccacaatcaccttctatttacctatttacagctgcgccaaggggcggggtcaggccccacccgtcccgccctgcgccgccctcgcagccctgccccaggctgccacccaccctcaccatgccccaaccaaggcagcctcacggacagccagccacttcaggccttgaacgcttcttaaaggaatttggtccgcccacccaaccgacccattccacccctcagtctgagcaactgtttcacccaagtggggactgaggacacccaggtctccaactccagccaggaggaggctggagagagaggcgaggctggagagagaggcaaggttgggtgtagggcctctaccgataggagagcctccaccagcactctctcaggtcgggatcttgccataagctttggaagggctggagcttttctgctacagtctgtgcacctctgtcccttgtctgtacgaactgaagactgggagcttcatggcacaacctgtttattccgcagtgtttactgagtgccccgtgtgtgttgggcactgatctctgaactaggggtaaaatagtaaacaggacagaacaaagtccttgctgtcaatttccatcttatacgggaagacaagaaatgagtaataaagttgttaactattataattttaggtggtggtgagtgctatggaaaaccaaaacagaaatgtgagctgaaaatgaaatgcctgaaaggagccagccataggaagattgaagggctctaaggcaaaaaagagcccaacggtgctagaaggaaattgaaggcaaggtgaccacggtgataccacatggacagtgacacgaggacagagggatagggccttgaagaccatagaaaggaatttggattttattctaagtgtggcgggaagccactgatgcttttaaacaggaatttgatgtgatctgatatatgtttttaaaataaaccatttggctccttatggattataaagggccagaggggtgcagagacaccagttagaaatctaaaggagatgaggctgggcgcagtggttcacgcctgcaacgccagcactttgggaggctgaggcgggcagatcacttgaggtcaggagtttgagaccagcctggccaacatggtgaaaccccgtctctactaaaaataaaaaattagccaggcgtggtggcgcgtgcctgtaatcccagctactcaggaggctgaggcaggagaatcgcttgaatccgggtggtggaggttccagtgtgtcgagatcgcgccattgcactccagcctgggcaacaagagcaaaattccgtctcaaaaaataaaataaaataaaatataaaataaaataaaataaaataaataaaataaaataaaataaaataaataaaaaaggagctgtccaagaaagagatgtcagtgtttggtcatggaggtggtgcccacctgtagtcccagctactcaggaggctgaggcgggagaccacttgagcccaggaggtctgggctgcagtgtgctgtgctgattgggtgtccacactaagttcagcatcagtatggtgagctcccaggagtggggcaccaccaggttgcctaaggagggatgaactggcccaggtcagaaatagagtaggtcaaaactcctatgctgattggtaatgggattactacacctgtgaatggccagtgcactccaaccttggcaacatagtgagatcccatctctaaaaaaaaagaatgaaaaacagaatttgtaatggatcagaagggggtagggagggagggaaagaggaatcaaaaaggctcctagattattggcttgagcaactgcatgatgatcgtgccacttggtatatggaaagataggaagaggagcagatttggaggcaactgaaacaagaattccattttagacactgattttgagatgtctattaattatgctcagagaaggtcagggctgtaaatgtaaacttgggtgttgtcagcatagagatggtagttagaaggccattagagtggatgctatcaacactggagatagtttgacaacaggacagaggacagagcctggggactcctacatttaaggcccagcagaacagcaaagtcatccaaagaacctgagaggttgaaataaacaggtaagtgactactggatttggcaagacggaggtcactggtgactctgacaaaaccaagtgcagtaggaaggaagcctgattggactgggctgccaagggaagaggagttgatggagtgggacattatctctaaactctaaacaagaagttttgctacgaatgagagcagaaaaatgaggtggcagttaagggagggcatgttataggctgatggggatgcaccaaaggagaaactgatatagaaacagagggctctattataagagcaaagtcatggatgaatcaagaaaggacaggatctggagtaccaatagacaagtgggcctttagtgagagcagggacatttgctctatcataacaagtggggtaagaaggctcttatgtatcttagggtccccaactactagtatggagtggggctgagagcaggcccttgagaaatggtggctatgattctatggctaacaatggctcagctctcaactccaggatcacctcctcctggggccatctctgactcccatttgatgcctctttcagttcccacatacctagtgtttctcccaacatggcatttaggaaatatttgtagaatggatcatgtttgacacacagagcagatcatttttatacc

SEQ ID NO: 12282 - DNA, 12836 bp, Homo sapiens
tttggcctcctcctggcctctgtggggcggctctcacattacctccagaaaggctgcaggctctcacccaggtaggcgcactctttgcttcagtaatccattagtcttctctagtcctttaggtggtcgctgattcattacagcaacacgtcacagtcagtcataagaaaaaaaagccacaggcgcctggggtgaaagtttcctctcctttcccggagctttctcacggtgtttccctggcatattggccaggtccccctttctgcagcatctgagctctggtggtgctgaccagatcacacttggcgtaggaccctctggtccatgttaaggggaactagtttttcctgggaagtaagccacaatgggtaggtttatgtcccattgccacctttatccagaaccagtactcagagttggtggtagggtgtgtgactgaagtataaatggaatgtatatcttttgtagctagaagaaggaaatctttctgcagtttcatgttaaatatattatgtagcaaacagtctttgtgattcctgccatgtgcaggcaagtgtccctgtaggaaccgtggttacaaaaacagggacgtaaagtgagtttttggtgggagatgatgcgtaaaccatctgaattctacagggacacctatagtgacaggagtggaagcagctcccctgactctgaaatcaccgaactgaagtttccatcaataaatcatgactgatcttgtagcgtaagtggtactttaaagttttagtttttaaaaacatggtgataacacactgcgattgcaagaatatcatggaagtttagggctgaaaatttttatctgccaggaatgaaagtggtgaggtcttgaatataatccagaggttgagagagaaaagaaagtagtgaggtcattgtgggtatcaaatgggcagcccttcctccaagttgcagtgcacctcccagtcctgccctggggatgacagcttggggagcatggtcactgggcagttgtctcaatactgattactacattctggtgccagtctgaccagttctggggcggggaaggggagggtctgaattcttagaccctattgtttgatgtagctgtaaattttggagatcttgaaggaagggacagatacaacaatgtggcacttgtcatttctgcagagcctcaggttttcatcaggaagtactttaaaactgacactgcttagagaacttttttttgttgattgctgcttattctggaattccttcaaagttggaacaattgccaaatagacgtcgaatgtttgtctattaagtgacagggtttgtaggttcataaagtgcaataactgtgggcactgccacgaaatgtaaatgtcctttgagataactgtgtggactgtgttggcagaagtacgcattctgctggtgaggtatcaaatgagggagtgtcagtcatctggggtctggaataagaaccaggggtatgggtgtgtggttccaccgctcctgccctaaggcctgggcagggggacctccctgaatcctgcacaccgtgtgttcatcaccagtgggcctctggtgctgggtcagtgccggtctgacctgctgatcccagctgtttcccctcctgccttggttggttgaccccctgtcctggcatagcctaagtaggtggtgggtaggcatgagaagttagtatcaggaggagggcctgtgtgctaggtaagcgtttaacacggatggactcattaatcccctgaccagggagtttgctataggctgtttcacagtcttaaggagctgatacaacaagaactgttaccagtgaaggaggtagatatttggtcagttacatggaatttctgactgcctcgcaagtggagaattgcccgttagtgacactgttacgaggtgctgtggagaaagaatgcttgcattgggtggttgtagaagtcgatgtgtgaggtcttgaaaaggtctgattctgtaggaattataaatttagcgtctaattattcccagtaggctccttctactgctctgccatgaaaaacaggcttagtttcccatggcagctgactagaaattctaacttttctactttaatgtacatcatataattcccacttttttttttcttttaaacagggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagagacatgctttgcttctcattctctttatgtcattggccagatgggaagcgtctgagcacgttgctggcttgcttgtgtgcagtcagctgaattgtcagtgccgggtgctcctgcaggtgagcagccttgactcagcagacaacctgagagtttgtttaaaaactaagaaatgaggctttctttttaataggaaccagaatttttcataaagcttcaaatacaggttctcagcatgtagagcgagatgaaaaggtgcatgggtgctattatggtgctatttatgactgagaaaggggagggataagcatgatttaggaaggtggtcctttcctctgccaggcactggacgtgggtaccccatatacacagccagtgagcagtgggccagactgtcttcaccagcagaactgcttgttatggtactttgaacgtggctgattgagcataattctaacctcttctcccacctggtggtaccaggagattgtcttcattttaaattttatttatttatttatttatttttttgagtcagggtctcactctgttgcccaggctggagtgcagtggcacaagcacggcttgctgcagacctcctgggctcataagatcctcccacctcagccttccaagtagctgggactacaggttcacatcaccacgcccagctaattaaattttttttttttttaatagacagggtctcgctgtgttggccaggctggtcttgaacgcctggcctcaggcgatcctcccatagtgcagggattataggcatgagccattgcacctggtcaatagtcttttttttgagatggagtctcacactgttgcctgggctggagtacagtggcgtgatcttggctcactgccacctccacctcgcaggttcaagtgattctgtttgcctcaccttcccaagtagctgggattacaggtgcctgccaccacgcccatctaattgttttgtatttttagtagagatggggtttcactatgttggctaggctggccgtgatctgctcatctcagcgtcccaaagtgctgggattacaggcgtgagccaccacgtctggcccgttttttttcaaacattccccaaactgagggtctgacacgcccgttgttgacatcatggtcccccacaatggctgggtgtgtgggtggtgtgaaaaagcctcccagtaattaagttcctgcccctatgtttaagatcactttggctgatcacttgtcaagtgctggccacataatgtaaggtttctgaaaaaagagatcccagatggctctccagagcttgcaaagctcgagcagccccgccacgctggctgtggcagacaggatagggctgaagctggatttacaggagggcaacctgtgcccagtgtttactgacccgtccccggaggcttctccctcatggggaggaaagctggtcacattcctcgttcctttcttaatgtgacctaacaataggcacagctatgtgtaacttcccttcagtaacttccttcagtccagggaacttcccttcagtccaggggatctgggcagttcttagcagtctggagcagctgggctgaagcctgacttcacccttcctttgtagaaatctgctcttttcccccgaaaaacatttccgaggattgtggtgcctggactagcatttagcatggtacctggaccgtggaaggtgctcagaaatgccactcctccttcttgagtaacacatttgtgtagttttcaaacagtcttggtgaccttggggcagctcggggggtgagcagcaggagtttggtaacctgccaccatataggtgtctgtgatcacattggtccctaaccagcatgaatggcagccgaggcaggggttgtgtgctctttgctaagtgggaaaaccaggtctcagagcagttgtgatcacccagaaaatgtcacctggctggtgagtggaggggctgggggttccaaagttctcatctgtgtctgctgtggatgtggccagggtcttcaagttttaggggatcaactgaagtgtgttctgtggaacactagtcctgtgaaatgccctgttcaacaaggtttggtgattttctggtggctcagaccccaaatttaggagtatccttaattgtctcaccagcaggtatttattgggtgtctaccatatgccagccatacccaaacccctgtcccccagagcagttattcagtgggggaagcaccaaatataagctacagagtgtggtagttcatagatggagaccaagggtggaagtgagcaggggagtggcagtgctgggaggtggtgtctttaaaatagggtgggtgggaaattaagcatggacttgaaggtgaagaggaaaggaaataggccgctatgtagcgcagaggccccgaggcaggagtgcaaatgaaacaagttggtgggcgtggctgaagtggcttacataaggggcggaagacattgaggttgggtgggctaggtggtggagaaccatgtaggccatcaagtttgggctttgctcttgaagaatttggagggctatgggtgcaggtgcggcatgagtgtgatcagactctggctttgcagcctctggctcagctggtggagacagcaggagaaacggccagaggcaggaagcagctggaggagtctggttttttttgtttgttttaagctaacggtcttactggaccagaggggtcttggaaaggaactgagacccttagtgtgaggtgctgctctgtgccacagctggcgtagacacagggcactggcccgatggtgacaaaatgcccctggccattgtcactgtcttatagatgaagaaactgaagcacagaggcatagcactttgccccacggtccctggtctttaagacagagctggactggagtctgaggggctgggctccctgcccttgcaggtctgtcctctgcctcctggacagaggtgggctgggcctgggactcatgaccctgcagcatctgaccggctgacccagtgtcctagaaagaaccattcttgtcccaggtgcatgtaatttattaatggagctttgacagtcacaagttccagcaagtcaggggtgggggctgcagggtggcctcttgccctgtaaccacagtcatcaaatatgcctcgccatctttgaggggctttcctgagatgacagattcctttctggcactgtgtagccaactggagtcacagacctcagcctgggccaaatgagcattttagggagaaggacaatcccttatagcttagccctaggggagctctgggcagggttttacacattstttctgaaagtaaggtcatttggggacagggctgagagcagtttcttggctacacagatgggtctgtcagggttgaagccacatgggtgcctgctcatgtgccatgttgaaggagtccctgtccgcctctcagcagcccgcatgggctttactggttggccttacactcaaacaggaaatccctgggtctcaggtggagagtgccgtgccgtcctgcctgctccccagggccctcacaggacacagcaggtgcaggacacaggcccgtgctgctgcagctgctgctggagctgctccttctccatcatcagcgccttcatcttctcttccagcttgcccagctccaccagccacctctgaggggacatgggaaaagcatgtggccaagcccgcctggtctcgggcctgtccgtcctccacctggggccaaactgagggaggaaggcaaagcccaggagcctgagagctttctcagctaggggaaaagtcaggcccctcggcctgctgccaccttcaaccgtgtcagcctgagggaagctgccggctgccagccatggaagggagcctcctccgtgctgggcaggccatgtgcctcctcactgttggtcccttgtcctccattctctgtttccctcttgaaaaagctcttccttgggactgtgtcttgccccctctgccgctttagggcctcccctaaaatgcagtgtatagtctttggggttttctggtgacatctcaacattccagtctctctgctccctcactcaagatcgagtgtgttaactgcccaagtagagggtgaggggtttcaggcacccctgaagggaggatactgcataggatttttttttttttgagatggagtctcggtctgtcgcccaggctggagtgcagtggcgcgatctcggctcactgcaacctccgcttcccagattcgatcgattctcctgcctcaccctctcgagtatttggaactacaggcgcccgccaccatgcccagctaatttttgtatttttagtagagacgagggttcaccatgttggccaggctggtctcgaactcctgaccttgtgatctgttcgcctcatcctcccaaagtgctgggattacaggcgtgagccactgcgcctggccactgcatagatttttaaaaggagagagcttgggcctcttccttcccaccagccacctacccgcggagtatgggatgtggtgtgattgtattccaaccccttgggttcaacggggtgatgcaggacccagggaaccatggtggcttgccctgggctgctcagtgggtggctgaaggggtctggggtcagctccgctccaccccacccactggcctcagcttccgtacctgcctgcaccactcctggatggcgctggcagacagcgggccctggatgctcccgtcgcgccgcagaaacacctccccctggtctgtctggtagagttgcggctggctctgggccttgggggtgtgcacggtcaggcggatcaccttggtaggggcaacagcagctctggaggcgccgcccctcacggtcggcagcccccatcctgccaggctgctcagcattgctcactgattccttagggcaggccagcagggctggcacaggggccatccccagcctcttctcctgtggcccccagtcccgtccctgccccagcactgcctggcaggagtgcaggccatcgtcttactgagtgatgacagatgacaggcccagaggccctcctgtcctgcaggctcaccttgagggggacgctggtctccgaggtactgatcacagggatgaaggtgagagtgtaggcatcgggaaagatctgaggcttgaagccctgcaggatggagtccaccagcaggcgtgcgcggtcctcgtcacggtggctgcagcggatgccctgcaccaggccgctgtcctctactcccacgagcaggctgccgccctcgctgttgaggaaggcgcacacgtagcgccgcacgtggtgcttgaaggccaggctgaggtactcgccgctaccccgcttgaactccatattgcgggtctcgctgcccaggaaggcaccctggaagagctggtccttgcccacgatctgctggtgcacaatggcactgtcggagcacacgccgctgggccggccctggcagctctgcagctgctgggcctggggcctatcaggcagcgtgtgtgtaggccaggtgggcagcgggacaccagagcctggactggggccagggctcaggccactgtcctcctcctcctcctccttctcctagggtggtagtcaagaatgaatgtatgggtccagccaggaaatgggagccctgaccctgagaaggactgcaagaacccccagtcaggcccctgctgcagcctgactcttacggacatcctgatgcccctcaccaggccgaggggcccagttctgcccaccctcctgcagccgaggcaggaaaccctgctggatcgagggttccagtcagcgctcctttccctgccaagctgggcccttcccaggtgagctgtgggatgcctggtggggaagaagagatttctgcttctcagggctgggtgctgggacatgtgtgggcccattttttcttacttgggttgcagacaggcccctgaggcccagaaccagatcattccagcaggtatctcagcaccctgtgacagagctgcagtaccctgaatggagagggactcccaggtaccccacccacttcctgatttcaaacctttgcccactacttgctgggctattgacaagtccgccctaatccccactttcttctgcgcctcctgaatctcctttcatggtttgggctctgctcgagggcttggtgtgagcctcctcggggccacttcctagtctgggcctccccagcgagcccctccctgacctccctgcttccaggctcaccctttcatgtcaaccctcctgtttttttttttttttttttttttttgagacagagtctcgccctgtcacccaggctggatggagtgcagtggcgtgatctcggctcactgcaagctccgccttccgggttcaagccattctcctgcctcagcctcccgagtagctgggattacaggggcccgccaccacgcccggctaatttttttgtatttttagtagagacggggtttcaccatggtctcgatctcctgacctcgtgatctgcccgcctcagcctcccaaagtgctgggattacaagcgtgagccaccgcgcccagccaaccctccttagtgacgctaacttcaaggcagattgttactcctcacaattctttcatgagcgtgggttggggtgaggagactgaggcacctccctaccagccctgcagctccccagagaagatgaatttatcagtcttagaaacaggataaacttcatacaaatgtgaaattgagttgaaatgtaagccacagagccttttagttctgcaacagtttaaacaccatcattttcacaccaaaagaaaccaaaatcacctgtctcatggagtgacctatcctaacgtcccatgtcccacccaataaagccagcagttcagccttgccttggatgatagccttggtgacctggcccctaccctaccttctggcccaacttccttccttagcaccccctgcagcctttagtgggagctccagggacaccaaatggtttgcccttctgcagacatgacactccctctaagcccccaggttcctctgcatattctgtgtcccttgcctggaatgtcctcccttgcaagtgcctgtccaactccctaagtcccggcctggatttcacttcccctgttaatctgtccccagagagcagggcaaaccttcctgtcttctctcacagctctgagcgcagccaccttgcagctcggtgggtggctgtccagctctggccacagatgcagggcttcctgggggcctggctgggcctctcatccctgccttactcttggcacagagggggtgttcatgtttgtcaattgaacaaatgagttgggccaaggagaaaatcggggcccctgtgtcttctagggtctcccaggcccagaggctggaatgtaaaaggacctaaggagaggaggtcccctcgtggcctttcttcacacaaacgtcgggcttgagcttgaggcaaactgtttttcccagagaaagctggcagtaccagccgcaagccatggtcatttgagtggcagcccccaagtttgcagatttgtccctgcttccccagagacacccctccatccccactctgcaggccactcccactcagaggctctcccttggggtgaggctttggagcttgcttgggaaaagtcccacttacctctctgtggctgaagggcccttgggcctcactcaatagcaggtccttcccacgggctgccagctccttgaggattaggtgctcctccagggccgtctgcaggcgccaggggagggaggccagggtgtccctgtggacagtcacctgcaccagtgcataggccttccgcggccgcctcaccacttcaatgtgctcccgcgccaccggcatctccagccgctccagggtgtctcgcagcaggcaggcaagcaccggcactgagaactgggggttcagatggcccacatagagagtgtgcgccgagggagcctcctcgaggtcagagtactccgtcagggactgctctgcgggtagctccggcagggactcctcaccccaggactccatgaagggctctgacacctgtgtttgcactgatctcttcatgggggtcatgggaaggctctccctgggaaggggttccaggattcctcactgctggctgcttctcccagggtctgtgttctcagtgtggcttaagggctcccagaggactcagggagtgtcccggctcctgggaggtacacagattggcagagactgggcagggccagagagagggagggcagagggcaagcaggaaagggcctgccacccacctgaggcctaggatgagaaagcagagtcacgtggactgagcaagacacagggcctgtgggaagacgggatctgcccaaaaagtggcagaagggaccagaactcaggtctctgagagctccaccatttcagtggccccaggggtcctgtcttccctccccaacccacaggctaggggcctcctaggtaccctcagggtttcctgcctaccagttcactcctgcctccaggcaacagagaaaacctttacacagggcctcctggagaggaggccttaacccaggactctgaggactggctggtggccccattgcagcttctctgcctgctctaaaaccccatgtgaggccatcgggggctctgaaactaggcagcgctggggcagaggcttttagagcagaggatctcacgctttttggcacactgatgaaagctatggcctctcagaaaaatggcctttgcatataaacataacttaaggtggctcctagaccctaagaactagtctagactgagtcctccatttttggtccagagagcagaggtcaacagggcagaacgagggttagagttggggccctagtgcccccgccccaagtccagggagcctctgtcctgagctgtgcacatatgtgcacacaccagcccctctactgctccccacacacccagcctgcatcttctcaaatggaatccttgaggcagttggcctgggggcattcaggtcaaacaggaagaggaggagaggagaggcctatgaccttcatgtcctggtggctcccgcgggagcatgggaggtgcctgccctgagctcccatagcctcccgacccctggccggtagctctcagggaacttggaggcttggcacagggacggccagaaccagggttataggaagtgggcggggcctgcacagctacctctgtgatctcatgaggttcaacaatgccttcttggccagccacaggcaggctgggtgcgggaaatcaaacaggaaaactcagctccctgtgggtcccaccacacactggaagcagacccagcggcccacccaccatgcagcttggctgtgggacacacttccccacttagtgatgtctcttcaggccccagttcccatgcaggtcacctcttgccacctctttcagcgctgctgcctaaagcctccacctccctctttagtcagtcaccaatcccaggctctactgagtactgacagggcccagctgctcccaagatggagcaggaggcacatggtaggctccagggctccccctgacgccaggcccttctctgtgctggagacagaggctgctgtccagaagagccctgaaaaataggtcaggcgtagctatctatctctttgggaagatgaggttgttacctgctgttggagaaaccaagacgtgggtgacacacagtctttatcagcacaggactgaccagtgctcatcattctgcagaaggctggcagcgcttgcccacactgctt

SEQ ID NO: 12283 - DNA, 12576 bp, Homo sapiens
ctagaaattctaacttttctactttaatgtacatcatataattcccacttttttttttcttttaaacagggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaatatgaagttactttcttaatgtgacctagcaataggcatagctacgtggcactatattctggccagactcgatgtgtactctaacttaagaaataaatcagtaaggcagaacaagagacatgctttgcttctcattctctttatgtcattggccagatgggaagcgtctgagcacgttgctggcttgcttgtgtgcagtcagctgaattgtcagtgccgggtgctcctgcaggtgagcagccttgactcagcagacaacctgagagtttgtttaaaaactaagaaatgaggctttctttttaataggaaccagaatttttcataaagcttcaaatacaggttctcagcatgtagagcgagatgaaaaggtgcatgggtgctattatggtgctatttatgactgagaaaggggagggataagcatgatttaggaaggtggtcctttcctctgccaggcactggacgtgggtaccccatatacacagccagtgagcagtgggccagactgtcttcaccagcagaactgcttgttatggtactttgaacgtggctgattgagcataattctaacctcttctcccacctggtggtaccaggagattgtcttcattttaaattttatttatttatttatttatttttttgagtcagggtctcactctgttgcccaggctggagtgcagtggcacaagcacggcttgctgcagacctcctgggctcataagatcctcccacctcagccttccaagtagctgggactacaggttcacatcaccacgcccagctaattaaattttttttttttttaatagacagggtctcgctgtgttggccaggctggtcttgaacgcctggcctcaggcgatcctcccatagtgcagggattataggcatgagccattgcacctggtcaatagtcttttttttgagatggagtctcacactgttgcctgggctggagtacagtggcgtgatcttggctcactgccacctccacctcgcaggttcaagtgattctgtttgcctcaccttcccaagtagctgggattacaggtgcctgccaccacgcccatctaattgttttgtatttttagtagagatggggtttcactatgttggctaggctggccgtgatctgctcatctcagcgtcccaaagtgctgggattacaggcgtgagccaccacgtctggcccgttttttttcaaacattccccaaactgagggtctgacacgcccgttgttgacatcatggtcccccacaatggctgggtgtgtgggtggtgtgaaaaagcctcccagtaattaagttcctgcccctatgtttaagatcactttggctgatcacttgtcaagtgctggccacataatgtaaggtttctgaaaaaagagatcccagatggctctccagagcttgcaaagctcgagcagccccgccacgctggctgtggcagacaggatagggctgaagctggatttacaggagggcaacctgtgcccagtgtttactgacccgtccccggaggcttctccctcatggggaggaaagctggtcacattcctcgttcctttcttaatgtgacctaacaataggcacagctatgtgtaacttcccttcagtaacttccttcagtccagggaacttcccttcagtccaggggatctgggcagttcttagcagtctggagcagctgggctgaagcctgacttcacccttcctttgtagaaatctgctcttttcccccgaaaaacatttccgaggattgtggtgcctggactagcatttagcatggtacctggaccgtggaaggtgctcagaaatgccactcctccttcttgagtaacacatttgtgtagttttcaaacagtcttggtgaccttggggcagctcggggggtgagcagcaggagtttggtaacctgccaccatataggtgtctgtgatcacattggtccctaaccagcatgaatggcagccgaggcaggggttgtgtgctctttgctaagtgggaaaaccaggtctcagagcagttgtgatcacccagaaaatgtcacctggctggtgagtggaggggctgggggttccaaagttctcatctgtgtctgctgtggatgtggccagggtcttcaagttttaggggatcaactgaagtgtgttctgtggaacactagtcctgtgaaatgccctgttcaacaaggtttggtgattttctggtggctcagaccccaaatttaggagtatccttaattgtctcaccagcaggtatttattgggtgtctaccatatgccagccatacccaaacccctgtcccccagagcagttattcagtgggggaagcaccaaatataagctacagagtgtggtagttcatagatggagaccaagggtggaagtgagcaggggagtggcagtgctgggaggtggtgtctttaaaatagggtgggtgggaaattaagcatggacttgaaggtgaagaggaaaggaaataggccgctatgtagcgcagaggccccgaggcaggagtgcaaatgaaacaagttggtgggcgtggctgaagtggcttacataaggggcggaagacattgaggttgggtgggctaggtggtggagaaccatgtaggccatcaagtttgggctttgctcttgaagaatttggagggctatgggtgcaggtgcggcatgagtgtgatcagactctggctttgcagcctctggctcagctggtggagacagcaggagaaacggccagaggcaggaagcagctggaggagtctggttttttttgtttgttttaagctaacggtcttactggaccagaggggtcttggaaaggaactgagacccttagtgtgaggtgctgctctgtgccacagctggcgtagacacagggcactggcccgatggtgacaaaatgcccctggccattgtcactgtcttatagatgaagaaactgaagcacagaggcatagcactttgccccacggtccctggtctttaagacagagctggactggagtctgaggggctgggctccctgcccttgcaggtctgtcctctgcctcctggacagaggtgggctgggcctgggactcatgaccctgcagcatctgaccggctgacccagtgtcctagaaagaaccattcttgtcccaggtgcatgtaatttattaatggagctttgacagtcacaagttccagcaagtcaggggtgggggctgcagggtggcctcttgccctgtaaccacagtcatcaaatatgcctcgccatctttgaggggctttcctgagatgacagattcctttctggcactgtgtagccaactggagtcacagacctcagcctgggccaaatgagcattttagggagaaggacaatcccttatagcttagccctaggggagctctgggcagggttttacacattctttctgaaagtaaggtcatttggggacagggctgagagcagtttcttggctacacagatgggtctgtcagggttgaagccacatgggtgcctgctcatgtgccatgttgaaggagtccctgtccgcctctcagcagcccgcatgggctttactggttggccttacactcaaacaggaaatccctgggtctcaggtggagagtgccgtgccgtcctgcctgctccccagggccctcacaggacacagcaggtgcaggacacaggcccgtgctgctgcagctgctgctggagctgctccttctccatcatcagcgccttcatcttctcttccagcttgcccagctccaccagccacctctgaggggacatgggaaaagcatgtggccaagcccgcctggtctcgggcctgtccgtcctccacctggggccaaactgagggaggaaggcaaagcccaggagcctgagagctttctcagctaggggaaaagtcaggcccctcggcctgctgccaccttcaaccgtgtcagcctgagggaagctgccggctgccagccatggaagggagcctcctccgtgctgggcaggccatgtgcctcctcactgttggtcccttgtcctccattctctgtttccctcttgaaaaagctcttccttgggactgtgtcttgccccctctgccgctttagggcctcccctaaaatgcagtgtatagtctttggggttttctggtgacatctcaacattccagtctctctgctccctcactcaagatcgagtgtgttaactgcccaagtagagggtgaggggtttcaggcacccctgaagggaggatactgcataggatttttttttttttgagatggagtctcggtctgtcgcccaggctggagtgcagtggcgcgatctcggctcactgcaacctccgcttcccagattcgatcgattctcctgcctcaccctctcgagtatttggaactacaggcgcccgccaccatgcccagctaatttttgtatttttagtagagacgagggttcaccatgttggccaggctggtctcgaactcctgaccttgtgatctgttcgcctcatcctcccaaagtgctgggattacaggcgtgagccactgcgcctggccactgcatagatttttaaaaggagagagcttgggcctcttccttcccaccagccacctacccgcggagtatgggatgtggtgtgattgtattccaaccccttgggttcaacggggtgatgcaggacccagggaaccatggtggcttgccctgggctgctcagtgggtggctgaaggggtctggggtcagctccgctccaccccacccactggcctcagcttccgtacctgcctgcaccactcctggatggcgctggcagacagcgggccctggatgctcccgtcgcgccgcagaaacacctccccctggtctgtctggtagagttgcggctggctctgggccttgggggtgtgcacggtcaggcggatcaccttggtaggggcaacagcagctctggaggcgccgcccctcacggtcggcagcccccatcctgccaggctgctcagcattgctcactgattccttagggcaggccagcagggctggcacaggggccatccccagcctcttctcctgtggcccccagtcccgtccctgccccagcactgcctggcaggagtgcaggccatcgtcttactgagtgatgacagatgacaggcccagaggccctcctgtcctgcaggctcaccttgagggggacgctggtctccgaggtactgatcacagggatgaaggtgagagtgtaggcatcgggaaagatctgaggcttgaagccctgcaggatggagtccaccagcaggcgtgcgcggtcctcgtcacggtggctgcagcggatgccctgcaccaggccgctgtcctctactcccacgagcaggctgccgccctcgctgttgaggaaggcgcacacgtagcgccgcacgtggtgcttgaaggccaggctgaggtactcgccgctaccccgcttgaactccatattgcgggtctcgctgcccaggaaggcaccctggaagagctggtccttgcccacgatctgctggtgcacaatggcactgtcggagcacacgccgctgggccggccctggcagctctgcagctgctgggcctggggcctatcaggcagcgtgtgtgtaggccaggtgggcagcgggacaccagagcctgkactggggccagggctcaggccactgtcctcctcctcctcctccttctcctagggtggtagtcaagaatgaatgtatgggtccagccaggaaatgggagccctgaccctgagaaggactgcaagaacccccagtcaggcccctgctgcagcctgactcttacggacatcctgatgcccctcaccaggccgaggggcccagttctgcccaccctcctgcagccgaggcaggaaaccctgctggatcgagggttccagtcagcgctcctttccctgccaagctgggcccttcccaggtgagctgtgggatgcctggtggggaagaagagatttctgcttctcagggctgggtgctgggacatgtgtgggcccattttttcttacttgggttgcagacaggcccctgaggcccagaaccagatcattccagcaggtatctcagcaccctgtgacagagctgcagtaccctgaatggagagggactcccaggtaccccacccacttcctgatttcaaacctttgcccactacttgctgggctattgacaagtccgccctaatccccactttcttctgcgcctcctgaatctcctttcatggtttgggctctgctcgagggcttggtgtgagcctcctcggggccacttcctagtctgggcctccccagcgagcccctccctgacctccctgcttccaggctcaccctttcatgtcaaccctcctgtttttttttttttttttttttttttgagacagagtctcgccctgtcacccaggctggatggagtgcagtggcgtgatctcggctcactgcaagctccgccttccgggttcaagccattctcctgcctcagcctcccgagtagctgggattacaggggcccgccaccacgcccggctaatttttttgtatttttagtagagacggggtttcaccatggtctcgatctcctgacctcgtgatctgcccgcctcagcctcccaaagtgctgggattacaagcgtgagccaccgcgcccagccaaccctccttagtgacgctaacttcaaggcagattgttactcctcacaattctttcatgagcgtgggttggggtgaggagactgaggcacctccctaccagccctgcagctccccagagaagatgaatttatcagtcttagaaacaggataaacttcatacaaatgtgaaattgagttgaaatgtaagccacagagccttttagttctgcaacagtttaaacaccatcattttcacaccaaaagaaaccaaaatcacctgtctcatggagtgacctatcctaacgtcccatgtcccacccaataaagccagcagttcagccttgccttggatgatagccttggtgacctggcccctaccctaccttctggcccaacttccttccttagcaccccctgcagcctttagtgggagctccagggacaccaaatggtttgcccttctgcagacatgacactccctctaagcccccaggttcctctgcatattctgtgtcccttgcctggaatgtcctcccttgcaagtgcctgtccaactccctaagtcccggcctggatttcacttcccctgttaatctgtccccagagagcagggcaaaccttcctgtcttctctcacagctctgagcgcagccaccttgcagctcggtgggtggctgtccagctctggccacagatgcagggcttcctgggggcctggctgggcctctcatccctgccttactcttggcacagagggggtgttcatgtttgtcaattgaacaaatgagttgggccaaggagaaaatcggggcccctgtgtcttctagggtctcccaggcccagaggctggaatgtaaaaggacctaaggagaggaggtcccctcgtggcctttcttcacacaaacgtcgggcttgagcttgaggcaaactgtttttcccagagaaagctggcagtaccagccgcaagccatggtcatttgagtggcagcccccaagtttgcagatttgtccctgcttccccagagacacccctccatccccactctgcaggccactcccactcagaggctctcccttggggtgaggctttggagcttgcttgggaaaagtcccacttacctctctgtggctgaagggcccttgggcctcactcaatagcaggtccttcccacgggctgccagctccttgaggattaggtgctcctccagggccgtctgcaggcgccaggggagggaggccagggtgtccctgtggacagtcacctgcaccagtgcataggccttccgcggccgcctcaccacttcaatgtgctcccgcgccaccggcatctccagccgctccagggtgtctcgcagcaggcaggcaagcaccggcactgagaactgggggttcagatggcccacatagagagtgtgcgccgagggagcctcctcgaggtcagagtactccgtcagggactgctctgcgggtagctccggcagggactcctcaccccaggactccatgaagggctctgacacctgtgtttgcactgatctcttcatgggggtcatgggaaggctctccctgggaaggggttccaggattcctcactgctggctgcttctcccagggtctgtgttctcagtgtggcttaagggctcccagaggactcagggagtgtcccggctcctgggaggtacacagattggcagagactgggcagggccagagagagggagggcagagggcaagcaggaaagggcctgccacccacctgaggcctaggatgagaaagcagagtcacgtggactgagcaagacacagggcctgtgggaagacgggatctgcccaaaaagtggcagaagggaccagaactcaggtctctgagagctccaccatttcagtggccccaggggtcctgtcttccctccccaacccacaggctaggggcctcctaggtaccctcagggtttcctgcctaccagttcactcctgcctccaggcaacagagaaaacctttacacagggcctcctggagaggaggccttaacccaggactctgaggactggctggtggccccattgcagcttctctgcctgctctaaaaccccatgtgaggccatcgggggctctgaaactaggcagcgctggggcagaggcttttagagcagaggatctcacgctttttggcacactgatgaaagctatggcctctcagaaaaatggcctttgcatataaacataacttaaggtggctcctagaccctaagaactagtctagactgagtcctccatttttggtccagagagcagaggtcaacagggcagaacgagggttagagttggggccctagtgcccccgccccaagtccagggagcctctgtcctgagctgtgcacatatgtgcacacaccagcccctctactgctccccacacacccagcctgcatcttctcaaatggaatccttgaggcagttggcctgggggcattcaggtcaaacaggaagaggaggagaggagaggcctatgaccttcatgtcctggtggctcccgcgggagcatgggaggtgcctgccctgagctcccatagcctcccgacccctggccggtagctctcagggaacttggaggcttggcacagggacggccagaaccagggttataggaagtgggcggggcctgcacagctacctctgtgatctcatgaggttcaacaatgccttcttggccagccacaggcaggctgggtgcgggaaatcaaacaggaaaactcagctccctgtgggtcccaccacacactggaagcagacccagcggcccacccaccatgcagcttggctgtgggacacacttccccacttagtgatgtctcttcaggccccagttcccatgcaggtcacctcttgccacctctttcagcgctgctgcctaaagcctccacctccctctttagtcagtcaccaatcccaggctctactgagtactgacagggcccagctgctcccaagatggagcaggaggcacatggtaggctccagggctccccctgacgccaggcccttctctgtgctggagacagaggctgctgtccagaagagccctgaaaaataggtcaggcgtagctatctatctctttgggaagatgaggttgttacctgctgttggagaaaccaagacgtgggtgacacacagtctttatcagcacaggactgaccagtgctcatcattctgcagaaggctggcagcgcttgcccacactgcttctggaagccccaattgggggcagtaaggatggtgccacagttagatgcttcaactaagaaagctgtttgacagcgtagagaagctgccttccttgaaagcagcctttctgaagatgttaccaaatgtttgtttcctagggggtgaggcagtagtttgggtagagcactcaagaaaagaggctatggtgtgcggggaagagaggggcgcaggcctcaactggtggcagtgcgaggctctggggagagtgcattcggtgccctctccttgcccgcccgggcagcagccaggttgggctcggctttgtgtccacagctcttagggttagagaatgacggctccaagctccccctgcctcaccccctctccctcaagcctttcttgcctctgtcatccatgaggtgccctcacagcaactgaggctatagctgttttgagatggccaactcaagtcgtgttgaactgtgcagaaatagctgtccgggagaagcaccttgacagacgaaacacctgaacatgaccagaggcgttctccctacttacctagaggccttgctattgggtggctgttctgcatgaaatttcccaaattgacttgagtgcagcaactttccccactcttcctggcagtctctttaagccactgcatcacatatttctctggcgcctttaacagccttctgtgagctgaatcagttctacttctttttggagatgggggtaaaaattgtctttcatggtaagcactaaacacatttatgaaccatcttttaaatacataaatataagataacaaggttatttacggtgtctctggctctctagtattaggtaatagtattagaaagtataggtgctctgcaggcagcttggagtggtgggttcccagtggggggataagcagccccgttaaccctcttgctggatgtctgtgacctcactgacaaacctcatcttgaactgaaggaaaaaaccctagaatttaagcctctttatgaatgtgaggtggggcccaaagatgaggggcagagagctgagccgctgtggatggcctcttttcatgttatctggacagtgtccactgggtggcccacatggccacaatccctgaacccacagcaggcatgccatcccctcttccccacagctcccacttcacaatctgctgtttgcccaggaaggccagtcaaggggcagagggatagggaagaggaatgagcccagccaggtgcaggagagaacaaggatgatcaagaagagcgaactctggggagcagagttacaaacatagctttccaggtcctgggacccacatcactccagcctcccttggtctcaagccctcccctagcgtgctgcctccagcctgtagatccccacctggctctgacagggcccagccccagttactgcagagtatctctgacttgagtggctccagcctagtgtctgtgccctgggtactgtgggctgccagcctctgtgagcacctgcagtggctttggcactgtaggcacagagccgcagttctgatgcttggctgtgactgcctctgggctgaaggctggaagctgtggctctgccctgacggaatgtggtggcaagaccatgtccagtgactcagggtacttaggtaaagaggctgcaaaaagctgagggctgctgaggggagaagtgttgggaccctcttctcaaggtttcccacactttttgttttggtggtaaagaaggagggatgattcaccttcaggctcttgccaacgagggagtgtggcaccagtgtgagggccggaacagtgtccatttggccca

SEQ ID NO: 12284 - DNA, 24566 bp, Homo sapiens
attatatcaaccaatacaatctcatttttgtttaagccagttttatttggtttcctgttaaacacgactgaaaaatcttaactgccaatgtggagatatcccccttcatgatgttgtaataatggctgcagcagctccaggtgtcaaatgcagacatgacatccagagaagaagtggaatgctgcctgtcatccatctctgtttattaggagtgaaaatcttttctataatttctaattcagaaggccagggttgtaatcacacactacatggaatgggatgggaatgattaccaaacagcaatctttacttatccctgaacttggggagaggatcatctttcactagcaaacaactacagtagaagaacatccaaataaaactgggactctgccagcaatataaaatatgaaaggggaaagctattgggtaaataatcaacagtgtttatgacactaatagatgtattaattttctgtaaagttgtgtgtgtgggtagaaaatatcaggaattgtacatatcaatctttagcagaatttaaatttgggagggggactatctggagtggaaaggatggatatttttacttatacaattttcattagtttatattactttggtgatttaaatttaaaagaacttcaatctaaaaatgggctgctcagaagtagagctagaacaaaaatatagagtcagaaggctggatatggtggtccacacctgtaatcccaatgctttgggaggtcgaggcaggaggatcactttaggccagactttgagaccagcctggggaacatagtgataccctgtctctacaaaagaaaaaataaaaagaattatgagcatggtggtgtgtgcctgtagtcctagctacccaggaggttggaggattgcttgaacccaggaggttgaggctgcagtgagctatgattgcaccactgcactccagcctgggcaacagagtgcttgtctctaatacatacataaatatatgtatgtgtgtatatatatatatgtgtgtgtgtgtgtgtgtgtgtgtgtgtatgtgtgtgtgtgtatgtatatatgtattagggagagagagagagagagagagagagagtcagagaagcacatatttgtatattccatcccagtcctggcccctacacagttactcaggtgccagtagcaggtttattccttctggggatttggaggcacaaagctatccgagcctgatgccatcaaatatttaaaccattcacctccctcccgtcccactctcaaagctgtcttcacatcataaattggcttcctgtgcatattttcctacggggaaagaatgtgctggacatggcattgtgagcattctggtccccttggcagttctatttctcatcataaattaatacattgcttctctggctcagatagcaggataggagctgggttagtaggatctactttccattccccaatagataggttctctcttaatgctgttaaagtcaagttcataagcctggaccatgatgaatttaccaaggtaaaagtcacctctgatgccacytgtcagctggccagccagcctgccctgatgacactcctgtctcttcaagcacatttctttcagactcctgtgcttcctagccacattcatctcaatcagctgtctctttctttatccctcattctgtcttttcctctatgactctctctctctaattatatatatctttctctcttcctacttcaccacttaatcttcctttatctttttttttttatttgacggaatttctctcttttttgctctggctggagtgcaatggcataatctcggctcactgcaacctctgcctcccgagttcaagcaattctcctgcctcagcctcctgagtagctgggactacaggtgcacaccactatgtccagctattttgtacttttagtagagatggagtttcaccatgttggccagactggtctcgaactcctgacctcaggtaatccattcgcctcagcctcccaaagtgctgtggttacaggtgtaagccaccgtgcccagacttcttttccttttttcttctgttttttgtttgtttgtttgttgttgttgttgtttaccttaattaaccatggagttgaaaaataatatataccagagctatgtgccaagcacagagctgggtcacatgtaaaaattatattctgacctcacaataactctgaaaactgtttttgttcctattttacaaagaaagaagtggaggctcataaagggtaagtggttgtgtttcataatcttaaaggttttctctgstgaattttcaaaattagtaaattaaatgctttgtgcttcctttatctaagaaaatacagtttaggccaggcatggtggctcatgcctataatcccagcactttgggaggctgaggtgggtggatcacttgaggtcaggagtttgagaccagcctggccaacatggcgaaaccccatctcgactaaaaatacaaaattagccagctgtggtggtgtgcacttgtagtcccagctacttgggaggctgaggcaggagaatcgcttgaacctgggaagcagaggttgcagtggactgaaatcaggccactgcactccagcctgggcaacagagtgagacactgtctcaaaaaaaaaaaaaagatgaccctttgaacaataaagctctcactgctctttgcctctccccatccttcttcctgagagtgggacttgaccctgattcctctgacacaaacttaaacttctttatggaggagataaccttctctgtccagtcaggctcaacatactttctgtatctgtgcaaaaggaagaggtcaaatcttcagcacctagatttgtaactttcagtaacttggagatggaggttgtggtaacattaaatctgctccctggaaggtcactttttattattttgggtgtttaattaagttgctcggcctcatcaagtgtcctccccatgatcctagaagatagtgaggtagaagtagagaggagtatcccttccagcctgcttcagtagagttctgagaggagcaaaagagaaaacaagatgtttctgggtgggttccaggcccctccacccttctgcaagggagtgaagggtgcttatctcctgaagacatgaattgatggattttggttataggccggaggagcagatgcaaccactgtattttcttaggtaaaggaaatataaagcatttaatttactaattttgaaaattaagcagagaaaatctttaagattatgaagcaaaactacttactctttatgatcctgccaaggatcagaacatggcagcagagaagtccsaggtctaactgaatgtccagactctgttggattcagcaccatagacagaaagcagcccaaagctgctgagggctgagggttgaatgccatagacagataccccttctctgtccccacccccaatttcactagtccccattgctattcctgggaggaacctaaccccttccattagttaactggcccccagcacttaaaggtcgagataaacaatgggttggtttccttctaaggccctccggaatttctttactgagctttcagttctgcggcttcctggtagagtggggtccgccttagagcaactcttattaacatccagctgatttgcatatatctgcattcactggggcttctccattctggttttattgtaaatgaattgctcagaggaagaaagggawggattatttcactccttttttttcctcttctttccccctattcctagggtctctgtctggaaatttcccccagatgcstgaaggtgtgtgtggtggaagagggtagaaaccagactccaacagtcaggtatttgccagagcatcctatgtagatttccccagataatttcccccatctgtttggtttctgaaagatccttgtcaggttcagaggaagtctgtattttgttttagcaccgagggtcagaacctctgggctgaagtccctggagcytcagtaagaagccatgattggtgccttagagcctgctaaggggatggaacccggttttaaagaggagtgaggggtggtggagtgaggactcattttgaaatgaaaggagtcctgggtctctaagcagcttctaaaaataccatctcccagaggtggaggcagggggaggggagaaatcgagcgtgaggagaatgaagatggaaaggaggtggcagtgtgagaacccttcctcrggtaggtctggttttagaagtcccgcctgcatccaaggactggagggatgccacacctccttctgcttcctcagggggcttgtctcctgtggtgtccaagccacagcctctcctgatgacctttctttctgcaggtaaagaagaccaattcctcccacctactcctcctattgctactgtccagcaagtatgtctgagtgggcamgtgtgcatttactcgcacatatacacaagcacacacgcagaaatggcacatgaaagcgggttgtaaatggccagtgatctacgatgccakgaatcctccttacactcggcgttcaaagaggtatggactctggcagagacagcgtggttcaccagggcatccgcagcacagagcatggcgcccagtgagggctgggtagaggggtgagggatacatatatgcaaaagcacagacactcagaccgcaggggccaagtagtcacaggactcacactcactctcgaggtttctcaggctatattcgcttccaaatagagagggggtgggtcccccaagaaaagagctcggaaaagccacgaggtgggtggagctttctcccctcaagttcagcccagatggtggcgctcagtagccgcctccctcgtcctggagggccccaacccttcccaccaccaaagtgttaaaccctcagcttgcacataaatgaccttcactagacagaggtcttgttccacgttttcttgcggcttcttcagcgccggctgaactctgccaggattgctccgcctctctcgcagatgtctccgattcctggcctctgtgctgttcaccagtcccctggggtgggcggagtggggtgatcaaagaggggaacccccgactctgagcagactgagggcatgggtggttgtgaggtgtgctgcttgtatcttgacagcaggagcaagaacctgaggaaccgatcgttcatgcaaaaccgccaccgcccccatcccagcgtccacatggtttcccagcctcggaagcgcgttggtagggcaggaccccgtccctcactttgctctcctttcccgagcagctcccgggatcgttcggcccctccttcctgccgctgtgtgtgtgtgtgtgtgtgtgtgtgtgtgtgtgtgtgtgtgtgtgatgagggcgggaagagaaagggggggatgagctaggagacaccgggagcctcagacacaggaacagacctagggcagggagacaggagagctccccagagcttggggtcaggacataaagcttcaaaaccccgcaagtcctgggaacaagggagctttcagactagctcagaggctgcaagtgttgctgcctccccgagggtcgcccctccttaagccaagcccaccttgcctgcctacttctcaggaatgaggagctaaggtttagcgctctrggccaccgatgccagctcattcccctctcgcagaagccctgccagctcccacagctgccccaccccccacggtttggagatctgcrggaccccttcctttccccaccagttgggtgttccgcccctggcctatgaaactccaccttcccaccctctgctggcggggattggttggcatcccgcggcggtgcctastgattggttcccatggatgatggtgagcggtgagactccgccccccgctggctctggggtctgggggcattgctcagcggtgctaggctggcgcggcttgagccgccgccggactkacagctcggtctgcggaccatggagacctgcgccggtccacacccgctgcgcctcttcctctgccggatgcagctctgtctcgcgctgcttttgggaccctggcggcctgggaccgccgaggaaggtgagaagactggtgagctctgctcggagcgtggcataccaaaagatagggggctggcgatgggggttctgggggaaggagtcattgsagagactagagtctgtattggggcttgaagcaagcmggcagcaaagaactggagagacagagaaaaatgtgatcaagcagtagcgaagagaggggcgctgaggagcttgggggctggagacccgggaggttgggaaagaaagaggccaggaaccgcgggagccagaggcggcggtccagcggccggtgagacggacaagctgagtgattggaggtgggaggtgcgggggcggggagatgaagagtggagacagggagatgcggaggtgagctcggaatatggggagacgggatggagcccggactacaggggctaggagaccacagtgtggccaacagaaggtggaatgctggtcgagggggctggatccgggcgctgcccgacgtgctgatcatggaactgtccgcagtgctgaattctgagcgtagtctgccgggcgcgctccgcgttgccgggtttgaggctgtcggcgatactggagcccgcgtcttgcctctgattgtgcatttaggggagctatacgctcagttgaatccagaggcgtcatatctaggtgcagaatccggaggagctggaatctgaggcgttgaccgcggggttggtctgggccctggatggctgatgccttccagttcgcgattccgatgtgctgtcagttgcgcggatctcggaaagccgtcggcggtcctgcccacagtcgctgacgcctctggagaggccctcaccttggtggcccaccccctggtttaagctccagagggtaatctcccaagactccggggtgtcctgacctcctgtctctggtctgcggactctgctgtccaaaccattttctgtgatccatgctgagaggttgcaggctgctgatccgatgcctcctgggggaataaagggacttcaagcttctctggtaggaagggtcatagatgtatacataaaagaaccccagacattctttcaaaagcagtggaagtgacagcccctgggaaaagggctggctgaggagaagagagattttatttctccagttgttagcagtatctctccacattgttttctcagaggcccgggagtcagtctaaaaatgttcaagtcttcatgcctggggaccaccgacctcagaaaagcccctgagtaggagtggattggggggtatatacaggaatcccctgatacattcactactcactttctctctctctctctctaattgactcttagctataattttgggaacctaagaaggctggggagagtcactgactcccacccccaatctgagagccaaccttagagtatttgccatggaccctgtagaaggctgaatgatgacccccacccccaatatgtcaatgtcctaatccctagaaccgtgaatgttagcttaattgacaaaaaggactttgcatatgtgattagtgatcttttgagatggagagrttgttttagattatctggatgggcccaataatcacaatggtccttgtrtgaggggtgcaggaggagccagagtcagaggaggaggcagtgtgatgactgaggcagagattaaagtgatgtgatttgaagatggaggaggggaccacaagctagggactacaggcggccaccagacgctgaagatggtaaggacatgagttctcccctcagagcctccaaaagaaaacagtcctgctgacaccttgactctagaccagtgaaagtggctttgggcttctgacctccagaactgtaacagaaaaatawtgtgttgttttaagccactaaatttgtggtaatatgttacagcagccccaggaactgaatacaagctccttccctactgactgtggctacctctctctggatttgagctattcacacccctcctggggatgtatggagtgggaaaaacttgcccatatcatttgtcacatattgcattctctcagcaaatttacagggacttcaccaaaggattccactctcttgctaaactgaccttctcgatttctgatatttctgtcttcccctctccttagttatcctcctggattccaaagcctcccaggccgagctgggctggactgcactgccaagtaatggggtaagtgcacaagtgtccctccctgtcccagggatcctctggtggtccaggacacagtctcctcagctcctcatgtttacatcagacaaaagtgctcctcagagtgtgtggtctccagcagccctggcttcaagccagagtggcctgttagaaaacattgagtcttcagccagttagacagtcaaaaaaaaaaaaaaaaagtgaataagtgaggagagaactggctgtctaggaacagaaaygtggcatctggatggagctaatacaggacagtggcttgcacatagtagtagatcctccaagcaatgttgttgattgattgacacagcaagcaagactgggagtcctaaaagaggcttggagacttggggtaggggaggatgatgtgggctgtaacagcagcttggtggagtgcaaagggcactggtcagagagtcaggaractacaggcaccattcctagctccaccactaacttgatgtgcatacctggtcagatcgctctccctctggagcctcagtttccccatctataaaaataaggattgggatcatttgtttccaaagtttctcccagcgctgcatcttacaatttccggggtgtgcatggtgcatgagagagaaagcaggagtcactgctagcgctccacctcctggaagcactttggctctgggctgcccacccctttactcttgtccccagtgggaggagatcagcggcgtggatgaacacgaccgtcccatccgcacgtaccaagtgtgcaatgtgctggagcccaaccaggacaactggctgcagactggctggataagccgtggccgcgggcagcgcatcttcgtggaactgcagttcacactccgtgactgcagcagcatccctggcgccgcgggtacctgcaaggagaccttcaacgtctactacctggaaactgaggccgacctgggccgtgggcgtccccgcctaggcggcagccggccccgcaaaatcgacacgatcgcggcggacgagagcttcacgcagggcgacmtsggtgagcgcaagatgaagctgaacacagaggtgcgcgagatcggaccgctcagccggcggggtttccacctggcctttcaggacgtgggcgcatgcgtggcgcttgtctcggtgcgcgtctactacaagcagtgccgcgccaccgtgcggggcctggccamgttcccagccaccgcagccgagrgcgccttctccacactggtggaagtggccggaacgtgcgtggcgcactcggaaggggagcctggcagccccccacgcatgcactgcggcgccgacggcgagtggctggtgcctgtgggccgctgcagctgcagcgcgggattccaggagcgtggtgacwtctgcgaaggtatccagttggctgggggccgtggggtgggagtgtagagcgtaggtggcaattgagagagagtgtgccctagaggaaagaggcgggtgtggggtcggggggcggtggagaagccttggactctggagcccaaggagagccctgaagtcttgtggagtttccagtgagtccagtcagggccaatgagtgaayttactagatgaaattgactggctaaggaggcattagggatctatatcttaggcaccttgcacaggccttctcgtttatttattttcatggcaataaaggaagtcattgtttttttttttttttaaataaggagtctctcttgctctgttgcccaggctggagtgcactggcttgatcttggctaactgcaacttccacctcctgggttcaagcaattctcctgcctcagcctcctgagtagctgggattataggcgtgcaccaccatgcccagctaatttttgtatttttagtagagayggggtttcaccatgttggccaggctggtctcaaactcctgacctcaagtgatccacctacctaggccttccagagtgctgggattataggcgtgagccaccgtgcctggcctaaaggaagtcattcttatctctatttcacagatgaagaaacagagcctcagagagattagtacctcacttgcaaagttaggaaatggggagctaggatttgaattcaggcttgcccaactcacattctatgacatcatgaggtctcctcagtgcataaggaagaactctacagcagcccaatcttcaggctagtgggattggttgcattacagagaggaatctcccagtcacggaccaaatacttgcaagttagaggctggcaggggggatttttatgctggagagagggattgggaagttgcactagatgattacgaagatcacatcccactctctgaactacaatcactgtgctccctgggggagatccttcatgttgagggttttgctggsttctcaggctagtgggggcattaggaacagacctctcattctctctcttgcctgtggctttggatacagagggtgatgatggggttattaatgtgtgtacttaatatagaaagatcaaggtatgctttttctaaaccatgtccttttctgggtgccagggcaacagaaatgagtcagacatagtcctagctctcaagaagctcacagtctagatggagagatgcaaaaatttaaaaatcacaagagggtaatatatgctataacagrgggatacacagagtggtgggaggacaggggaggaagtgactaaatttgctctcattcctttgttcaatcatccatccaatatgaattgaggatgtgccagctgcatttattgagggcttattatatgtatatagatgaatgccaccatctcctccctgcggaaattgtaatttagagaaagactgggaggcatgaaccttcctgagctctccagatatagttaggatccacctcggtgctctccagcattcattgaaacctatttctgtacttaccccatggtatgcactgatctacttatgtgtgttttcaccactagattaagaacttctttttttttttttagaaatgggggtttgtctatgttgcctgggcttgcgtgtagcagctattcataggtatgatcatagtgcattacagcctggagttcttggtttcaagcattccttctgcctcagcctcctgagtaggtgggactatagggaccacaccctagattaggaacttcttgagctcaggcactgggtgttactagtgtcagcagccccagcattcataacaggataaggcatacggtaggtgttcagtgaaaatgcattgggtgaaaaagtggttactatagggtgtgaaacataaacagagagctaaggaagcatggaagggagaacctaattctaagcatggagaaggcttcccagagaaggtgagaaggttttttttycccaggcagcttagagcattctaagcttaggaattgcatgcagaaggatggaggcagaaggaacatagcatggctgggcctatgtaactaaatgtggttggagcagagggcatgtgggggtgtgggagtgaagtgatggggttggagaggagcaggtggaaatcatgaaaggccttgaatgttgggataaagagcttagactttatgctttaggccaatggggaggatctgaagcagggatctgacatgctcagatttgtattttcaaaatatcactcaagctgcaattgcaaagaaaggattgaagagggaaggattaggagccagaagatgaagaaggaagatggtgcaatagtgcaggagaaagagcacaagggctgaactaaggtagtggcagagatcattgagagatgaggatagatgggatcatgagttagcatccacagcacttagtgmccatgtgatacaggaggagaaaggagtcccctttgacttacatgctactggggattgaatggacagagggatcattcactagggtacagaacacaggacctggatagacacatatttatgatgtccacggtgcattccagtggaggtagctagaaagtgggtctggagctctgaaagacagagacagtacttgaacctgtgggtgtggttgggacagaccaggagaacgtgtggggtaagaagccaagagggccaacaatgaagactcatagaatagcaatacttaaggacaagtagaaaatacagagcccattaaaaaggctgagagggagtgatcagagtatggaggagaactaggagagtgtgatattatgacagccaagagagattgaaggtgtccaggaaggaatgccctacagagttgggaagcagtcaggtaagtcaagggttagaaagtgcccagttggtggccttggtgagagcaattgcagctgagtgatggacacagagaacaggttgcagtagattgagggataaaggaagttgaagagcttgagtcagggaatctagaagcctggatttgaattagaagaggaggtatctcgaggaggacattggattgagagaggatttttattatagatgggagagacttgtttgtatgcggaaggacaaagagccactgggataccaagtgtgtatatgggggggatccccatcccggtcccaggaggcaggagtattttattactgatgtgggctagaattgctgatgcattttgctaataaaaaagcaggccagattttagtcagttttattattgtttttacatactctatagtttgtgcccttattgcctgcacccaaaatgggccactttttactgcttcactaccaagaagggagatgactgatggaatgtagtatttgatgaggttaaagggagagatccagggtggagacagaggggctggccttcaacaggaggtggctcattccctcctctaggactggaagggaggaggagaggggagatggttgtggatgggggcatttgtgtattctgatgggcagatgttgagggaattatcaactgatggcttcccttctccctataaggtgggagggagggcatctgtacaaatggacagtaaggtccttgtctgttttattcattgttgtgtatctatagagcctacctagtagatgccaaaaaatatttgctgaatgaatggatcaggagtgagaggaggaggtttctctgggaaatgwgggagaaagagagagagagagaaagagactcaggaacccaaaccatgtctgatgagaacagaaaaaggccayttgtaatggcctcagctctgccttggggagtggggagctggggacaatgccaaggaaagcttcacaagggagatgttatttgaactggggtttggagaagtatagaagtttgccaggagaaaaaggatataaggaattacagaacaagacccagaggtgtgaaaggatgagctcagtgtaccatggmtagagtggrtggcagtggggagctgttggaggacattaggaagggaagggaaatgattggatttgcatttagaaagttaaggccttccaagtgccttctgcagctaacacaagcttccctctaaaagtagatggataagtgggggaatagaacgaatatgttcttttcccctttttgtttctctttagtgaccttgacttttgttctccctcggttagccactagagaaattagtaaaagagctggggtttcctttgggggaaaaaatcagggcatataacaagtagctttaattctmtgctagggccaggtgcagtggctcacacctgtaatcccagcaatttgggaggctaaggcaggaggattgcttgagccaggagttcaagatcagcctgggcaacacagggagatcccatctctccacacacaaaaaattagccaggcatggttgcacagcatgcctgtggttccagctacttgggagggctgaggtgggaggattgcttggccccaggaggcaggggctgtagtgagctatgattgtgccactgcactccagcctgggcaacagagcaagaccctgtcacaaagaaacaaacaaacaaaacaactyagtgggattgccttggagccaagggacccaagcagatatgttctctgaggctccatagggcacaatgagcccctgtgatggggtggcacaaggggcattacagacagcgaagctaatgggggctcatcctaagaagcactttctgccagcattgttcaacaaaggcagcctcagaagcgggtgaatgcctcatgataaagtatgtgacaaagactgtggctactgctggggaagctgccggaggaccaggccagtgggagctgagctagattatctctgaaggtctgaccttgaagrgagggaggggctggcagtcaggaatccctgaatctgctcttcagcacaaactccttctaagcagagcctctyacagcagagataccactgtggtcgctgatgggcccacccacctctaggacagcagccaccctcatacacttgtggggagggagcctccagcattcttcccctatttttgtgaaaccctgcgaacagatcatttatctgggctctcacttgctctcctatttcacaacagtggtgggcagggcatggttgttattcctatttgaccaatgctttttttgaggccagagaggcacaaggagtggcccagccaacactagaacccaagctttccaagtcccagcctgggtctctgctgcccaccagaccacggggatagttggcccatgctctgttctgcaggcagaggagacttctgaaggctcctgggctgccgagcccctccccagagttgtgctgcccagaactctgggcaagatggaccctctcaaacctatgccttccrgacagtggaaatcctagtcccctcccctcttctgccacacaggctgaaagttcctcctgagggctagtctgcaccctttctgttgtactgcgtcttcttggagctggagagcagccagctaaactagaggagagggccagggaacaaggtgaggaccacccaagttctgagaggtagggccaggaaccamctggcccagctggtgagaaatttttttaaagtgggtgtttagcarttaccacttaaggcctgtgggggaggaacagtaattactatcattattgtgaaaatgtggttggtactgggctaggtggtttacatgttttatctcaatcctccaacaacctttttgaggtaggtattcaacacaaggctcagaggggtcaactgatgtgctcaaggccacacagcaaataagtggggtgactcagctacaaacccaggttgttcagatagaaacacttgtgatcttaacaacctgtgttctgagaagtgagagaagcaaactgagtaggtgtcaagactggaaccaggtctgactcatggtccagggaacttttactggcccttytctctccacccacccccctccacctggctggctttacttccagttgggaatttatgacacactcactcacatgakggtggtgggagggtgtgtgtgtgtgtgtgcatgtatgcttgtgtgtctgtccctgcrtaactgtggaacagctcttggggcacctctcctcccctctctttctcacaccagcactgcagagtttgacttattttcttccagtggtcctgagggtggtgtgatgtgggcttgggttgggatcccacaggctgcgggagagtagctgtaggcaacttcacctctcctagccttagctccctcattttaaagaggataaagggtcgggcacagtggctcacgcctgcaattttggcactttgggagaccaagctgggcagatcacttgaggccaggagttcgagaccagcctggtcagcatggtgaaactccatctctactaaaaatacaaaaaaagtaactgggcatggtggtgcacacttgtaatcccagctactcaggaggctgaggcaggagaatcgcttaaacctgggaggtgggggttgcagtgagtggagatcccgccactgcactccagcctgggtgatagaaggagactcgaaaagaaaaaagaaaaaataaataaaataaaaagaggataaagtatataacctcacaggtggttgtgaggattcaatgaattaatagacgtaatttaaaaaataataaatagagacggggtttggccatgttgtccaggctggtctccaactcctgggctcaagtgatcctccagctttggccttccaaagtgctgggattacaggcatgagccaccgcgcccggctgaaagtaaaatgtttcaaagttttccgaacacacagcgttttctaagggtaggtaatgggttgttcaggagtcactccacggggcagtgctgactggagtggctgagtcccctgactgtttttctatcgcaattggaggagataaacgctgccctaamcaggccagtcaggaaagcggggagaaactggaggagccccctcttctcaccagycatgccctgcagcctgtcccccagggttttacaaggtgtccccgcggcggcccctctgctcaccgtgcccagagcacagccgggccctggaaaacgcctccaccttctgcgtgtgccaggacagctatgcgcgctcacccaccgacccgccctcggcttcctgcacccgtgagtcccccctccaggctgcactgcggagggtggggggtgggagtggccaagaaggaaggcctgatccaggtggtggtgagggcagggtctccgcactggggcgcacgkgggcggatatggggrccagcgccccggaaggcggcgtacgggggagcggagcctggacgcgccctgggggccggggcctttgatgagaagaaccaggacaactgcgagagtccagacggaggatggggttaggatgcctggcagatcactgaggagagcgcccctccgctgccctctcctcaccctgcctaccctccagccgaaaggggggctcccgaccttcgcaccatcggttcggtccccatgctsccatcctcggttcctcactaacctcctcccaaatcctcaccaactgccccgccactctcacattccgacctcccaagggcccccacgcccccgtctctgacccttcccggggcaagcccctcctcccgctcgcccctgctcccactcacccctgctcccgctcgcccctgctcccgcttgccccgggctcatccgccctcgacccctcactgactgaccatctctgtaccaatctccctgactgaaccccacgcccccattcctcccaccccagacccctcacaccttcctatcccccatgcccactggctcccacggcccattcccgctcatccatccctgttccttcaccggtcgtcccttctaccttcctccctgactgaccccatgccactgtctctcctgtcccccgtcccccctcatccaccaagtcccttgatgaacgccctggttccctcctccccgactgaccctcgcgcccctgcttctcctgcctcactgggggtggacaagaccccgcccccccctcgtgcatcccgcccctctcacgggcacccacgccccgccctgaccgccccgcccctgtgccgcctcagggccgccgtcggcgccgcgggacctgcagtacagcctgagccgctcgccgctggtgctgcgactgcgctggctgccgccggccgactcgggaggccgctcggacgtcacctactcgctgctgtgcctgcgctgcggccgcgagggcccggcgggcgcctgcgagccgtgcgggccgcgcgtggccttcctaccgcgccaggcagggctgcgggagcgagccgccacgctgctgcacctgcggcccggcgcgcgctacaccgtgcgcgtggccgcgctcaacggcgtctcgggcccggcggccgccgcgggaaccacctacgcgcaggtcaccgtctccaccgggcccgggggtaaggccgtccgcgccccccaccccgaggccaccgcgcctgccgcccctgcgccctcttggggccgccccgtcggtcctgcgggagccccacccacccaccccagagaagccatcctctgtacacgcaccccgcccctctccgggacacaaagtcacccccccggacgccccagcgtcagtcgccctcccgagtgtgcgagagggactgaggatgcaggcgtccccttactactgggccagaggggaggcgcgcggttctgttgcgtctgcgggaagcacctgtgtgctcgcytttctcctggactccttgcacaaagcctctgtcccgctcacggctctgcagttggcctcgccgctgatttctcagggaaaaagaggtggaaagtcccttaatctcttmccttccctttaaaaaaatgtcagtaggaatccgaatttacttccttccctctgtctcgggaagccggatccggccctgtgtcccttacctccaaccctcggcctctgcatggttttgctgcatctggccacctcctttcctggtcccgggaaagggcaaggaagcttgtagagttaggctgtaggggcgatggaacacaccagccaatacatctctgagtctggacatgaggtgaataagtgaagacctacaaccttttcacaccacaccttcattcctgagagtttcttttgattcgcttctcagctggggtggaccttcaagtaatgcttgtattctttgcaagaaagataagcgagtggtatggtttctgactcccttcctaatcgagcctatagggtcggcctgtcaccctgcatccctgctttctgtgatcccgcttctgtctttggcagtggtgttgccaagaagtctgaggctagggttattttcattcttttctacttaacttggacatatgacatgtacacgtatgcacacggatgttagaataattctttaacctgcttaacctactgttgataataattttttttttttttgagacagagtcttgctctgtcaccaggctggagtgcagtggcgcgatcttgattcactgcaacctctgcctcccgagttcaagtgattctcctgccttagcctcccgagtagctgggactacaggtgcatgccaccacgcccagctaatttttgtattttttagtagagacggggtttcaccatgttggccaggatggtctccaactctcaacctcatgatctgctggcctcaggcttccaaagtgctgggattacagacgtgagccactgcgcgcctagccagactttctttttttttttttgaaatggagttttgctcgtcacccaggctggagtgtggtggtgtgatcacagttcatggcaacctctgcctcctgggttcaagtgattctcctgcctcagcctcccgagtagctgggattacaggtgcgcaccaccacacccagctaagttttgtatttttagtagagatggggtcgcaccatattggccaggctggtgtcaaactcctgacctcaagtcatctacccgccttggcctcccaaagtgctgggattacaggcatgagccacctcatgccaggctgaaaataatcatttaaccaatatggatttcttttttttttttctttttctttttctttctttttttttttttttttttttttttttgagaggagtctcgctctgttgcccaggctggagtgcagtggcgatcttggctcactacaagctccgcgtctggggttcacgccattctcctgcctcagcctcctgagtaactgggactacaggggcatgcagccacacccggctaattttttgtatttttagtagagacagggtttcaccatgttagccaggatggtctcgatctcctgagctcgtgatctgtcctccttggcctcccaaagtgctgggattacaggcgtgagccactgcgcccggctaccaatatggatttcttttgattgagtaaaccttttgatttgcacaacttttttttttcccgggaaaagttttcttcaggccgggaacagtggctcatgcccttagtctgagcactttgggagcctgaggccaggagcaatatagtgagaccctgtctctacaaaaaattttaaaaattagccaggcatggtgatgtgtgcctgtagtaccaggtgctcaggagggtgaaggaggaggatcagttgagcccaggagtttgaggctgcagcgagtgataattgtgccactgcactccagcctgggtgacagagccagactatgtctcttaaaaaaaaaaaaaaagttttattcagccactgctttgactagaacttctgatagctcaaatatatctcttaaaaatatctctaagccttaggttttacattcattttctgattctcaaatcttgtcacttcacttcccttatccttttgagctcttaatccatttccactgccttttggagattttccagcttgtctgggtttctggaacagtactgttttttattgtctctattgtgatttaacatttgctattgcatttacatctttaaaaattctttttttccatctttctttcatgtcagatgggtattttgccaacgtgaaaaggttcgggggtgacacatctcacatacgagtgtgaatccccaatcatcacacttgcaaactacaaaaggatcacatttttaaaaattcagtatagaagaagaaaaaacccataatcttattacatagataaaaacaactattaatatcttagagtatatacgtccagaaaatttttcctgtctatcttgatctctgtattcatatttgtaactatctacctataaaatcccttttgttttaatacagtcatgcaccatataaagacattttggtcaacaatggatggcatatatgatggtgatcctgtaagattataacggagctgaaagactcctgtcacttagtactttctgttacagttgcctgtagtattcagtacagtcacatgctgtcacccaggctgtacaggttgtagcctaggcgtgtcataggctatgctgtctaggtttgtgtaagtacactctgatgtttgtataacaatgaaatcacctaacaacgcatttctgagaacatcttcccatcatttagcaatgcatgatggtatatgtaatactaacttttatctggcattttacattaacaatcttttttttttttttgagacggagtcttgctctatcacccaggctggaatgcaatggctcagtcttggctcactgcaacctccgcctcctgggttgaagcgactctcctgcctcagcctcctgagtagctggtattacaggcacacaccaccacaaccggctaatttttgtatttttagtagagacagggtttcgccatgttggccaggctggtctcgaactcttgacgtcaggtgatccacccgcctcagcctcccaaagtgctgggattacaggcgtgagccaccgtgcacggccttatgttaacaatcttaactgttttgacacagatagatttagaagccatgttaaggaaatactcttctatttccattttctcagtaaaaatactaagcttccactgatctagtgctgctgtatttggcactgtgcaatatgattttctacattaattcattgaaatggggctgggcacagtggctcacgcctgtaatcccagcactttgggaggccgaggcaggtggatcgtttgaggtcaggagtttgagccagcctggccaacatggtgaaaccccgtctctactaaaaataaaaaaaattagccaggcgtggtggtgcacacctgtaatcctagctactggggaggctgaggcaggagaatctcttgaaccctggaggtggaggttgcagtgagctgagatcgtgccactgcactccagcctgggtgacagagcaagactccacctcaaaaaaaaaaaaaaaaaaaaaagatgaaaagaaaggaaactcatcttagattggttttggaacccaggtctgtctgacctcaaagccctgtgcctttaatccctaggccatataatgcttcattgaactttttctaaaaatcagaaatggatgttaattttataaaatgcttattaagcattttcaatatgaccaaattttttcctttttgacctgtcggtatgatgaattctattaatggatatttcagtgtgaactctctgcactcctggattataccctactagatatattattctttggatgttttgctgagttcatttgcttatattttaagatttttcccatctacatttctaagagagattagtgttttgtaatgtgttctttgtcaagttttggcactatggggatgctggctttggtaaaggtatctggaaaaatttcttctttttctctgctctgggacagttttaacaacacatttacatattctttgaaggcataaaaaactgcctgggaaactttctgggttctatgccatttttggagagaaagttttatttatttgtttatttatttatttgagatggagtctctgtcgcccaggctggaatgcaatggcaccatctcagctcactgcaacctctacctcccaggttccagtgattctgctgcctcagcctcccaagtaactgggattataggcaaccaccaccacgcccagctaatttttgtatttttagtaaacatgggatttcaccacgttgatcaggctggtcttgaactcctgacctcagatgatctgcctgccttggcttcccaaagtgctgggattacaggcgtgaggcactgcacctggtggtttgatatttttaatctttactgtaacgtcttgatcagttttataaatttgtgctttcctagaaaatattttggtgttctttttctaatttattattagaaatgtatatacatttcctcagtacctggagttaacttcactttctctttcttcctgttgtatgcttgtgatttctgtcttttttcttaattatccttgccagaagttaattttactggttatgacacagaatcagctcttgaacctatcaattccattgttctttactttcgtcacttattttatgatttattattattattatttttgagatggagtctcactctgttgcccaggctggagtgcagtggcaccatctcagctcattgcaacctctggctcccaggttccagtgattctgctgcctcagcctcccaagtagctgtgattacaggtgcacgtcagcatgcccggctatattttatgattttatctttattaataccactctcctgctttcctgaagttttttttttttttttttgagacagtttcactctgcctgtcacacatgctggagtgcagtggcatgatcttggctcactgcaacctctgcctcctgagttcaagcgattctcctgcctcagcctcccaagtagctgagattacaggtgcacaccactacgcctggctaatgttgtgttttttgtagagatgggggtctcactatgttgcccaaacttgtcttgaactcctggactcaagcaatctacctgccttggcctcccaaagttttgggattacaggtgtgagccaccccacccaacctctgaagtctttttctaggcaagttcagtgcttagttattttttgtttaaattttttaaagctatgagttttcctctgaatatagctttgtcacttccaatacatttgatacatgatattatcacattgttagtattataaggtttttttaggtataattcatgtaacataaaattcacccttttgaagtatacggttcagtgatttttcatatatccgcatagttgtgcaacaagtgctatctaattctaaaacatttcatcaccctgaaaggaaacccattagtcactcaccattccatccacctcctctagctcttggtaacaactaggtctttctgtttctatggatttgcctcttcttggcatctcaatacatggaattatacaatatgtgaacttgcatgtctggcttctctcacttagcataatggcttcaagtttcatccatattgtagcacgtatcagtacttcattcctttttatggctgaatgacattccattgcatggatagaccacaattttgcttatccattcatcagttgatagacattgggctgtttccacattttggctattatgaataatactattatgaatattaatgtattcataatacattaatgaatatatgtttttgcataaacatatattttcagttttcatggctatatacctaggagtagaattgctaagtcatatggttatggactgaattatgttacctccagattcatgtgttaaaaccctaaaccccaatgtgactatatttggagagagtctctttaaggaggtaat

SEQ ID NO: 12285 - DNA, 109738 bp, Homo sapiens
ttcctttaccccttcccttaggggtttgaagggaaatttttggatgggagaaacaacacctaaaagcttcgttggtttaaacattgattgggcaagtctctattctagttctgggtcttatcaagtaacttggagtcaagtggaaaggcaggctcttcacagggctgttgaactctgtccccaaagcagaggttgttggggtaattcagattggtgacggtgaaggtcaggaggaggaggtggccgtgggcacaaagcggaaggtgcggacgaaccacccgcagatccacaagaaggtggtgaatgggagtactgtggggagaacacagaggctgtggggctgtctcccagcttctgccatgttcccaccacaggctgttctcaacccagtggcccgagtgattcagttaggaggtgcagagtccctccagcagcccgccttcctcagaggaacagagtcctcccaccgccataaggccctctctggcttcattcctattgcctcagagcctctgcaccagcagctccatctgcctggaatgcttctgacccacatggctccctccctccctccctccttcaggaatgttctcaaatggcatcttctcagggagacttgttggccacctcatctcaaattgcaacctcccagtacttcctatcccctgcccttgtgttttatttccttatgtttctcctcagcactatcactctgacatgctatatatctgtcttatcaatctgaaatgttgtctcctagattgtaagctttatgaaggaaagatttgtgtgtgtttactgtcctatccctacctcctggaataggactggcatagagtaggtgctcaataaatgtttgttgaatgaataaatggtggaaagaacactggatttggagctagattgatcttgaaggttcaagccccagctctagctgtgtaaccggagaaaaattgcttaacctccttgtgtctcagtctctttcatttgtaagatggggatgacagaacttagtttatatagttgtaaggggattaaataatataattaggccgggcacggtggctcacagctataatcccagcactttgggaggctgaggtgggcagatcacttgaggtcaggagttcaagaccagcccggacaacatggtgaaacctcatctctaataaaaatataaaaaatttgccaggtgtggtggcacatgcctgtaatcccagctactcaggcggttgagacgggataatcgcttgaacccaggaggtggaggttgcagtaagctgagatcgagccactgcactccagcctgggcaacagagcaagactacgtcttaaaaaaaaaaaaaaaaaaaaaagaatgaatccattcagcatccactgatcgtatccctcctgtggaccaggtgttgtgggggtgctggagatatagtgttaagtggagaggcactgttctttccgtcctgaggacagtctcagggaacaatgggcataaggcatagcacctacaggcttccaatgcctccaggcacccactcccttctcagtgagtgacagttccctgagatagacatcttttggagtattggtcccattcaccatgaccatcctcactgcaaggaagaatcccaacgaccagattatgttttctgacccaccactgcagctatagttgattagacagagcctccgactcaagctaggcacctagataggtgagtgtcctttgtgggtccagacagcaggatctgctcctctcaatctgggaaatttttaaaggaatttccatttgtagacggaacaagcccaactgaccgagagggaagcaccatgactgtttcaggatggacactcttggggacttgtttgtacttgtgtgttatgtcccggcaagtgagcgtcttttttgggtagcagatggcggggtcagctcctctcaatttgggaaattccttaaggaattcccatttgctggttgatcaagcccaaacacagaagagagaggaagcaccctgacttttcagtttggacactaagggcttgtctgttgctgcagtagttggatagtgttctggtgattgtgtgtatttgatataggcatgaggaattagaatttaatttggtaatcttttgcaatactctttggccccaaaattgtttggaatctggagtttgctgttgaatgggaacgtgggatggagttgcatgtatccaggcttttgttctgctgttttaagcagagtcgggcctagttaatatgtaatgttttcctttggtgctgtttagccccagtgttctttggagtctggggaggtttggcccttaaaaatcaaactgccatgaaaactgctttacccaaaattttggctcatagcctttgttggattacctatcagggcaaacaaagtgtaaccatgtaaagccggtgagtttgtattgctatggcatgggtaaagttccaaggtataagctattgaattttcgcttgtgtatgtgtctacatacctagatgtgtttatttgtatgtacacttactgttatatgttgtgttggcttataagagcactcataaattaagcaaataagtctaagcaattttcaagttcacatgacttaagtaaatctttactaaacacactggttttaaaattattggtaaaatgaaaatataaatgtcttcagaattgtcagcatacatttctgtctggattttatatttgtctctgttacatagtttgaggcatcagagtttggcatagaaggttataaaactataaacccagcccaaaccaaatgatctttgtgcaaattttttgataagtaagactaatgaatgtggttggtttaatgaaaacagctgaatttctgagttattagttaaaatacctatgttttcaacttggaggcttttttttttttttttttgagacagagtctcgctctgtcgcccaggctggagtgcagtggcgtgatctcggctcactgcaagctctgcctcccgggttcacaccattctcctgcctcagcctcccgagtagctgggatcacaggcgcccaccaccacactcggctaattttttgtatttttagtagagatggagtttcactgtgttatccaggatggtctcgatttcctgatctcgtgatccacccgccttggactcccaaagtgctgggattacaggcgtgagccaccgtgcccggcccttaacttggaggctcttaagtgagcacctgaagttcactggctatgaaaaaactggttaggctgggtgtggtggctcatgcctgtaatcccagcactttgggaggctgaagcaggcagatcacttgaggtcaggagtttgagaccagcctggccaatgtggtgaaatcccatctctattaaaaatacaaattagctgggtgcgctggtgcatgtctgtaatcccagctacttgggaggctgaggcaggagaattgcttgaacccaggaggcagaggttgcagtgagttgagactgcaccactgcactccagcctgggtgacagggtgagactccatctcaaacaaacaaaaaaaaaaaaaaaaaaaaaaggaagaaaaagaaaaaagaaaaaaactggttaacaaggaaataaccaactttaaatgatggtgtttaataactgttttcagaagtaatctagataaactgttaaaaatgaaagaattgaatacatgtaaatgggataaatgttttaggtaaactttttgtgtaattttaaatcttaaaattatttttgatgctcattgacatctgggtcattttcagttaagaaagggttatgatatggggaaatatgtttctagaaattgtggaatggttctcagctataaaatgctcatatctgatagttcaggatttattgcttcttagggtttcactaaaatttaaggttaccaaggataagaattatagttaatatataattatgtctataaaatgtgccacaaatgtgctatttagtgagaaaaagaataattatgtctaattcagaagttatctaaaagtaaagttaattcaaattatggacttgaaaatgattatttatgaaacaaagtagtaaggaaccagtaagtaagggagagaggtgtgaataaagtcatggatatgaagatgtatttttggcaaagaagattgtaaagaaaagataataattttgtatgagaaaggatcttgtgtggtgaattttttgtgttggagtaaaatgactggttatttaaagtaaaaacaagaagaaaaaaatctgggactggatggaaagcccaggcatgtagtgcatagtctgtgtaagttgtatgtagtttttcttgtttctctgcacatgcagagaaaaatagaaagttgaaaaagttttggctgggtgcagtggctcatgcctctaatcccagctctttgggaggctgacatgggtggatcacctgaggttaggagtttgagaccagcctggccagcatggtgaaaccctgtctctactaaaaatacaaaaattagccaggcgtggtggtgagtgcctgtaatcccagctactcaggaggctgaggcaggagaattgcttgaacccgggaggtggaggttgcagcgagctgagattgcaccattgcactccagcctgggtgacaagagcgagactctctctctcaaaaaaaaaaaataataataaaaataagttgaagaaatttagataataaaatgttctttaaaacctggtagagaattggagaaatttggatacttaacattttcatagtacttaacattttcatagttaaagctcttcatcttgatgaaggtaaaataataaatattgcacagaaatacattagcagtttggcaattcttttttaatacagttaagtatgaagccagatttagtgttgcaccaaatctcacatacctgcctgcattgcttcacactaggtttgctgttttgcatgaatagtgctggtgctagagtacttactggtcatgtgcctagagtgaatttcttgatttcacaggatgtatggtgatattggtggacttaaggatactgaattgtgtatgaggaataaaatattcatcacgtgtttttttttttgggctctggatagcatggtagcctccagggtagactaagttgaggaaaggttggggttggtttcctgtttgtttttgcttctaattttcatttgtttgctgtttgttctgctttgcgttttgcttgtgtatgtatatatatataaaacaatgtatggtttttagtttctagtggaaggcttttactttgttctgtgaatagttattttgttttctgtgcatttctaggaagtcatcatttgttctgtttatctggaattcctaggctacctttgttgggcctgcaggaattgatggagcacaccagccatttggaatttggttggttttgcttgcctctgatgatctagagctaaaaaacaaaagacttatttttttaagttctgaacagaaatagtacattatatattttgttgtttggagaggtggataagagtggaactgtttgcatggtgtttgtttccagggtgagtcaactgaatcaatagtttgggttgatttcagatcatttcctttaatgaagaaaaactgtgatatggatacaaagttttaatgttcaggaaagattggccttgtccttaagaaaattatattgattagaatttctctcaaatgaatttaaagtgacattcacttggattaagtagtaataaaaaaaaggtgatattttctagtgattttgtttttatctcaagtagtttatcactgattgaccttcatgtgtgtaacttgaaaacaaaatatgtgcaagtgttgcactggtttgaagattttggcagtaaaagttacctaatcagttgtcagtactgtgtctggaaaccagtcttggaagtgtgatgatgtgcttttaaaatagctgaaaagaaattgttttgtacttgttcttactttgtccttgttttgttgtatagtattgtgtccagaattggttccttccggtgggttcttggtctcactgacttcaagaatgaagccacggacccttgcggtgagtgttacagttctgtttttttttttgttttttttgtttttgatggaatctcgctctgttgcccaggctggagtgcagtggtgcaatctcagctcactacaagctctgcctcccgggttcacgccattctcctgcctcagcctcccgagcagctgggaccacaggcacccaccaccacgcctggctaatttcttgtatttttagtagagatggagtttcactgtgttagccaggatggtctcaatctcctgacctcatgatccgcctgcctcggcctcccaaagtgctggtattacaggcatgagccaccacacctggcctacagctcttaaagatggtgtgtctggagtttgttccttccaatattcagatgtgtccagagtttctttcttctggtgggttcgtgttctcgcttgacttcaggagtgaagctgcagaccttcgcagtgagcattacacctcttaaaggtggcatgtccagagttgtttcttccttctggtgggtttgtcgtcttgctgacttcagaagtgaagccgcagacctttgcagtgagtgttacagctcttaaaggtggtgcgtctagagttgtttgttcctcccagtgggttcgtgatctccctgacttcaggagtgaagctgcagacctttgcagtgagtgttacagcgcttaaaggtagtgcggacccaaagagtgagcagcagaaatttattgtgaagagtgaaagaacatagtttccacagtgcacaacgggacccaagcgggttgccactgctggctcgggtggccagcatttattctcttatttggccccacccacatcctactgatcggtccattttacagagcactgattggtccatttttacagagtgctgattggtgcatttacaaacctttagctagacacaaacactgattggtgtgttttgacagagtgctgattggtacatttttacagagtgctgatgggtgcatttacaaacctttagctagacatagagcgctgattggtgtgtttacaatcctctagctagacagaaaagttctccaagtccccacccgacccagaagcccagccagcttcacctctcagtatttaagtgaaaggagattatttctcatattgaatttccaaaactgatatttgcatttaccatatttcaatgatagaggaaaaagttgtcttagtttgataagtttggcatagggcttatcacatttttgatactttgggtcacagttctgtcactagaatactagcaattagacatatgcaatgagtaacctaactactttaataccctggtttgaaatactgcaggcagttattcctaaacaccaaatcacagtgttttaatttgtaacatgttagagaaaacgacaggactttctgtagtataaatatcctattaattaatgtttgtgctgttaagttacagggctttgactcttgagcctcaagaaggcaccaacccaataaattttcagcattgattccagtcaaatcctcaggacagtgatgcaaggccagcgtctgggcccatgttttggaatgacagggttgtcttggagtattgatctgctctttaatagaaaattgggaccaggcatgggggctcatgcctgtaatctcagcactttgggagactgaagtagtggatcacttgaggccaggagttcaagaccacactggccaacatggcgaaaccctgtctctactaaaaatacaaaaattaggtgggtgtggtgttgtatgcctcccagctacttgggaggctgagacacgagaatctcttgaacccaggaggtggaggttgcagtgagccaagatggtgccacactgcactcttgaaagcaggtttctgataactttggagattgtgccattggattagagagaaaactttcagggcccttattgaaaggctaatgtgttcatatcccaatatgaggcagagcaggagttgattgcatggactgaactaataagggactgaaataattttttaatggcttttgttgtttgaaatattgccgattccttttgtttttcagagtctggagaatttttttcttttgagttatttatatccttgaaatatactttaagtgtattgagtatacttttgtaagcagaatttgaaacatgtttctctcgctgcctaatttctccagaatatggaaactatttgtgaatattctttttttttttttgtccttgagatggagtcttgctctgttgcccaggctggagtgcagtggcatgatctcggctcactgcaagctctgcctcctgggttcacaacattctcctgcctcagcctcccaagtagctgggactacaggggcccactaccatgcccggctgattttttttttaaatttttagtagagatggggtttcaccatgttagccaggatggtctcgatctcctgacctcatgatccacctgcctctgcctcccaaagtgctgggactacaggcatgagccaccgtgctcggctttctttgtactttttttttttttttttttttttgagacagagtctcactctgtcacccaggctggactgcagtggcgtgatctcggctcactgcaagctctgcctcctgggttcatgccattctcctgcctcagcctcccgagtagctgggactacaggtgcctgccaccacacccagctgatttttttgtatttttagtagagacggggtttcaccatgttagccagaatggtctcgatctcctgacctcgtcatctgcctgccttggcctcccaaagtgccaggattacaggcatgagccaccgtgcccagccgaatattcttaattcatggcaatgtgtttcttttcatacatttaataagaacctgttttcttttgtaatgggacacacttggaggaactggttattttcccagtgctttgactgaaatggccttatgataggttccagcaaagccaattttggagagcttatgttggcaatgattcttgctgcactttgtgtagataatcaggtcaagcatacgggaccgaagcctatcttgcaggtagattggtcctgctgtgattygtctttggtggaagtggcagactggagacagaaagattgtgtttcagaagaaaactctatattagcttaatctttgattcctcagtggccacatggtcactcatggtatggagctgcctatgacacccctcctcagcatgaagcagccaggaagatcgacagccagattcctcatgattgagcaattgacaaatagaaagtgagcacggaaactggcccaagactcccacagactgttcttttggaggaacatagaaattgatccttctgctgttaaagcttgaaacttgtattagttttatctgagytccttcctcaggaaaggacctttaaaaaaagtatcagagaactgaaactcaccagatcactgcaccagatgcctccttgcccctctgtagtccttgttttcttacacattgttacatttcttccctggtaacatamacccctagttttagtcagggagatagatttgaggctgagctctcatctccttggctgcagcacctgattaaagccttcttccttggcaatacttgtcttctcagtgattggctttccgtgtggtgagcagcaggacctggaccaaacctcgggtgtttccctaacattctcatagttccacttataatacacttaatatattaatacatgcattaggtggctagcactaattcctatttgtagcccctgccaaatcccaccatgtgacacatagcagacgagcaacatatacaaattcttgtattctactggtcatcgtaggtgattagtcatgctagtccctcctgcttccaggtgcacagggcaggcttattttcttggaaatctgctccccagcctacctcagctcagggcagtctgggcacatcttagacatgcttgaagcctaagtaggcccttgaaccccagtggtctaggagagctcaccccatgggagttcagaaagagtgaamccccgttcctggccctaagatgtcttccctttcacttctcactccgaatgcagaggaatgattataagggggtcctgcctgggcacacagatgttcccaggccctcaggtacctcctgggaccagcaatggctggccatattttgtataagaagcaggacagtgatgctagaaccttctgtagggcaggcttttcagtgttgagatagcaggacaccaggggagcctcagctaggtagcccacactgcttggccacagctgatgccaaaactctagaaggtgagagggcccagtgaggaattctggaggctattataccaaagaggcacagcactccccaaaggcaccagtcatcacaccagaattgaatgagtacctagagctcaatgatggactgcaaccgggagagcaagagtggagtctgtgtgccaatgcctagtcacttgagtgaccagcaggggccctaaggctgcttacaggaggaggtgactgctaggcccactccagcactgtcggggctgaagcagtaaastggatgaagagactcgtgaaggaaaagggggcaccaatggggtgaatgccttcagtttccccacggagtctggatagacaaaagtagagggaggtctcagatgctagagaaccaatgcctcccgatgggtggattaggagcaagcactgaagacagaacatggagacataagcaagattgaacctctggccctacatttactaacaagaagctgtgtgcacccctgtgcagccaagaaaagaccttgttgacctgctggccaaggtgccaggttctgctagggtggggccctcccttggcccatacttcctcctcaccagctggacagcatccaggtttaggttaggcttaggttagcttagcctgggagtttccactcctttaacttctgatttagactctcagggtttcaagttcctataaccttcacttggcctacagtgttttgtttgggcatctctccagtgcagtgcgtaagagcagcacctttggagtcactgggccgactggcctgcagccccacccctgcctgtgtgactacgtgccagtcactttactcctctttggtttggatttccttgtctgagaaccaaggtccatcttgtacgtggaatgtgacatctcgattctaagtcattttgcagttaaaaaatctatcacttgaatattgatatgtcctagccattaagaatttccttctggtcttcaggaaagctccagtctctagtgcatttttcttcttcccaggcccctgctccatgcaccttggtttggctaaccctcaccagtccttaagtccgaagagttcacgtgtcttcctccccactgccatcatcctggtccaagccactgtcctgtttcacctgggcaaccacaacatcccttgtgtccactactgcatcccttaccctgtagaactctcctagcaggacagacaaatattaagcaactagacagacatgttaccgtgatgattaagaagaaaaacgatgtggtgggtgcagtttagataggagggagtcaaggactgcctttctgaagaagtgccctttaaggtgagatctaaaggataaatagaagttcacaaagtgaggtgtgggggcaagagcagagggggcagaggaaactgtatgtggaaagagatgaaggcaggaaagacctcggcctcttgtacgaactgaaaggacgccaatgtggcaagagcttggtgagcagtggcggtgactcccagcggcttagcattggcctctgggtggcccacagcttctgtgtgccttcacggtcctgcacaatctgcccctgctggcccctcatccccagtctcatttcaagtccgtttcttcttcaaaggtgaagccagcatgctagtttggagtggaggaatctgggtcctggaagatcccacctacccatcataataatgtaatgggctgtcatctttgcagctgaacctctctgggggtgcctggatccttccctgctctctggatctggcttcccagtggggcragtacatgtgaagaacatgccagcaggggggaaggggctggctgctgtgacagggtgcaggctgggtcggggttgttgctcagcagacagagtctcctgcagaccctgtggaaccctttgctccaaggcctttgcctgcatgctccttctgctacaccagcctttgggagaccttgccaaatgtgactgccaagcctcagctctctgtgaaagtcaacccatgagcagtgcccagactttcagtaaagtgattagggaaagatgggacaatgccaggtttaagacagccataggtgaccagcagggacsagcagggactgtgggcttaaatatttcttatttgggtattagaggggcatctggcttctgcakgtgggagaagagagggacattggattatattcttttgctctttaatgcataaagaactatctctccyggtacctgtgtgtggctgggtctcccaggatggcgcctgagaggaataaccagagggagaagtgcatcctctctcactccagaaatggaggagcagagcaggaccctgcagaacaaagatgacaagtctagaatgacayggaggcaagggaaatgagggcagggctctacttacagttccaagaacagggtcagcagataatgtaagactttggggaatttttccaacacttcccatgtctgttattttactgtcatcttttccttcttctttacacagattaaaaaaaaaaaaaaccctcagaggctgggcatggtggctcacgcctgtaatgccagcactttgggaggccaaggcaggtggatcacttgaagtcaggagttcgagactaacctagccaacatggtgaaaccccgtctccactaaaaatacaaaaattagctgagtgtggctgggtgcggtggctcacacctgtaatcccagcggatcacgaggtcaggagatggagaccatcctggctaacatggtgaaaccccgtctccactaaaaatacaaaaaattagctgagtgtggtggtgggcgcctgtagtcacagctactcaggaggctgaggcaggagaatggcgtgaacctgggaggtggagcttgcagtgagccgagattgcgctattgcactccagcctgggcgacagagtgagactcgtctcaaaaaaaaaaaaaaaaaaagtccttagaaagcctcgctgcatttcctgaaggagataggaatgaacaggctttggtcctgcctgagctggcagaggagagagcccaagtccagtgtgatctctcagtgccaggcagtcctgtgcccagaaagggacaagcagaggtggcttcagatgagctggagcccccagtcctcagcctcctctctttccctcttctggccttggccccccagctaagcagaagttagacaaggtgtgggcaaacacctttattctgtgtcccaaattccccagggcaagagaaagaggttgctggggtcagtgctgcagggaccatacagactccaaccgcaagtctggcttggggacagacatgctgtgtttcttctggctgtggctggagatggctcaccagagggggtcagttggtcttcacctctaagtctacctcggagttggagagggaaggaagccgaactccagcgagggtgtggaaccctgtgacctgctcttgctcttggatctggtctctgaggcgctggatttctaggcgctgcatttcaatgatcctcccagtttcttcttgctcattcaaccttgcggtgggagctgtgctgagcatgtccctgctgggttctgtaagagacaacaggactcatgtgggcctgtccattgcactgctgcagagccgatcctcccctcctccctccctgcttcctcaaacatttattgggcacctactgtggagcactcaatcccagatgctggaggtacagtgataagccattttgctgtctcgcagagagatggagaagtgaagcagcatacttcagagtgatgaggtgaatactgagaaccaccccagcccagcccctctcctgagcccccagatccgcctgcacagaggcccccamccatggaggctgccccttctcccattctccacatcctagcaggatggcactcttctcctgacctatgttggcttctgaactgccagtctttctccttgtgcaaaacccctgctcctggagacagaccccttcgtgcctctccaggtgtgtccactcataccttgttccttgagaactttctcccctgagtcatcctccctgtctcaggtgctggcatcatcctgggcaatggcagtgtccaccagggtccacggctcacccctgccccgcaaggctgaacttgcagcattagtgaccttggcctccacgccatgccagcacccactcctgtggcttcccctgatgccatgctttaggtctttcactctagcactgttctctgaccacaactgctgtaactgctctgtgcatgacacacatgatcttggactgaactgagaaccctctcttcctggacaactcaatttcttgcctaccaaattggctccttttagatttactcccttttctggccagctagaccccagtgagtttcttcctccatcttcccaacagcaccctcagtgttctagttgccctgtcctcctgtcccatgcgccctgcttgggatccactgggcttcctggatttgatgattggcatctttcatcaattctggaaaaactcttggctgtaccttattgtaatgttgcctctcctcattctttctttctcaaacttcaattagacatacattgcattatcccactccctcctctttgtcttttactatatctttatctctctgggctgcaatctgggcaatttattcttttagctcacaaattcccccttcagatgtgtctaatctactgttcaatctgtccattgagcttctaattataatagttttcatttctagaagtattatttggttccttttcaaatctgcctatgcaattttggaagacttttgcttttttgtcttattttcaaattccttttttattttttcagacatgaaattttcttattttaataatcatactagctatgagtctttgttggttttattctgtagtttgatttttttgttgttgttgrttttcacttctggtggtttattttttcaagtatttaatgacttttgattgtgagctcatgttcctcagaacactatttatgggaattctttgaagcctatatttaaaaggtactcctccagagaaaatttgcatttgcttctgcttggggcctagggacactactactgtggggtccttttaaggtaaattttcagccaagatcgcctyaagccacaaattgaatgcaaattctagactaaaacttgtctgagtagggacttttggttagaaattgtcatgcagagaccttgtctgaagttttttctttccttcatccagagccaagattgacacaaacagtttctcacccatcttcttatgcaagataagttttctcctctagtcaacctttagtttcttaattcgttctattttgctttgactctttcttttcttttctttgtttttaaaacagatatccttgtcagttttcccatatgcataaggggagaaaaataaaaatgtgcctgcaatagtaaactggaaggaaagcaaagttttcctaatattttattaatttatttatgaaaattatatatgctcatagtcaaataactctataaggcttattacaaagaacagtatctcttattctacattccattcaatttctcaatcctcagaggcaacaatttcaattagtttagctaattcctttatatctacttccatactctgctttgattaatgtacttacgttgcctctttgacttatcatttttaggcattctctattgacttctctctatgaaagacgaggatttagctttccttcagcaccttcccctgcccctgcaaattcccgtcctttcatcctcctaattttgagtagatcaatagtcagaatttaattatgatttatataattgctggtcacagttgagccatgtagtatacaatgattcatttctcttttccatacaataatttgtgtttcctaaagttaataattgctttgttttttcatttgtgaaattttatatgtccatattgctaatgaaactgtctcaatagttccatagacagttgtttttgaataaacatagaaatttacccttcttctcttaaagcctgaaacctgtatttgttttatctgagttcgttcttcaggaaaggaccttcaggctccttaaaaaggaaatgtcaaagaactgaaactcaccagatcactgcaccgggtggcccttggcccctccctagttcttgttttcttacccatgtaatatttcttccctggtatataaaccctccccgttttagtcagtcagagatatggatttgagactgagctcccatctccttggctgcagcacctgattaaagccttcttccttggtaatacttgtcctcccagtgattggctttctatgctgcaagcaccaggaccttgaccaaactcctggtgtttcagcaatatattttgtttccttgaccgggaatgtcttgctcatggcagctcggttgctgtggkctgggagtctcagaagccctcctaagcagctgcccacctaattttggctggaggtgaatttccgtctctctctggccctgccacagccagccccaactttgttcctgattgccttggaagaactgcctttgaaatttgacatctgtacacagataggtgagcagcatctgctcctctcaatttgggaaaattttaaaggaatttccatttgtaggtggaacaagaccaactgactgagagggaagcaccctgactgtttcagtatggacactcttgaggacttgtttgtaattgtgtgttgtgtcccggcaagtgagtgtctcttttgggtaccagacagtgggatcagctcctctcaatttgggaaattctttatggaatttccatttgcaggtcgatcaagcccaaccagtagagaaagggtgcactctggctgtttcagtttggacactaggggcttgtttgttgctgcagcagttggatagtgttttggtgattgtgtgtgtttgatatagtcatgggaaatcagaatttagccaacttgatattcttttgcaatactatttggccccaatcttgtttggaatctggactttgctgctgaatggaaaagtgggatggagttgcatggatccaggcttttgtgctgctgttctaagcagagttgggcctggttaatatgtgatgttttccttcggtgctgtttagccccagtgttctttggagtccggggaagtttggcctttaaaaatcaaactgccatggacactgctttacccaaaattttggttcacattcttcactggattaactattggggcaaacaacgtataaccatgtaaaaccagtacgcttgtattggcatttcatggctagagttctaaggtaaaattattggattttcgtttgtgtgtgtgtctacttgtatgtgtctatttgtatgtacacttattgttacatgttgtgtctaccaaactggcttataagtaaaagagcactcatacgttaggtgaaaaagtccaagcaattttcaagttcacgtgacttatgtaaatctttactaaacaaaccggctttaaaattattggtagaatgaaattgtcagcatacatttttgtttgggttttatatatgtctctgctagatattttgaggtttcagtgtttggcatagaaggttataaagctgttaatctagccaaaacaaaatgattttggtatgccttctttgacagatgagactaatttaatgttgttaggtgaatcttctgagttattggcaaaaatatctatgtatttaactttgagcctcttatttaggtgagcacctgatgttcactggctattaagaaaatggttgggccaggcgcagtggctcacacctgtaatccccacactttgggaggccgaggtgggcggattggctgagctcaggagttcgagaccagtctgggcaaacacggtgaaaycccatttctactaaaaaaaaaaaaaaaaaaaaaaaaagttagctgggtgtggtggcgtgtgcctgtagtcccagctactcgggaggctgaggcaggagaattgcttgaacccgggaggcagaggttgcagtgagccgagatcgcgccactgcactccagcctgggtgacacagcaagactccatctcaaaaaaaaaaaaaaaaaaaaaaaaaagaaatggttaagaaggaaataactaactttgtataattgtgtctaatatctcagttttcagaagtaatctagataaactgttaaaaatgaagaaaccaaatacatgtcaatgggataaatgttttaggtaaactttttgtgtaacttaaaatcttaaaattatttttgatgctcattggctatgtgggtatctgggtcatttccaattaagaaagggttatgggctggacacggcagctcacgcctataatcccagcactttgggaggctgaggccgaggtgggtggatcacaaggtcaggagatcgagaccatcctggctaacatggtgaaacctcgtctctactaaaaatacaaaaaaaaaaaaaaaaaaattagctgggagtggtggtgggtgcctgtagtcccagctgctcgggaggctgaggcaggagaatggcatgaacccgggaggcggagcttgcactgagccgagatcacgccactgcactccagcctgggtgacagagtgagactccatctcaaaaaataaaattaaaaaaaaggttatgatatggagaaatatgtttctaaaagttgtggaattgttctcatgtataaaatgctcatatctgatagttcaggatttcttgctttttagggtttcactaaaatttaaggttattaaggataataattatagttaatatataattctgtatatgaaatgggccaaaagatgttattagtgagaaaaaaataattttgtctaatttagaagttattaaaagttaattcaaattatggacatgaaaatttttttatggccgggtactgtggctcatgtctgtaatcccagcactttgggaggctgaggcaggcagattacgaagtcaggagatcaagaccatcctggataacatggtgaaaccccatctctactaaaaatacaaaaaaaaattagccaggtctggtggcacgtgcctgtagtcccagctacgagggaggctgaggcaggagaatggtgtcaacccgggaggcagggcttgcagtgagccgagattgcgccactgcactccagcctgggcgacagagcgagactctgtctcaaaaaaaaaaaaaaaagaaaatttttttatgaaacaatgtaggggagagagatgtgaagaaagttatggatatgaagatatattttttggtaaggaaggttataaagagaagatagtaagtttgtatgagaaagaattttgtatgatgaatttttgtcctggagcaaaataactgtttttttttttttttttttttgagacagagtcttgctctgtcacccaggctggagtgcagcagtgcaatcttggctcactgcaagctctgcctcctgggttcacgccattctcctgcttcagtagctgagtggctacctcccgagtagctgggactacaggtgcctgccaccacgcccggctaattttttgtatttttagtagagacagggtttcaccatgttagccaggatggtctcgatctcctgacctcgtgatccacccacgttggcctcccaaagtgttgggattacaggcatgagccaccgcacctggccaaatgactggttctttaaagaaaaatgaagaagaataaaatctgggactggatggaaagcttaagcatgtcacgcatggtctgtgtaagtcatatgtagttttcgtttgtttgtttctttgcacatacagagaaattagaaagtttagataataaaatattctttaaaaccttataaagaattggagaaatttggrtaattaacactttcatagttaaaattcttagtcttgatgaaggcaaaataagaaatattttaaacaaatgcattggcggtttggcagttcttttttaatacagttaagcatgaagccagatttagtgtgaagccaaatctcacatacatgcctgtattgcttcacactatgtttgctgttttgcatcaatagtgctggcactggagtacttactaataggtcatgtacctagggtgaatttcttgattgcacaggatgtatggtgatattggtggacttaaggatattgaattgtgtatgaagaataaaatattcatcatgtggttttttgggctctgggtaacatggtagtctccagggtagactgagtggggaaatgttggggttggtttcctgtttgttttgcttctaatttttatttgtttgctgtttgttctcttttgtgttttgcttgtgtatgcatatgtataaaatcatccatgttctttagtttctagtggaaggcttttataagttctgaacagaaatagtacattatatattgttgtttggagaggtggatgraagtggaactgtttgagtggtgtttgtttctagtgtgagtcacttgaatcaatagtttgtgttggttttagatcttttcctttaatgaagaagaactgtgatatgggtacaaagttttaatgttcaggaaacattggccttgtccttaaggaaattatattgattagaatttctctcaaactaatttaaagtgacattcacttggattaagtagtaataaaaaaggtgagactttctagtaatttttaatctcaagctgtttatcactgatgggccgtcatgtatgtactcgaaaacaaaatatgttcaggtttttaatacaattaagcatgatgccagatttagtatggagccaaatctcacatacatgcctgcattgcttacattgctgcaaatctcacaaacaacttatctattttttatttcgttgcctgtgctttttgtgtcattcgccaaataaataattgccaaatccaatgttatgaagcttttcctctatgctttcttctaagagttttatagttttagctcttctgtttagatctttgattcattttgagttaattgttgtatatggtgtaaggtaagtgtctaccttaattcttttgtatgtgtatatccagttttcccaacactacttgttgagaagactgtcctttccctactaaatgatcttggtacccttgttgacaatcacttgaccatttatttgagggtttatatctggcctctatattctatttcattggtctgtatgtctgtttttacgccagtatcacactgttttgattgctatagctttgttgcaggttgtgaaatcagaaagtatgagacctccaaccttgttcttctttttcaagattgttttggctattcagggtaccttgatattccatatgaattttggaatggatttttctgtttctgcaaaaatgtcattgaggtttttatagggattgcagtgaatctgcagatcactttgggtagtactgacatcttaacgacaagtcttccaatccaccacttactggtatttaatttctttcagcaatgttttgtagtgttcagtcttttgcttcttcagttaaatttattcccaagtattttattctttttgatgcaattgtaaatgcaattgttttcttaatttccgttttggatagtacattgttagtatataaaaattgcaacatttttgtgtgcattgattttgtatcctgtaattgtgatttttgatcctttgtataaaaattttccttaactcctttggaagtctggaggagttctttcctcatactctggtgttctgaaatttcaagatgatggacttgatgtgggtctgtttttagccactgtgttggatagtaggtggatctaacagcttcttaaacagatttttttctgttttcagccctaccttcacttccacctccagagatatctgcttctgatcattcctgagccttttgagggttttgtggcatacattggatttcttctaggttcaccactctggcttctgggtcggggtgggggtatgttgatgaatcacaagtgacaggagttgatatttgttggaagtaggggactggggtcccaggaattgattagacttctctctcaatttttgtatatgtctggaaatctccaagatagtaatatgaagaccctggctatatcacatggcatcctgaggaggtctcaaatgaatatttgttaggatacttggatatatttaaaacttttttttttttttttgagacagggtcttgctctgtcacctagactggagtgtagtggcgtgatcatggctcacagcagccttgaacctctgaggttcaggtgatcaattttactctaaaatcctcacacctcaacctcccgaatagctgggactacaggcatatgccatcatgcccggctgatttttgtattttttgtagagatgtggtttcgccatgttgcccaggctagtcttgaaccctgggcacaagcgttccgctcgccttggcctcccaaagtgctgggattacagatgtgagccacggcgcctggcctgaaacattttttaagagaagttttgcaattgttcacatctgtgctttattttcaagagaagatggtttcacctctgagaagtcaagcatgtcaggtttttttgtttttttgttttttgttttttgagatggagtctcactctgttgtccaggctggagtgyggtagtgcaatctgagctcactgcaacctctgcctcccaggttcaagtgattctcctgcctcagcctcccgagtagctgggactacaggcccgcgccaccacgcccagctaatttttgtatttttagtagagacggggtttcacagtgttggccaggatggtctcgatctcttgaccttgtgatctgcctgcctcggcctcccaaagtgctgggattacagatgtgagccaccgcacctggccccaagtatctcagtctttatgacacacgctatgctctcacatcaaccctgtaggcctggtattgccacttcaggtactactcagggtttactcttgtttcaacttcaaccctagccaaaagtgcacaagacaacaaaattatatacatatacataaaatcttatatatgtatttaattttgtaattaaatgtatatagttatatagttgaagactaacaataagttgcaaaaatagtacaaggttcctgtgtacctttcagccacttttccccatcataagcttatgtgaccatgggacaagagacaactgacacttcagagacccmatccatagctatgggatgtttcagttcaagcctctaatctttattccttaatgtaaaccaccagaaaacaaaaacttgaaccatgttggcttaatttgccatagagatgccttaatctcttggtttttatcgattgtccagataaggagtggatacttgaaaaatgcttctttggggcctgaaagcggcatatgtaattaaaggctgttcattgttactccacattccttttgtaaggatccatgtggtaagtttctcagagaatttattgccagggaaacgtttgtttctccagaaaaaaagctcccttttgccatacaatgagcatgatataaacgatcatatttctttgtttctctttttgccttggccgtcagaaattcagaggaactttaggatataattgcagtaactgactcatttaatatttatgtaattatttcccctcttcctttaaatagctcctcatcttgctttttgtcttcattttaattgtacaggttcacaatcccttattcactattctaaaatgcaagaagatctaaaaacagagtgcttttttaaattcaggaagcttagtgtgaatattcatatgtcactacagaaatactaaagtgtttgattttagggcactgccccagacccctctgggaatgttatataaagtattcgctttctaaaatctaaaagagtctgcattctgaacggtagctaacctcaaggatgtcagccaggggactgtggacctgtgtgtgtcggagtgtgggaaggccctcatggattcctcaaagagcaggtgtgtgccccggacaggatcccagaaggccatgtgtagatgggacctgatacagaaggaagccaaagggagacctgcctgcagctgccatcaatcccttcgtcccagtgcccatctcccctggccactggtgatattacctgtctctgaaacttcttgtggtcggactttcttggtcagtttcagagctgcttcaaggtcatagacttgggaccgagtgaacttcagctccctgcggagctcattaatttccttgatcagagagacattttcctgcagaaaagggggaagagagagggagggtggatggatgagtggtcagtgggcacaaggcataccctcctgggctgagtgtatggggaatgggcagggttaggtctggatccagaactctggatcctctattggggcctgagcctttattccagcctattgctcagcctcttaaggaaccagctaacttactttcgggtagactcagcaccattcacatccacccatgcttgttgcaaygtcaacagcaacaacaatgcttttccatgcactttttatatgagtttaaatgcatcataataaccctatggctattattatatcamaattattggctattatatggctattatattatatatatataattatatggctattataatcacaaaaacaattataaattgttattataatcacaattttacagaagagaaaagtgaggcacagagaggtatatgacttgctcagttacacagctagcaagtggtagagtcaggattccaaccccaacagtctggctccagagttcgtaagcactgtgctatacttcattcatttttcattcatttgctgaacccacatttataggctatctggtaagtccataaagtgcaaacagaaataggatatggtctgcccttagcagcatgctatttagtgagtaaaacagaaaagtaaatggataattaacatctgctgcatccattggaagctcacttctcttatttgtgtttgacaaatatccatccatccatccatccatccatccaaccaaccattcatctaataaatgtttattgagtacctataatgtagtcatccaatattatggagatactatgttaatcctagagtatagagagtgtaaatcttagcttctgctcttgaggagtttacagtttagtgcggggtgtgggtacagtttaacatggtggccaccttgctgtgatggaggagtgggcctagaggaaagatgcttccttctgcctgaatgactagggtggattcctaggaattgacccctgggctgaggcttgaaggagtcaccaaggagagggtaaagggtgtcccagacaactagaacagcagaagcaaaggcacagaatgtgacacagctgatgggggtgggggagacctgcaacagtcctgcatcactggaatgcagagtgaaaggaggggagtcgacaggagtgaggacgaagcttgctgggggccaggtggtgcaggctctgcaccctgggaccaaacagtctctttcctcttttcccacacctcaaatctctgccttccatttcacacccagcacaagtaccccaaggaggagccccatccccaaggkcccaaagagactggccactttgctcttagagcccacagccacagtagtcagcttgtctacagcagttcctcgtgtatgaccatacaaatacatcacctgaccaccttgttagatgcccctctgactcataggtctggaatgggccctgaaatcctgcactgggcttccaagagatgctgctgctggtctgcaggccagaccacactttcagttgcaaagcacctgagggtctgtataccagaaaaggcagttgcaggccaaatctacataaaatggacctgtgccaggaacaaactgtgcttctacttgggacattatctcacgagtggtggctayggagtcagagcccagagaacaggatggtcttaagcactgttctccctgagctgtgacaaacggtcctctgctgtggggaggtacctgtggarcccagaagggagcaggggtygggctagagacaccgcaatgattcttttcctccagaaatgcttcatctaaagcacagatctacacctttagacttccagtatattacttaatttcagtattccttacaatatagtttggatgtttgtctcctcgaaatctcctgttgaaaactgatccccagtgttggaggtggggcctagagggaggtatttgggtcatgggagcagattcctcatgaagggcttggtgccatcctcgcagtaatgagtgcttgttctattcgttcctgcaagaactagttgttttaaaagaacctggcctcggctgggcacggtggctcacacctgtaatcccagcactttgggaggccgaggcaggtggatcatgaggtcaggagatcaagaccatcctggctaacatggtgaaaccccgtctacgctaaaaatacaaacagttagccgggcrtggtggcgggtgcctgtactcccagctacttgggaggctgaggcaggagaatggcatgaacccaggaggcggagcttgcagtgagccgagatcgtgccactgcactccagcctgggcgacagagcgagaccggccccttctcctctcctactctctctttcgccatgtgacacgcctgctcctcttttgccttccatcatgagtgaaagcttcctgaggtcttgaccagaagcaatgctggtgccatgcttcctgtacagccctcagaactgtgagccaaataaacctctcttctttataaattacccagcctcaggtattcctttatagtaatgaaatctctctgtctcggatgaaatgcccagtcctcattgtcaacccctcattcttcatgctaggatttgtacttgtgtttctgaatcagatgttttctccatcgaatgctttaccctttgaaccaacccaggccttgctgattgtagtgtgatgggtcccccaccaggttacttaagggtgtatgttcactgtctgaaccctcaaggccaggcagttagtcaaggccatggtgcccagctgtggagcaggtgtccctgagaatccaarcatcctagaagatatctgaaaacctactaaggaaaacagtcccatggcacatacacagtaggtgaagagccagaaaattagcttaaaagcagcttagcgatgtgaggcaaagcaggtctctagagctgtcctgctgctgcccaggagtgccccacatggaagacctaaataaactcatctactcaccaagctggacttgtcattcttcggtctccccagtttgggagggagggtggggaacattacagttccaaattgtctcataacagtgataggtttcccgcatttcctttccagatgctgcctggtaaaactctgctagatcctcccatggaccttctccttgcagactttatatcatgacatgatcaattcaatacatatttattgggttatggaccttggaccctgccttgcatgttagaggtgctcattaaatatttgtgaaatggatgagaaaatgtataactaatgcagtggataccaaaccgaataagatgagattcttactaataaggaagttacagaccaagggataagggacaggtgaaagagaccagaacagaagggaaggtcttagagccacagggggaagcttgcttgcttgaggtctctctccatttctcccttcagtaggcctcgctaagcttcacttctcctgatcctcattaaataactcaataacaatcatcagaataagcactagaaactgaaagcacaattcgagttctctcacagtttgcatctttagctgcttcctctttttggtcatctccatccattctgtcactgagtcctattgattttgtgtctgagttgattctgatgttcatccttcctgctggtttgtcaccagctctcagtgttctcccttgttctgctgtaaaggccccccggcaagtggagccctgccctggcttctccccaccccctccaccctctacagccctgtcactgtgattgggatttctggctcctggtacctgttggtgtgaatgcctgttcctgacccccctgccaacctctgacatcttcatgatgctcccttacctaaatgggtctccagggcttgatcctttttggagtatgattgaggcccaccactcagtgcagcctgactctcttgttctgttcattcattcattcattcattcacgtattcatgtaagaaaagtaatctaagaaccagttcctgaaagcttatactggtcactgtgccaggcatgggaggtcccgcttggctccactgcagagctgccatgagaggctgaagcatggttgggcccctgcccaacccagtgtgacagtgtgcaaccccaggggagacagaggagaagagtgttccaggcccagagccaggaggcggcaagcagaacctaaggcaggaagagcttgatgataaygataataagagtaaccacaattgcaagggttgattggatcactgcaaatgtatcaaacagcatgcatacagtccctcagttcatccttacaccaaccttgtgaggaaactgaggccgtatctcagtggtagagctggtgtctgaaccctgtcgtgcctccatccagagagccctgctcctccgtgactactgctttccaggctctgctgtcccccctcacatttatgtcacctccattccaatatctcacatagtatgatggccaaggacactcccaataagtataagttgggctacctgcaaaatgttttctggggtggcctgtgttccgaggggtcccgaggtcacattgaggtcgaccgtttttgctttggatggctttgtggattaaaaatgtgaatgcaatgggtttgccgagccttctcttcctgatctctcccttgtcagtttgacttccaaaatcccctccaatcctccagacccccacccaggtctacacagctgcagaggaaatctgacctggggtccaccaacgtgccaagtcttgggggatgtgaaactgtttatgtaaaaagctttctaagcaaaggggctctgccaagctgtccaggactgcctttggcctttggaactgactgatgaccctggcaggtctttccgacctccgtattgagcagagaagagaagggaatgcctacagcaccccctaatggcatggcctgagtcgatgcctttagaatatggcagtacctcacagcctggaaaaagcaggcaacagatttattccatggacttggaatccttgcatcagtgacatctttctggaacccacagtcagtgggctcaccatctgcctaactgcacaaatgagccatcctggaatccttctccgttctttcaaccttcctcccatgtctaacctgacatttctatttgtcatttctactctgaaatgccttttgacaccacaactttcccctttccaagtacttctcatctacccttaacatgacagtcatttcctaatgggtttttctgccacctgcctctttccccaccagtcttcccaccttgccaatggagtgttttgtcttttcaaaacaaagacacccctacttaagaaaccttgggtggagcctgtttacaggacaaactgtactttttggcatggcatggacgccctttccaacatgaccctcagccaccaaccatttcagtgggttcttctccacttggactctcttctcgtggactcttgggtctccaagcacctcacaggcctcactcttctctgctttttctcaggttgttcccacagcctggaagtctcttccctgacttgttccacgatcaacctctactcacccttcaaggctcagctcaaatgccccttgccccagaaaccttccacaagtcctgaaggcatcactgaaccccatttccaggatgagcccacagcactgcatacaatgagttgagcagtaattatttgtatctggtccaggttcccaatgattaactccttgagagtaggaacactatcacgttcatcttggaatcctcagtgactgacacagagcttgctgtacaagaagccctcaaaaaatgtgtactgaatgaataaaatgcatgtcctagatgtttgtatctcatagcaactcttattttcatatctgccagtgtgctgaggaatggagtggggaggctgagctcctgtctgaataaacaaatgagacagtgacctcattttctgttattttctaatgagttactcttagatgccatgtttgctgtggccttcctcagcctttttggattgaagtgccagggccatggcaactgaagatgaggtccagctggctcctgaccagcacacaccaaggtcaccaactgagggtctggaatcagttgtgccatccaccctccaccctccacccctgccacctgcagtccacaggcacccgtggcccatcctgtgatgggcttctaggctttcccactggatttctaccttggttcttggataggtcctttgcttggatgaagaggatggaaattgccttttttttttkggggggggatggagtctcgctctgtcgcccaggctggagtgcagtggcccgatcttggctcactgcaagctctgcctcccacgttcatgccattctcctgcctcagcctccagagtagctgggactacaggtgcccaccacacgcccggctaatttttttgtatttttagtagatatggggtttcaccgtgttagccaggatgatctcgatctcctgacctcaygatccacccgcctcggcctcccaaagtgctgggattacaggcgtsagccactgcgcccggctggaaattgcctttttttttttttttttttttttttttagcacttattctgtaccaggccagtgcctagtgccttatgtggttgtcccattcaatcttgcaggaaccccccactctcaggttggtgttttcttccctgttttacatataggcaaggtggctccttgagttaaggaatttacccaaggtctcctggcagaggagtggtggagcagggtaaaccagggtcggcacagtggttttgaaaacttttcttttttttaaatcttccagacttttttccaacaaaaagagctccactgttagcagcaagcagtctctttctggttgaaggggtagggacccggagacccgcaccccctgccacacaccccccaccctgggccccttcttactccctgcagttgctggagttacttatttggatccacaggactccctagcacataggttacaatgctgctggagaaaatgttcttcccgggacttcatttgttgatggctccctctgccagccatyagggagtggcagggctgggcaggaggcccgcttgggtctcctctgctttctaccccaccctggcccagcaccctccggggcatagggaagcagaagaggacaggatgcccgccccagcagcctcatgctgacgctcacaccctctggctagcctgtgatcttcctcctcctacatcgatgtttgctttggctgcttggcatggagagagggacccagttcctcaggcctgtactctggtgacagggcacagagggtgctaggtgatgtcagcagctgacaactgctcctgctgtcatcctggtttcccttccctgctcactgcactccagagccccagggggctctccatgctctaggtactccaggccctaagcagtggctcmgtgtgcggctgctggtgtctcagggctccaccagctggaggcacttctatctctgggcctccgatggctttcatggccaaggagtagggcaaagggtagatggactgggctgcttttcagcagggactggtcgtaagatgacatgagaccagccctgcctgggtctggcctgaatcacagtgcgctctgcccagctstgtatgaactggccaagctgggaactggtttgtttcaatctaactgcaacctgttcccattccagtattttaattatggcaataaagaaatgtgaacataaaaaggtacgtgctttataaatgtgattctgatgttcccttttgatactaattcacattaattgcctcagatgatactgatacccaaacagaaatctggcagaagaatcccgactggcagtcctgataacgtgcctgtgtggaggcggcagtaatggggtcaggctctctgaacagcctatgaaggatccagggaggtgggtgtgaggcgcttattaaaccagagtgaggccagctctgggacgttgtggctaacttgggacacaagagataagggtagggacctgaggcaccagaaaaatcagatgaggcgtggccacgagatatgggtagcagaatacaaaggagcaaaacaaagtcaggtgaaatgagagttgggaatggaagagagaagggaaagtggctcaggagaggtaagatgatgtggatgaaggtctagagggccaaggggctgatgagaggagtgaggcaggggacacaggtgtgctctggataaagatggtgtagaaaagaggaatcgggtatgtggagaagggaggtgggcattgggtggggtggaggccagggtgcagcatggaagtgcctagaaaacctcctaggtgagctctcagccacagtcasagccaagacgagctcaraggagaggagccaaaataagactttagggggagctactgggcccccagacacctggggagccctgaagacaggtggtctcagagggacccttgatgggatctctcatcttggatggcttggcctccacaggggctgaggggagcatgcaggtacctgcatgatgcggacgtagtctgtgcggtgcagctcgccctccttgaccaccttcttcttgagagtggccaggttcctctccaggtgctcccgctgccgggtgtactcctgctgcaggtctgtgttcagccctgcgatctccacctgacggggcccaggagattctcagygagggagaggagaccccggaggtcagtgcatggcaggaggggaggctgagcttaccatgtctgctcgctgcacgtacttctcaaagagacctcgaaccttctccttcagcagccgcggttcctgaatataggctacgcagttgtggaggtctgttttaaaccttttgacyagcgcttccaagtctcgctcctgcaatcagagacrtttccttctggtgctgtagggtgctctcrgtggaggggcgggggctgcaggcagaggttaatggcacagaaagggaaaagagatgcctcatctgggacttacagctgactgccaggggccayactgggcatagaaacttagacgggcacacagccaacaggtggaggcacgaaaagtcttgtgcacctgccctcggctggacacccagcctgaacagcctacatggggcttcatccttaagaggccacacagatgggctcctttattgactctgattccctttcaggaccacaggccttaaaagataaaaggaagctcatgtggtcacccatatccctttagagccaagacagatggcatcatttctctcttgcagattcctggccagggcttccacgtcccccgtgttagctcatccagtgcttacccttcccgatagtcaggagcgctgctgtgagtgggcaggttggttcatctacacagttgggctagtgtcccctcttcatcatgcttttacctgtcttccccaaccctgacctrgagaaagtcatttctccttgctcccatggccctttctacatgttccatcgtyttctacctctcaatataactattatgcacatgccacaaatcaccagtcatcctcttcagcatggaaatggcaggatctgtatcagttctcgtttatagctctgcagctgctggtgttacctagtgcagagttagttaatgcttactgcagaagatggaaatttccaatctttttttttttttttagacggagtcttgctctgtcacccaggctggagtgcggtgttgcaatcttggctcacggcaacctccgcctcccaggttcaagcaattctcctgcctcagtctcccagttagctaggactacaggcgtgtgccgccatgcctggctaatttttgtatttttagtagagacggggtttcactatgttggccaggctggtctcgaactcctgacctcgtgatccacctgcctcggcctcccaaagtgctgggattacaggcatgagccactgtgcctggacggaaagttccaatcttattcaacaaatgttaaggagtggcctgtgctaggcaggagggcacaactgtgtcctggcccacatccagaaaacctagattccattattagcyctgtgtgtactacctagctgtgggtgctgggtgaagtttcttaacctcccaatttttggggcctaatttttcttatttataacatggagaaatgggaatcaatgacctttgaggttcccctggccttggcaatttttcggtcatcaaagccttaaaccagcggcgacaaattgcctctctgagcacgtactttcctcctccaaagaagccaaatgctacaaatattcctgccatgctggcttcccacctccttgatcacttacccaaagtcattttatagtctcagatgagttcagtgatgtaaatctacatgggcctgaaatcaggcagggctgggagcaagtaaagaatgtgagttaaaatgggaaacatatcctcgcagtgggctggctctgcctcttggaagccagctgcccattgcagataggtgccagatcccgaatccaagaactgccagactctgaaaccctcacaccttctgtctctctctgcgcatctcctgatcggtggctctcagtttctgccacaattctgtgatgttcagctccagttgagtgttctgcttatggaaattctccagttcagcttccatctgtagacaacaagggaaaagagtcaagaagaagaaagttagataatgaaaactgtatttgagaactgtagtctttcagwggggatgccacccctgacacccgggcatttcttttctcatccccttctgtgtcctctggatcaaaacctttcttctacttgctttcctaacagctccccacccctagactgatatgctaaaccagcatcaygtgtttccacggccaggctgggaagttttccctctgagtcactttccctttccttcaaccatgctgattattttattttcttgaattccttataaattggtgacacccaagcactagaacctcaactctcacctgaggcagggttccccagagaagcaccttcctcacctgctttctgaagttgtataagtgaatctcgaccctctggggccactttagaatggggtcattctaaagcagaaagtttggagggaccaacatgtgggcaccacccatctaaggcataaaacaggaaaggggaagctgagaaggggcctcagcctcatcattctgttgaaaggtcttaaaaagtacaactgagaagtgtcctgtcttcacaagaaaaataagaaaccaccagtgagcttctgaaatacattttttttagatggagtcttgctctgttgccgaggctggagtgcagtggtgcgatctctatcttggctcactgcaacctccgcctccgggtttaagcaattttctagcctcagcctcccgagtagctgggattacaggcaattgccaccatgcccaactaatttttttttttttttttttgtatttttaggagagacagggtttcaccatgttgtccaggctggtcttgaactcctgacctcaagtgatctgcccacctcgccttcccaaagtgctgggattacaggcatgagccactgcgcccgggctgaaagattttttaaaaattcatttttgcatttatattaaccaaagtcatgggaatgacaactggagtgtccaattaggatgagactagctgtgcatgagctttcattgacctaactcctaatgacttatggactatatctggtggacactagtatttctgataagagggaggtttgctgactgttttgggagaatgggatcattcactggattttttcacggctaggtagagtagaccctccccctctagtctatcccaggccctttggtcaaatttcaaggctcttggtaaccttctggggggtgccaggaggccctaatgaacacatccatgttctagacacaaaagggcagcttttagaaggttttcctcattactggaagcattttgtatagacagaatagccctctgacccaaagcctggcataaaggtggcactcaaatatttsatgaatgaacgaataatggcaagtgtggtggacaaaggagagcaatagtgagggacacgaaaagagcctgaaacaccctgcttctggaagaggaatgacaagataagaaggcagtgttggcagagttatatagaaccaccttgtaggggatacacattgagtgtgggtatttgcacagctaaagaatgtgcccattagaaagggccgcccagcttgttgtagacttagagatctaaggctgattaagaagtagtttctgccttcaagaggcctcaggtctgcaaggataagaaagaagtaaatcagaaattcaggtggagtaggataaacactgcagttaaggcagaaagcactgtgtgtacacagaggaggtgagcaggcagcacccaaaaagatgggatgcgtccactggatttgggaggaagaataagtattagaggacaaaaggggaaagaattccaggcagacagaacagcctgcacacagagaggaccagaggcatgggcagcctggcgcatctctgcaggctgcaagtggcttagggtggctgcaggagcagggatttgaagaggkgggagaggggagggagaagaggctggctgagctaggtcatgcaggatccaagggcagaggctcaaatggtgagaagtttgcctttatcctgaaagctcagagagccactgaaggcttagaccaggagtggaatgatgtmatttgcatcttagagggcctgatgcagaggttctgctgaaaagagcaagacgggggccaggcagaccagtcaggaggctgccagtttggctgaggaggcagatgatagcgtcctaggccaaggcaatggcagctggaagagagaaagggggcttctgtttgyggggctcccgaagatcatgtctgagtgcctcattctctaaatctcaggccagcagtgacagatgaggttagcagagagggcatacaggagtatattgtttacttctgttcattttttcccccaggcaaagactcatactactctgagaataaaaataatctgtttatagaaaaattgggaaataggtcaaatttgagtagctggctggayagccagaagcctagccccttatgtggaaacaagcatcttttcccagtgtggaaartccatctacttttccatgtgtttttcatcacactcagagattctcmatggggctcaggcaggagggtagaaagcattttgcaccccccaggggacctctggcaaggtctgaaggcattttttagttttaacatcctggatagggggtgtttttgggatctagcaggtagggaccagggacgctgctaaacatcctacaatatacaggacagaccctccatgacagagaattacctacctcaaaatagtagtagtgctgagcttgagaaaccctgccctagtaaatgagtgtaaactaaaacgacaagcctcgggaaacctctcccctaggcagggcaaagggacccttggatcatcagagccaagttggaaaaagagtatgtgagggcgggtacctgaatcaggaagtgttattagaagttgcagctctacaaatgagccaagggcttgaggcttccttcctgggagaaaaagacctttacaggagatccacagtgcatgaaccaaaggtgtctatgacccccagagggaagccccaaggtcagaggctcccagaagcacccaggcccaggtatcagtcctgacagcaactggcaccagcgaaaggaggtaggagggatcctgctggaatcactcccaaggtgcaagtgtattccctgctgagcatcaaggccacggttggcccctgttactgccagagaagrtgaatggtccccccaggtgtgctggtggggaaagtaagctgaccattagcaaacaacggacccgacctgaaatgcagctgacaaatgtgtcaaatgaggaaggagaaagggggcagtgatttccaggggcctgtggtgtgctggccctccaggtgggtggggcctctgctcttcctctcatcttctcaggctgctatggtctgatgaacgttggtgccctccaccccaaattccaatggtgaaacctaacccccaaagtgatgggattaggaggtcaggtctttgggaggtgatcaggtcacgagggcagagccctcacaaatgggatttgtgcccttgtacgagaggctggagggagcttgtttgcccccttttgccctcccatcacatgaggacacatagcaggtgccatctatgaggaacaggcctggacaccaaatctgctggagccttggtcttagactttccagcttccagtactttcagcaatacatttctgttggccataaattatcccttctaaagtattttgttatagcaccccgaaaggacgacagctgccattttggggccctgaaagcactcaagaatggtaggaggcccagcggaggcaggtctgtggtcagctgggggcatcctttctcatcccagaagccagggaaaaagtcattgtcacaaggacataccctctctgggccccctggccctggactgatctccacctggctctttactgggcttaccagagtacaggcgtcaccgggcagactggcacccccatggctctggcacttctagttgggtcatcagtgctgtctgacacccttgtatctgttatcccggctcagcacaaacaattagagaagatggaggagggagcagaagcctattttgtctagggcggtcagggaaggcatataggctgagacctgaaagatgcaaagaagccagccatgtggcgatctgggggaagagccttccaggcagaggcagcagcactgcagaggtcctgagatggaaaagcgtgacttacaggaactgtcagaaagtcagtgggctggagcagggagggggagctgtgagaggaggctggagaggcagggagaggctggatcacgcaggaccttgtgggcctgactgggactttggattttactgtaggtgggatgggaccccactggggagttcactcaggcctctatgtggagaccagactggaggctggagtccagtccagataagagatggtggctgcttgtaccagggtgatagcagcagcgggaaaggagggtttgatgtgagatatgttttggaaattgatcagayagatgttggtgatgatttggataaggagttaagagaagtgaagaatcaagaaagacttctgcatttctgcattaagtaactgggtggatcayagaccactaactgagagagggaaaactggaggaagggggagagaaaaatcaagaattcggttttagatcaacatggacgccactgtcagcccagcaggggaggctgatggggcaacacacgttgcagggaaaggtggcgtgtggtsgggggcatgggggacctcacaggattctcagaaacccttgtccagttgatcctgcttctaatctcgcctctctaccttcatcctgtttgcttcccagaacatattcttaattatgccactcttctgctcaagagcctctgatgacttctcattccttatcagatgaagtccaaacaccatggcctcacctggggtctcaaccaacatttccagtttgagaaaaaaatgctgaactagaaggatagcctgttggctgagtacacactgccctctggtggccaaatgcccaatagctgcatctcccttaggagggcacagtacaccgcacactgaggcacgggtagggccaaagcccatctccaggtcccgtggcaagttaactcccaagcgatttgctttcggwcagctgagcctgcagcggggccacggccttccctgttgcacccctgtggactggaggctgcacacaccttgggagcagagaggactgtgagaagagcttctcctcagtccctgaggccagctagccaattgtggaagaagagacagagggtctgagaggccagagtgttgcaaatggcttcttacctcctgaatctgttccttcatcaccctgatctcattctctcgaggttctatttgcttcttcagctcctttattttgtagtcaagcacaaacttgaatttccctagttcttgatttttctttttcagatcataaattcgcttctcctgggggtgagatgagagagaagtgagagatattgtaaggccctggtatactgcagccctttagggcaaaagagcacgaagcctgtgactctcctggttgaagaggtcaaccaggagactcctctcctcccttcgtcagtacagaggctggcactccccccatggggctacagcacagacccctcagcctctgtayaaggactctcatgcattcactcactcattcatattaggttgtgaacagcggtattttccaacgatggcccccacagcatctcccgccccacactccagctgttctacagcgtgaccttgctgcttctccatcaggaggtggaagcgaatccccttcccttgcatttgccttgacttgtgacttgttcgtaacccaaataatgcagcagaagggagactgtgtggcttccaaggctaggccaaaaaaggccaagcagcttttatctggctctcttgggacacctgcattgggggagggcatctgctatgtaagaagtccaactacactgagacatccaggctggtgggcacattaggggctctgatcaaaagacccagctgagcctagcctcccagacacccctgccaaggtgccagacatgtgactgaagaagccacattggatgttgatcttccagcctccagctgttttgagtcacccccagtattcccagctgaggccccagacatcggggacagagataagccatccttttgtaccctgtccagattccagatctgtagcacctgtaagcagaataaaatagttgctttcaatcacttagtttttctttttgagatgggtctcactttgtcacccaggctagagcgcagtggcacgatcttggctcactgcaacctctgcttctcaagttcaagcgattctcctgcctcagcctccagagtagcttggattacaggcatgtgccaccactcctggctaatttttatatttttggtagagatggggtttcaccatrttggccaggctggtctcgaactcctgacctcaagtgatccacctgcctctgcctcccaaagtgctgggattacaggcgtgagccaccacacctggcctcaatcagtaagttttaaggttaatttgttgcacggtgatagtaatcagaacataagtatatccatccatcaaacatttactgaatgaagatcttttgtcaagtattgggtttccaaatataaatacaacacagtcccttgcccttaaaagaaaacactagttgggaaagaagacacagaagcaaatctaagcctaaaatgtgataaatgttgtaaagcacagaaggcaaagtatatattgagggtgctgagaatgactggcttgagagccaagcggtggttcatgggggaagtgagaggtgaggctggggaaatagaggagggaggtgagggtcttcatgttgggggaaagagttcagaatttatctcctaggccaggggttggcaaactccagcctgtgggccacattgggcctgctgtctatttctgtaaaactttattggaacacagccaagttaattgactaatgttttgtttatgggtggtttcacactacagcagcggtgttgattcrttgagacagaccacatggcctccaaagccaaaaatatttactacctaggtctttacagaaagagcgtgctgacccctgctgtagcaatggggagctgtgagggctttgagcaggagagtggcagcattgcacctgtaccctgccagtccatggtggtgggagatgggaagtgaggccattagactgcttaggaggctgttgccactttctaggtgaggaggcctttgtctctttcttgtcaaagccccctttgagaatctgaacagagctttggatcttccctaaaaacaaacaaacaaacaaacaaacaaaaccctggatatgtacaccgacactcacatgcagaaatgacatccaggcatgatcccatgatcctatgtgatccttacaagaccccttgaggtggttatcatccccattttataggtgagaaaatgaaggcttagagaagttgctcgaggtgcaatggtcaataaatggaacctgtgccagacctagttccctaacactgaagcccacgtccttggcccttggagaattccacctgccttgggccgtagtggcaggggagatggagaggagggcacggaatctgkatgtgctcaggaggatgatactacatactgggtattgaggtatctgccccacagaatgtgatgtctctgacgtctgagtgttttgtaagaaaggcatcccaaaagtggaggcagcctcctggacagggtcaatcccaggagagtccctctgcgacagggggaccatgtggtcagtgcggcaagtgagctgtccccagcccatggggaagcrcctccaaggatgcctggagcagtggagtcagctgactcggttcttattgcagcctgtcacctattgaagtgtgtgaccctgggcaagatacccagcctcttggagttcagcttcccgaaccataacactgggttctcaggccccctgggttgttggcagagctgaaagtgatgtgttgacagcgattagcccagtgccaagcacacaacaggcacttcactgacggctggttcccccatcaagttaaagaaatgcgtcctgagaagctagggaccctctctcccctgagctttgccttcctcgccttggcccatctggccgtagctgagggaggacagaaggagagctgcaccttgtcttgaatagtctcgtctctttcctggatctctcgcttgaggccttggatgtccttctccagagacttaatgactccttgcagcttcatctgctctccttttagggtctcgatgtcattggttcgttcttcaatctccttctgtaggctgctgaactagaaaagcgaacagcaacaacaaagaccactaaagtcagaactcatctccatccctcccactgtctcagtgtaaggggctccccaccactggccaccttctgtggactgaaaacacttagcattcaacatttctgggattttaggagtgaatatctggagcatttgggacggttcaggaatttcccaggccaaatggatgatgtagtattctgtcccataacatccaggcccattctccatatgagaggactgactgtcttcacaagaggttccagagaccggtacaccaagtggaccagagacttctatgaccacactgatcttgaaaagctgggatccacactgcatcaaggtcacagaaagtgggccctaactgatgagccatcttagccatgaccaagaagggaagactgattgttccctggatttactagtgtgctttctaataggaagaaacttcagcttgctttgaacttagcttttccagggctaaatgttttggggaaactgagttgaatcctccctcacccctgatggtgagtgaactaaaaacatcttccccactttgtaaactaagcatcctacacccccattccctctcccacctgtggtgctgaacaggagccgcccatgactccctggaccaagagcccgaggatgcctcccggccaagacttcatctatctcatccccagaagaccttatttccatttccatttccatcggagggttatctcagaaaacattaactgaatcctacttgccagtaagtgaaaactagaaagmctctgtctgcacacagggaaccccaatatcctgtgaaaaggagagcagggaagcccgtgcagctgcctttccaaggaygaggtggggagggtccatctgcgtgagggtgcactggctggtgctcttctcccagcctgctcgctgaagatggggacaggcaggaccctggccagcacccccaggccggtcagtccacccaccccagctttctctgcaacaccctcgcccaccctaggtctcttggagaacagcctgctaccttcttcctcatgatgcctgtttctcccttgagccgcaggtttgattccttttcatcccgaagctttttctcatacttggttttgatatcttggatttctcggtcttcatcttcctcaatctgcttcttggtctcttcaaactcccgcagctgctgcctgacgtcttcctgtgcctggctcagagagagtgggcgtgtggtcaggggagaagggactcacacatctttgtgccaacagggcttgaggtgagatgagcatggggacctgtcccagggagtcaaaggcgagtgtcattccagaaacggagaccatggccacagggcccttgacctgtccaccttcttcccrtctgtcctgtcttcctgcctcccctcttttcctaccaaatcaggcctcatgctccaccacttcaaccccaatcttaccaacaccccatccctgttctcctttggtcttgttcactggacacccagccttcctatatttttctctcacagaacttgtgacagtcataatgttatatttatttgcgatgttatttggctgtctctcccatttgatataagttccttgggggtagaaaccatgtctgacccagtgtataacacatcctggcatacagtggctatgccatggagatctgagtgaatgggtggcttttctctgtgaaagggaggcacagcatggcttcctgtgagtacctcttccagaagggtggttttctcctgcagttttgcctcgtaaaactcagtcagctcctccagggcctggctcttggtctcatcgttatcccggagctgtttttcatactcttcctgcatcctctgggacttgagctgcagctcctggtacttctcatattctagaagcaacttttggttgttgcaacattctggagagaagcaaggatggtatttaaggtgggagagcagcacttgcttcagggacacccaggagccttgggcgctctcccatcccttccagcaccagctggagcagctgcctccagagccaagattcaaatgcctgcctagcttccttgctgccaacccctcatcccatcatctcatcaggtagccaaactccctgcctgcctgctctgggaagaaaagtttccaggaaagcacagagtggtatttggggactcagggccaagaagaatatcctgagtgtgaaaaataagtattaggactcctgctttatrgcaaagtgaggctcggtaaggttaggtgactccccagagcacctggcaagtacgtggtgagcctgggacccaaggcaagactatcaggttccaaacttgaccttttccgtgcctcctactttcatgcaataggtgtttaatgtgcttagtgaatgagtaaaaacacagaagtgaaaaccacagtgagttccaggggatacatgtagcctgtttttagacagagccatattccctgagacttctactgtgtctgggggactcttgagtgtttccccataacctagctcttccaaycctaaccaacgaggcctctacttgtgggctcacccatgtcctgcagttcccggctttgcttgtctaggaggtctyctatgtgctcatggtgataaacatcctgcttctctttttctgttcttaagacctaaaacagagtcacatttcctcatttacacacatctgctgaaagcactactagggcaagaactgattttacaagtaacaccctccttcactcacaaacatttctcaagccctcattttgcaccaagcactgttctatgaagcagcaaccacattgtcacttttcatttatgttatattctgctctaaaagctctatactgttcctatttctattcttgctactaaatgggtttgtcaatgatgagttcagttttggacacgtgtcaaaaggacttctgggtgaaaaagtagggattcatttgaatcctctgttgccagcacattgctgtcaacaaaatccttggctgtgctcatgggtaagcttctgaggaagtgttttctttaactgagcaggaaagctttcaggcttggggggcgagttggaggtggtgtgccatcttcaggacctaactttgcgcctggcttatatagagcaccaaataaatgtttgttggctaaatgaataaaattataaagtgaattaattaatacaattaatagccaaggtttttctttctttttttttttagccgaactttatgacccatagacattaaagaaacaaatatccctcaaggacataattggggatttctttagggggtgagggacagggcctcgctctgtcatccaagctggagtgcagtgcagagatcatgactcactacagtccccacctcccaggctcgagcagtcctcccatcccagcctcccaagtagctagaactacaggcagatgccaccatggcagactcattttttattttacatagagacagggtctcactatgttgcccatgctggtctcaagctctcggatacaagcgatcctcctgcctaggccttccaaagtgttaggattataggggtgagccaccttgcccagtggggattttagataggagtccagatttgtgtagaacaaagaaaagaatctgggagagtcccagaccaaatctaactatgtaaaggccatgtagactaattttatttaacttcctgacaatccaggaatcagtattctgctagttattctccatctatgctttgattttcttatctttttgctttttcttatcktttcattttgttttaaaataagtttctcctaatcataattctcattgtagagaatttggaaattacaaaaagtatgtaaaacaaaatttaaattatctgtaatctcaacttccagagataattatactgttatctattttctatatgtattttactactatagatcagattaattaatctgttaataccactaataccgattaataccattcaccataaagtggtttatattctgctttttttcacttagcaattgattgtaagcatttatttttatttatttatttatttatttttagacagagtctatgttgcccaggttggagtgctgtggagcgatctcagctcactacaacctccacttcccaggttcagatgattctcatgcctcaacctcccgagtagctgggactatgggcacgtgccaccatgcctggctagagatgggatttcactatgttggccaggctggtcttgaactcctgacctcaagtggtctgcccgccttggcctcccaaagtgctgggattacaggcatgagccactgtgcctggccagttgtaagcatttctgatatcaacgactatgctttaaaattggacattttcacatatcttactgtttgagcatagcttgggcagtatatgccagtcctgtcttgaaagtggaaatttcttgttatttgtgcttgttggtcagtctcttaaacagacctggttttttgttttcaaggactccatttcctggatgaacttgtctgttagctccttaatcttctcagaatagttcatgtcctttagtcggagttgatactcattctccatttttaattcctccacacgagtctttagctccaacataacctgagcctttgggagaaggacagaaggatcaagaacactgacagtaagggtgactcagaatatttaaacctgcggccttgacctgagacctgcagctctgcctagcttcaaactcaatgtgtctcaactagaacttgtcatcttttccccagaaggcacatcagctaaaaatgaggagacatatgagcttcctcctctatcctcaaaaaatctttactacattgtgctagtcatgcgctcatctcattcaagtcrgcttaagcatctcctgcttgacgaggctgacttgcaccacactgtttaattctgcaaccccttcccattcccaggacccatcacctctcttactctgctctacttcttatttccttagatcttgcactttctacaatttacttattattttgtttattgtttttattcttctttccccatcagaacttaagctccacatagaccagaatctttgtagggtttgtttgctgatatatcccaagtacgggaacaatgtctaacacagagtaagatctcagaagatatttattgaagcatgatggctgtccccatgtaacttagagtctactgaggcagccagacaaacacattattacaaattgtggtaagtgcccaaagctgggtggttctcagtactgccaatctgtccctcttgatgtcttcttaggctcacttttartactttaatataggtcctaactcttctgtcttgctggtttttatgcctagtatcttcttattcttcctttttttctcttttttttttgagacatggtttcactctgtcacccaggctggagtgcggtggtgtgatcatggctcactgtagccttgacctcctgggctcaagtgatcctcccacctcagcctgccaagtagctgggactacaggcatgccccaccacacctggctaatttttatattttayattttttgtagagatggggatctcactatgttgcccaggctggtctcgaactcttgggctcaagcagtcctcctgcctcagcctcccaaagtactgggattacagactgagccaccgcacccggcctagtgtcttctcccatcgtactcaatgatgccaaagttttctaaaaatactataatacacacacccttcatttccttaaaaagttaatgttgatgacagagtgggtcagaatgcagtgttttcttcttgcttacctatggggacaccccgtgcatccctatctcatcatttctggtctgtctcctctaccacctgtgaacgacttgacatcaaggaatggattacgcacatttctgcattcctggccagcagactagygaggatctggtgcacaggaagtactgagaagaaggataagcacaaattgcacgtgcaaagtcagagaggatggagcaggaatgcctggccagggcactcactgcatgtgatatggcacaggttggatgtataggaaggggcagccaagactgcgtcagaccatcaggggcccggtagaccatgctaggaagtttggattttatcttagagggcttccaaaggtcctcatcgaacccgatcaggctgactttggtgttataaagatctctccaatggcggtacgcagcacggactagattaaggaaggaccaaaggcaggatgatgagttgctggggtgggtgggcggcaactgcatagaccaggcragagacagacagggtttggactgaggtagggaaggggaccagagaggaatggagaggttggagagagtgagtttagagaggatagtgcctgactgggtgtggggtggagaggtaaggatcatggatgaaggctgtctcctaggtagaaggaccggtacctgagggtggggcttggcctgtcttgcttctctgctttatccccagaacctagcataaaactagcagcatggtcagcactgaatgaatacttatcaatgatcccaggggtctgccctggctagtgggatatatttatccatgggaatgacccggcctttgacatgctgtgtttgaggtccttgttcagtgtccttcctccatctattcttcacattgctgcagattawtctctccgagatgcgaatcatgttaagtcattccccagcttaaatttatgaatggtccttatgaacaatgtccagcctaatgcagggtgtaaaaggcccccctgacctgtttctctccagcttcatcttcagcccttctctctggcacaacctaactaggagcagctttgcagaccaccactccctcatccctctgcacacactcactgctcattgctcactggcccttgtccatttgtcctggaaggatctgagcaaggctcatgtcctctggcaccacctggcctgagccaagttccttcccctgtgctcccacagcatcgttctttcatgacacttcattccactgcacgtttaattcccttctttgtgatactctgccctcttcccaggctatcagctaaaggatgctttatgtcttttatctctgtaatcccagaccttagtatagtgtcaggtacacagcagacccctctgtaaatcctaggcagagaaggtaaatcatggcctgagagttayttagactataatggaatataaagagagttgggaattctgggaacatgctttttaagggacaggmggaggaagagmcaggacagaagcggggaggaggagtcagaaaggtttwcagggaacagagtgtggtcacaaggatggtaagacagaagggagtttcaagaaggagcggtatatgcacaagtcatttccagcctggcagcggtactgtcaggcccatctgggggctgtggtcagaagccagcttgggcaccttcaggcctttggttcagcctgctgtctcctatttggcctcttcccctaccctctgggaagaacagaaaagataacagagaaaaggaaatgtcccttctgcagcaggtcaggcccccactctcacgggcccctccctcatcctcttctccctctttgcttttcctgcagaaaattctagggagctctggragggatctccagcgaatgccaggggcttgtcaccgtgctttgtggcagtgttgtattgctgctctgatggctttacttgtttctatccctcacttgactgtaagcttcctggtcatgtcacagggcccacaactgtcttttcacrtgtgcatccccagtgcctagcaaatggtaggtgttcaataaacacacttaagattctggacaaacrgcaatgactgtgtagctttgcgatcctccatgagccttgtgtgtttatcatccattcagcttctcccttaggaagcgtaacacagagctatgcactcatatctctgcaaaacacacctttatggaatgtttactgcatcaacaggaaggaagggatgtccctttggtatagtgattaagggagggggctctggattaaatctggattagaactctagtcctattaattattagcacactgactttgaacacatccctcaagctctcctaacttgttttttgaaacatggggagaatgacagtatcttcttcatagagatgttgtgagatttaaatgagaacatactttacttttgtaaatatttattgattgtcttccatgtgcccagcatgtgctaggaactgttggtcataagagaactgtatgtttcattattcttggtttcaaagagtaggaagagaaaaccagatcacagaataaaagcaaagcacagtgtaagtcaagatgatcacatggcagaaagacaggcagagtcgggtggacagtggcaatgaggaggagagcttggttgtggggacagcagatgtgcagggagccgtgggggtctgcactgggcataggrtgtagccaggctgtagagggccccagtgctggacctgcatctgaatgcagtctggtaagtaattccatatccctcttcattagatccagttcttaccttttcttccatgtytgttttagtcacaagcacctcttcggcaaagcccacctccctctctcgcttgattccccggccatccttatcaaagaccttccaggtgaacaggcagccatcctcagcagcagtcagcaggaactgatcatcaaaggtaagcaacatctgaagagaaaaagggtcatggccaggaagctttcaaggccacagatgaccagggctgagccagctgttgygcaaggcttccccccatgcaatcctgggcacagcctcacagggaggtaaacttgatcccaggtaagaatgagagaggagccctcacaggcatctgttaatgaatagaagaagtaaggttacgtctacattctctgtggatttggaatctgaagagtcagctattatctagaacgwacaagaaactctcaaaactcaacagtaaaaaagccaaacaatccaatcagaaagtagacaaaagataaggagacatttcaccagggaaaatacacagatggcaagtaagcacatgaagagatactccgcattattagccatttaggaaaatgcaaaattaggaccatgatgagatatcactacacacccattagaacagctaaaataaaaaacagtgacaacaccaagtgctggcaatgatgcagagaaactgggtctcatacattcttggtaagaatgtaaaatggtacagccactctggaaaatagcttggcagtttaaaaaaaaacaaacctgaatatacacttaccatatgattcagcaattatactcctgggcatttatcccagagaaatgaaaacttatttccacacaaaagcctgtatatgattggtcacagcagctttatttataatagctgaaaactggaaaaaattaaaaatatcctacaataggtgaatggctatacaaactgtgatttgtttttcatggaatactactcagaaataaaagggaataaactatgattgatacacaacacaacttggatggatttgaagatttagctgagtggaaaaagccacaatcaggacattaagctaaaaagcttctgcacagcaaaggaaacaatcaacagactgaagagacgacctgtcgaatgggagaaaatatttgcaaactattgctctgacaaaagaccaatatccagaataccaaagaactcaaacaattcaacattaaacaaacaaaaaaatctaaaaatctcattaaaaagtgggctaaggggcgggcgtggtggcttacacctgtaatcccagcacattgggaggctgaggagggtggatcacctgaggtcaggagtttgagaccggcctggacaacatggtgaaacctcatccgtactaaaaatacaaaaattagctgggcgtggtggcaggcacggtaatcccagctactcgggaggctgaggcaggagaatctcttgaacccaggagggggaggttgcagtgagccgagattgaaccattgcactccatcctgggtgacaagagcaaaactctatctcaaaaaaaaaaaaaaagtgggctaaggacatgaatagacatttctcaaaagaagacatacaaatggccaacaggtatatgaaaaaatgctcaacatcactaatcatcagggaaatgcaaatcaaaaccaccatgagataccatcttaccccaattagagtaggtattatcaaaaagacaacaaataacagattctggcaagaatgtggagaagagagaactcttatacactgttggtgggaaggtaaattagtacaaccactatggaaaacagtatgtagacttctmaaaaaaactaaaaayagaactaccatacaatcctgcaatctcattactggatacttttctaaaggaaaggaaatcagcagattgaaaggatacctgcgctccaccscacccccccatatttattgtaccaccaatagtaaagatatggaatcaacctaagtgtccatcagtggatgaatgaataaagaaaatgtggtatatatacccactggaatactatttggccgtaaaaaatgaatgaaatcatgtttttgcagcaacatggatggaactggaggtcgtgaagttaagtgaaatatgtcaggtacagaaaaacaaatattgtgtgttctcattcatatgtgagagctaaaaaatgttgaccctagtcgggcatgatggcatgtgcctgtaatcccagctacttgggaggctgaggtggaagaatcgcttgaacccaggaggcggtggttgcagtgagcggagatcatgccattgcactcaagcctgggcgacagagtgacactctatctcaaaaaaaagaaaaaaaagttgacctcatggaagtagagagtggcatgatagatactagggaagagtgtatgggttggtggggtgctaaagagagattggytaacagatacaaacattagatagaagaaatcagttttcttttctttctttctttctttttttttttttttgagatagagtctgctatgttgcccaggctaagagtgcagtggcacgatctcccagctcactgaaatctctgcttctcaggttcaagcaattctcctgcctcagcctctcgagtagctgggattacaggcgtgcaccaccatgcctggctaatttttgtatttttagtagagacgggggtttcatcatgttggccaggctggtctcaaactcctgacctcaagtgatctggctgcctcagcctcccaaagtgttgggatcacaggcatgacccacgtgccaggtcaaagaagaaataagttctaatgtttgatagcagagtaaggtgactatagttaacaacaatatattgtatatttttaaattgctagaagacaggacttgaaatgctcccaacacacagaaatcataaatacgcgagatggatggaaaccctaaatatcctgacctgatcattacatgctctatgactgtaacaaaayatcacaggtacttcataatatgtacaaatactacgtatcaataaaaaagccattttcagaaggccacatacagtataattccatatacagttctcaaaatgacaaaagttatggaaataagaacaaattagtggtaggcagggattcgggatgatagtcgggaggagtggtaggactctgaagggcagatggagatctttgtggggatggaacggttctatagtgtgattgtagtggtggttacacagactgtacatgtgagaaataattcagaactacatacactgtggaccatgtcaattttctggtttgatattttgctacagttctagaagatgtaattactgggggaaactgattgagggatacacgggaactctgtgccatctttaaaatttcctctaaacctataagtatttcaagataaaaagttaaaacaaaaggattaactgtgaaaaatgtcttctcacaatcagcagtatgtgtcaagaatcttgagaatagcaatactcttgaattcaggaattctctctctaggaatttagtcttaggagagaatcagagatgcacatataaatttgtaaactgggctgttcactatagatcataagataatttaaatgcctaattgcaagagaatagtaagttacagtccatcataggataggatatttgtgtagctactaaaatcatgcttctgaggaatatttaattgtatggacaaacgcttacagtagtgtgaagttaaaaactagcaggccacgagactggcctcacagtatgatcttaattttatttaaaacacacacacatggaaatgtagaaggaaatgcatcaaagaaatgatgataccattatgaggatttttttttttttttttggagacagaatctygctctgttgcccaggctggagtgtagtggtgcgatctcggctcactgaaacctccgcctcccaggttcaagcgattctcctgcctcagtctcccgagtagctgggactacaggtacgtgccaccacgcccggctaattttttgtatttttagtagagacagggtttcaccgtgttagccaggatggtctctatctcctgacctcatgatctgcccgccttgggcttccaaagtgctaggattacaggcgtgagccactgcgcctggcaaggatttttatttttaaaataaatatgcattgcttctataatcagaaaaataaatatgttatccacaaaacttagcagatctgaagggaagaggtggaatatgttgtagtaatttactttggacccaaggcccaggcttggtacagaaatgttctgttttataatgagaaaccttttcttaatacagctagtgttgcaggtaagccactaaggagtttgggatataactcaaaacctcaggtgctgtgtcattcaatctgcagaaagagagagtaaggaagaagagacacataccttcccagtgcctgttttttggggggtccagtgtaggtatagacattacttttttttttttttgcactatgaataacttttaatttactattggctatgatttcttggcaaccatttcgcgtgcaagataattcttttttatttcatttttaaaattgtcgtaaaatacatattctgtaaaatttgctatcttaaccattttcaagtgtacagttcatgttattaaatacatttgtaatgttgtgcagccattgccaccaactacccccataatccttttgtcttgtaaaaccaaaactctatacctatgaaacaatcattcctcattcccccttcctgcagcccctgccaaccaccactctgtctttgtgattctgactgctctaagtatctcctaaaagtggaatcacactgtacttatctttttgtggttggccttatttaatttagcataacatcctcaaggttcatccatgtggtagcacattgcagaattcccttcctttttaggcagggtattgttccattgtatagatataccatcttttgcttatgcattcgtctgtcgatggatgcttggttgcttccacattttgactgttgaacatagatactactttatgagaaggrtgaatggaaggacaatttacaaatgtgtactcatggtattgcccctggggtggccttttgtaccctcagggagaggtaggggccaatcttcagggctatggctcctttcagtctggggcattctctggaggaggaggcagctgtggtcaagtgcagcccacactcacggcagctacggcatccaccaaacggccccttattatgcataatattatggtgaaaacgttgtacatacatttttaggtgtatctctgatgatttcctaggctaaattcctggaagtagtttaaacaaagagtatattcatagtcaatagatggtgattcaatgaatgatggatgaataaataagagagaagaaggagagagaaaagacattgggaggttgaagggatgaacaaggcacgtagcaggcaggtgtgggactgggttcctggggagagggccctgctcaccttggtgataggaccggcatgggcctggtactcattgaattccttctgcagaggcagagggtacttcatggcacgaatggttcccaccgaggtgcccacaaacatcatgcgtccagaatgygagatgacaatggcggtgtaggtgacatcaaacgccgatatctctcgaaggatctgagacacaggcagctctgctcagtgtgaggggtcgagctgtggcccccacgtcccagtgccatactctctcgccctctgctctaacagatccctaggggcttgtctttaaaaaatgctttttctatccccttttggcatccggtatagtgcctagcacaaaaaaaggcgcaaactagatattccttgttgtgttgctggtaaataaccaggttcatgagttaggaataatactaatagagagagatattcatatagcacttactatgtgccaagcactgttctgtgccttctccatgttgcaactcattcaatcctcacgaaaccctctgaggcagttactgttatccctagtctatggatgacggaccatctgtgtgaaaggcatttgcttcatctcatgtacctgggtgggctccagtctctgctttgactgctaygcatgggtgcatttcaaaatgagaatgggctattgctcataaatgcattcagcaagcatttattaatgctcattacataagcaaaaccatacattagtctccccttatccttgagggatatgttccaagatccccagtggtgcctgaaaccacagatagtactgaaccctatatatactatggttttctcctatacgtacataactatgatatggtttaatttataaattaggtccagtaagagataaataatacctaataataaaatagaacggttataagaatactgtataaaagctgtgtgaatgtgatttctctctctcaaaatatcttactcacagtatggtactcacctgtttttggaccttggttgaccacaggtaactgaaactgtgggtaaggtgggactactgtactatcagagcgccccttcattccctcactcattcatgcactcattcacccacccacctacacacatatttttttttcttttattattattattatactttaagttctagggtacatgtgcacaacgtgcaggtttgttacatatgtatacatgtgccatgttggtgtgctgcacccattaactcgtcatttacattagatatatctcctaatgctatccctccctgttccccccatcccacgacaggccccgttgtgtggtgttccccaccctgtgtccaagtgctctcattgttcaatgcccacctatgagtgagaatatgcggtgtttcgttttctgtccttgcgatagtttgctgagaatgatggtttccagcttcatccacgtccctacaaaggacatgaactcatccttttttatggctgcatagtattccatggtgtatatgcgccacattttcttaatccagtctatcattgatttgggttggttccaagtctttgctattgtgaatagtgccacaataaacatacgtgtgcatgtgtctttatagcagcataatttataatcctttgggtatatactcagtaatgggatggctgggtcaaatggtatttctagttctagatccttgaggaatcaccacactgtcttccacaatggttgaactagtttacagtcccaccaacagtgtaaaattattcctatttctccacatcctctccagcacctgttgtttcctgactttttaatgattgccattctaactggtgtgagatggtacctcactgtggttttgatttgcatttctctgatggccagtgatgatgagcattttttcatgcctacacacacatttattgaatgctgtgcaccacacaatgtgccagctagtagggctgccaagagragcaaaagatggccctgccctaaaggggctttattctggcacagcactgatagctgccattgaattaggaccaggctactcgggggtacacaggagagtcaccatactgtcagctgtgttccagccacgggagatctgccttgggctagcttgctgccgtggtatctacgcactttcccaggcaccagtcacaggaaaagtgggaggaaccagctggaggagcgcacagcccatgtttgtatgatgcatccttgctgagctcctctcttttcccttcactatttggagcccaatgtaactgtacggtttcagagtttggggatttcaaaagaatacagtggcaagcctaggtgagagcagctcactgcacagtcatgcatcgcttgatatgggatacatggttaggctattttgtcacgcaaacatcayggagtgtatttacacaaacctagctgcgacagcctactatacacctaggctatgtggtagagcctactgstccgaggctacaaacctgaacagcatgtgactatgctgaatactgtaggcaactgtgacgcaatggaaaatatctgtgtatctaaacagaaaaggtacagtgaacatttggcattataatcttatggcattacaatcttacagtccatgtggtccatcattggtgttactcagtgcataccgtagttaggtttttaccccaggaatgtaagtgcagaccaagggtaagagtacagtttagagatgacatgacctccatgcctggaaggtgggagagaagttacagacagcaagtaaaagggaaatgaaaaagagccccgcaatttacaatttcacccagtcaggaaggaaactaggcaggaaattcaggaagtgacgataactgagctaatctaaaaggaatgaggagcctgatgttatcttgggaagaaggggccctgtatgcagaggccctcattccgtgcatactttgtgctgtaagcacgggaagctgtccctgcagatccgtgccccagcccagaggcggggcaggggcagactcaccaaggaatctgcaatctccttgagggtgtggtctgatccaacagcaaagataattttggcatcgggggagacagtaacacagttgtagctgcaagacttgagcacgcattctgtctctctctttcctgtggacagattccattcatacacagcaccatctgtgccaccagaaatcagtttgctatcatctgcattccacacaattgagcgaatctgcaggagaggaagacatatccagtgaagagtgtacacacacttacaccctaacacagaaaagggtgcaaactccttaggtgctccactagactgagcagaacgtcctttcctgctgtaggcccttctgttagcacaaaacatagcttcttgtgaacgttcacattctgttttctatgacgcttgcaaattactgaagatgaaacactctcatttctttttcactttatgaacgtaaagactgaatcctacaggtttcttaaggctagaaccaaccaattattgctgttttttcaaaacatttttgaaataattatgtattcacagaaacttgcaaaaatagcacagagagagtggacttctggaatggcacggtaagracctcaacttgaccttctctctgacaatgtaggttaactggtaaatatgataaaaaataatcatttaaagtctttagaaggctgggtgcagtggatcacatctgtagtcccaacactttgggaggctgaggtggaaggatcacttgagcccagcagtttgagaatagcctgggtaacatagtgaaaccctgtctttataaaaataaaaataataagctgggcatggtggcatgtgcctgaggcaggaagatggtttgaactggggaggctgaggctgcagtgagctatgagtgtacctctgccctctggcctcagtgacagagtgagaccctgtctaaaataaaataaataaaatgtctctggaaattgtcctcagggaatacagcaaatggaaaaacatttattcaagaaaatctactcaatcccagtaagaacagagtctgctgcatttaagccatgactcgctctgttacggcctcagctccagaaacttcactgctgtgcactctgggcagrtgtggccaagataagcgactccctctccccatagctcctgatcttgggctatggtttcggtctggaaagggaaactgctgggatttcttattcttaccccagccccatgttgcagaagctctattccaagcaggtgtggccaagagggctcagactctcttcccctcggcccattgtcacttgttggaagaaactccactctaagctcagcatactgagaataactgtgccctaatgattcctgacccagtttgcttatagagtgaaagttccaagccatgaagggcaagccaaaaagaccaggggcttacayacgtgcacacacacatacacacgcatgtgcacacacaygcacacacctcaagtgtcactcacagaagtgaggatgttactcctggaaaagcaggtccccgccccagctctggtgcagtggagcaaaggttctgtctgtgggaaagtcaggtgctaagacagggagctctacagctctgcttgagggggctgactttatttggaatagaacatggaaaagtccatgcctatgggcattgtctaaaacagtggagatcttggtggaaagtgattaagaggaggctgataactccaggatgtaagcaaaatgatatagaggagtggaattttgatagaacaagggaaagggacagagaagaagagtccttcagggataacagacaactctagaggctggaaggtcttgtgtatgtgttagactgtactgattcaggtgcagtcagagtgggatatgaggaaaacttgaaagcatctcctaagctacacaaagacccgttaacatagggcagagtctcactggcacaacgggcctaccaaacacaacagtctaccaaatgckgaacattaagctctcccgacccaggggcatctcctaggaagccaggcttaaaaatgaaatcatattcatccctcgcagcctggaagactctgtgcatgcccaaggctgtaccctcttatgaacaatcagaaaggggycatccaaactaccagtctctggctgaacatgatgcaaaagccatcactctctgaactgtgatagcattttccaagccacacataaatctggtagtaaaaggtaaaaacctaattgtctaagggggtttatgcaccatctgtaactaataagcagcttaggcaactcatgggcaaccctaggtagccaggctaaaagaaaagatgaaaaatagatctgagtagtgatatgagacactgcwcactacaggggaaacagactttacagaattagctcagccaagtcacgaaacagataatcagccaaccaaccaacaacaatgccctggggggacacatattcagaactgctacaatatattgtctaaaatattcagccaacaaaaaattgaaacataaacaaacaaacaaacaaacaaaaagagtgtaaccaataagaaaaagaaagaaagaaagcattcaggcaatagaaattgcctttgaaggggcccagatggtagattttgcggacaaagacttcaaagtagctaatacaaataagttcaattaactaaaggaaactacgcttaaataattaaaggaaggtaggatgacaagcctcatcaaataaagaatataataagaaaacagaaattagttyaaaaatcaaatggaaattctggagttgaaaagtacaataaccaaaacgaaaaattcactggaaggctcaacagtagatttgmgctggcaaacttgaaatagctcaatagagattgtgcaattggaagaacagagagaaacactaatcaagaaaaattaacattaacagagtttcagagaaatgtgggcatccattaaatgcacccacrtatggtactgtaatgagagcactaggagaagagagaaaaacaacaaatattcaaataaataatgctgaaaaatctcaaatttgttgaaaaacattaacctacacatccaagaagtacaataaactccaagtaggataaatgcaaagaaatctagatccagacacatcaaaaacaaaatgttgaaagccaaagataagaaaatcttgaaagctggccggccacggtggctcacacctgtaatcccagcactttgggaggcyraggcaggtggatcatgaggtgaagagatcgagaccatmctggccaaaatggtgaaaccctgtctctactaaaaatacaaaaattagctgggcatggtggcgcacacctgtaatctcagctactcaggaggctgaggcaggagaatcgtttgaacccaggaggcagaggttgcagtgagccgagatggtgccactgcactccagcctggtgacacagcaagactccgtctaaaatatatatataaatatatatttctatctgtgctcatgaaaaagactagcttatttttttttcttgtggtgtctttgacagattttggtatcacrattattttggcctcatagaacataactggaaagtattccttctttttccaattctctagaagagtttttttcaagattagtgatagtgttatttttttttccttaaatgttgataaaattccccagtgataagatctgggcctagagttttctttgtagaaaggttttaagttacagattcttcttgttttgttttgttttgttttgttttgaggcagagtctcactctgctgcccaggctagactgcactggcatgatctcggctcactgcaacctccatcccccaggttcatgccattctcctgcctcagcctcccgagtagctgggactacaggtgcccaccaccatgctcggctaatattttgtatttttagtagagacggagtttcaccgtgttatccaggatgatctccatctcctgacctcgtgatccgcccacctcagcctcccaaagtgctgggattacaggtgtgagccactgcgcccggcctacagattcaatttttataggaatttgtcagtttcatctatatattaaaatttatttgcataaagttcataatatcctttcaatttttttttcattttgttttttttttgaggtagggtctcactctgttacccaaggtagagtgcagtggcataatctcggctcactgcaacctccgcctccgaggttcaagcgatcctcctgtctcagcctcctgagtagctgggattacaggtgtgtgccaccacacccggctgatttttgtagttttagtagagatgaagtttcaccatgttggccaggctggtctcgaactcccgatctcaagggatccgcctgcctcagcctcccgaagtactgagattacaggmgtgagtgactgcgcccggacccctttcagatctttttaatgtctataggacctttagtgatatcccctttttaatcctcatattggttgttggtatctccacactcttaattttttcttcatcagtcatgccaagggtttgtctatttcgtgttttcaaagaatcaaattttggctttgatgatcttttgtctgttttctattttattaacttctgctcttatctttatttcctgccttttatttgaatttaatttgctgttctttttctaacttcttgagatggatgcttatgtatcttttttcatttctaacacagtatatgtatttaaggttatacatttccctgtatgcatagctttagctgcatcctgtatctgtatttgtaaaaaatgttacacatgtcattctaacatatatccctaattagagaccagtgttttaagtacttgtaaagtgatgaaacaaatggctgttttcctggactggtgagcttgggcatcagaatcactttctgtactttcatccgcatctccacagtcacttgaagactaattatattgctgaagctgaggagrctcagcagctctcattaataatgtccgtgggccaggcgcggtggctcacgcctgtaatcccaggactttgggaggccgaggtgggtggatcacctgaggtcagtagttcaagaccagcctgaccaacatggagaaaccccgtctctattaaaaatacaaaattacccgggtgtggtggtacatgcctgtaatcccagctactcaggaggctgaggcaggagaatcgcttgaacctgggaggcggaggttgcggtgagctgagattgtgccattgcactccagcctgggcaacgaaagcgaaactctgtctcaaaaaaagagtttgtgttacttgggaggctgaggcaggagaatcgcttgaactcaggaggtggaggttgcagtgagccgagatcacgcctctgcactccagcctgggtgacagagtgagactccgtctcaaaaacaaacaaaaatgcttgtgtttacatagcactttcactttccacacatttttacttttccttccaatgatctgttatttgctaaagtcaacggtcagttttggactttacatgacctccctctgacatctagtaccactgaccacttcaacctttcagaaattgtttagttccttggcttctttgagataattatctgattccaagttctctttgtatctttattttcagtctttcatcggctcctcttctttcaccagtctcttawatgttggtcttccctctgctgtccaatattcttctcagattctacataggcycttggtgatctaatctatgcctctgacttcctctactttctaattccccgaatcttcatactcagccctgacttctctcctgacctccacacacatacatcacacttctgggcacgtcaaatatcacatggccaaaatggaacttcatctctttcttctctctgcctccgctactaaagtcatggtttagttcctaacccagctttcaccttcacatcctaactgctctccatcactccaatttccttccactctaatccttcctcaatactgttcagagagttacctttctgatcccattactttcttgcttaaatcctttccgttgtttctcgtcacctagagactaaagtccaattccttggcatggcatacactaccttctgcgatgcagccarcctttcctactccctctatcattgctcaaatgtgtccagtgttccagccatatgaaccaatgagcactgtcctatttcatacctccatttcatcatctccaacaagtccttctgcctagaatgcctctcttttccaatggcctcttatctccaaattcatctgctgacttcttaccctttctatgcctctccctcttaatcatgcctcacatctaatctactactctaggacctagtgattttactttctttttttcttttgcttttctttctttctttctttctttttttttttcagacagggtcttactcttgtcacccaggctggagtgcagtggtgtgatcatggcttattgcagccttgacctcctgggcccaagtgatcctcccaccgcagcmtcccaagtaactgggaccacaggtgtgtgccacmacacctggctaatattttttactttttgtagaaacagggtctccttatgttgcccaggctagtctcgaactcctgagtgcaagcgatcctcctacatcagcttcccaaagtgcttagattataggcataagccaccacgactttactttctaaaatcatttgaatccatccacttctccctaactgtatcaccaccactattatctatggtgtagatatccacaatagcctcctcaccatttctaccctcgcccccttcaatagtcttcactctgctgccaaagtaatccttcaaaatgcaaatccggtcatattctctgccctgaaagtcttccatgatttcaagaaataagaaggataaatccttacaaggcctacaagtttccatgcatttgggcccttgtgacctctccaatctcagcccatctttaccccacggtttatcctggcaccacattccaggcccacagactttcacgttctctgacaccctatgagtctcccatctctggcctttggatccctatctgcagtgattatccccaccagttgtgtctgattaactcctactcactcttataggaccaagcctttgcaaatacagccacctaaattatgccgcccccttcattatttctctcacaacaacaccatgtttttctttcagtggaactgcaattagtaactacatttgtctgtgcatttgttttattgtctctttccccaagtagacagtgaacccatgaggaaaggaaccatctctcttttgttcacctgtatcccactggctggcggcatacttggctccgtgccccttgtttccccagagactgttcactcacttaccttccctgtgtgtcctttcaggcttgagatgttctctaggctcgtggtggtgtaaacgtgaatcacatttccattgactgcagcaaacaggtgacctccattgctaaaggaacactatagggaaagacagcaagagagcaagcaagcaggaagtgagcagtctaattagaggttacagtcaagaggtgcttttcccaacgagttcagactgaaactacgtgtgagggtgggagtggggggaaggtgcaaatgagactgaggagtggctgacattttcagacactttcattattcctgtaactcatagtggccagatgctgacactgtcaggcccacaaatcattaagccgttgggaccacaagcaatcattttgcctgtagaagcatgtttcagagccggggaagtaattcctgaaatcattgccttgtttctgcaagacacctcagggaaagctgatgcgctctttattacctctcaccattgatgcttatttttccctggctcctccgtctccaacctcaccttcttagctgtgactctgattctgagattacttttcttttaaaatatttgttaatattccacaattacagacaggacttatcatagcggggatctcacaaggttttaggttcaatgaaatagtckggtggacataagaatatggggatggaaccatatactcaataaggttgctgggaaaataactggatttcctccttccccctttttttaagccactgtagttctccaagacagattttggtcccacctccccagatcatgttagttcctgatatttcagccgtggctttctaagaaactggacttttgtcttcagcagttttttttttacctctccgcatcctctaacagagtattctttgaaagaacgtatatcatcaatgagtagattcatgaggcgtagtttgtcagcaaaccctactacaatgaartgtccagatggatgaaggctgatggaatatgcctcttcttggtattccttaaatagttccagggtgctgtgaaaaagatcaattactgaattgtaagcytagctcactaaatccttccagtcatctactgtatctgatatatattgttatcatcgtatttgagacacactactgtttgcaattgttggttcctctcttttctagatcttggttattaggggataatgtccagcgtggagcatggtagatagggagactggtcaaggtgtggtctagcgatgctgaagacatagctctgtttatattccaaaattcatgagtattgtccaagtattttttccccagaagccccagaagttgtacataagaacaaagaaaacagtagggggtgggggtccacctagggttggagcttcccagggaagctgtgctggaaggtaaagtcaggagggagttgggggtggttgagatagtgatgtcctgggagaaagatgaggaagaaagggtctggagagctccctgaagcaaagagcagttcctgtgggaaacaaggggatargagagctggagggacccaggagtttatgtaagaaggtgagagactgaggtgttgtcttcatctcttcatgtccccagtgtctagcatgtggtaagcattaaataaaccacaaagtagttttctagcccacgcaagagtgagaaacaggtaggttgactgacttgattttttaaaaatcttttccaactgaaagcttctaaataattaaagtttggaacactgtaattaaaataattcacataaattcacaactggggtcttgcataataaagtaggcaagccyttcattccttactttgtttcataattccaaaggcggatggatcgatccagagaacaggtggctataaggggtttgcggatgcaggtagctagaccggtgatgggtgctgagtgcaatggatacatcaaatactcaaagtgagcaggctccccctagagaaatcacacagaacaagatcccgcagagtaagcaaaaggctggctgtacatgtcagctctaattagttcccatgaacattaattagcctgggtgcacagaaatcaggctgtggctaaactgtttgaatattatgcatattttcctgagccaatattattattattttttattttattttattttatgtttgagatggagtctcgctctgtcccccaggctggagtgcagtggcgcaatctcatctcactgcaagctccgcctcccgggttcacaccattctcctgcctcagcctcccgagtagctgggactgcaggcgcctgccaccatgcccggctaatttttttttgtatttttagtagagacgcggtttcactatgttagcccaggatggtctcgatctcctgaccttatgatccgcccaccttggcctcccaaagtgctgggattacaggcgtgagccaccatgcttggctgagccaatattatttttaaacattattttaatggcaataaaatattttcttcaatggatatcttagaatttaatttaacccttcctctgctgtaggaacatttaagtggcttccaatttttgttatttattataggaataacactagactaaatatccttgcacaagtctttgtatctctctgattatttccttagtatacagttctagaagtggaatactgggaaaaattgtatgaatgatttttaaggatctggataaataatgccaagtttctctctggagagactgcactaattatcaccagtagcaaatgagagttggatggatgattttaaattgaaatgcatcctactgcactggttatgtaggttacagatgtctgtcatcagaggcattgtttctggaacacctgaatgaggagtgatcgttgggaaatttaatgagatgtacatatttaggtctgttcgcaagccaagacaaaggctgaaatggattttttttttcaaattctgcccctctgccacttataaatttatctgcatccactctatcctacgctagtatctcccatccaagtattaaccaggcctgaccctgcttagcttctgagatcagacaagatcaggtgcattcacggtgttatggctgtagaccctactatctcagagaaagagatgctatgctgggtaggcaggcacaggttattgttattcttctccatctgttacgctttctttctccaatatcttcaacctgcctgtctctatgagcacattcctattagcttttacacactcaaatctctcttgtctwaaaaacaaaagcaatgctctctcttccccctctgcctgaggagtcatgcaatgatggggaatcacacaagtgggcttaccggtttcactgcaaatgcatgaccacaaacctccagtgggcatttaaccctgtctggtaactctaccatattttttcaataaattcacattctaaatatccaagataagtatttcatactgtttattctccttttcaaacattccaacctttttcttccaattctaaatctcatctgatgacattatctcatatttccttgctttctgtgtctttgttttcattttgtatctcagaagcagacttgcagagattcatcataaattcatataagacaaattttattttatttcgctcctttctttctcaatttttacttctgttcctccctatgataagtaggcaccaacaaaaggatttcatgtatgtcactgactayatacatatgtgttttatatttctataaatgatattgtgcttcaratctctttctgtacttttacttttttctcaacacgaaatttttaaggaatcatctatgttgcagtatgtataatttgcttctaactgatgtttgatattctacagtgtgcatctagctactttacttcttcattaccactaggaatgaacatgtggattgtcttcaaccgtccattgctacaaacactatggtgaatatctttgtccatgtttttttttttttctttttttcttttgagatggagtctcgctctgatgccaggctggagtgcagtggcgtgatctcggctcactgcaactccgcctcccaggttcaagcgattctcctgcctcaacctccctagtagctgggactgcaggcacatgccaccatgcccagctaatttttgtatttttagtagagacggggtttcaccatgttggccaggatggtctcgatctcttgaccttgtgatccacccgcctcagcttcccaaagtgctgggattataggtgtgagccatcacacctggcctgtccatgttctttaatggctctgtggggtcaaattcctggtgtgtatccagtgcagactactggataacaaggtacatgcactctctatttgaccaagaattatcggattccttgctagaatggctgtatcagtttacactcccatcatcaccatattagggttatcattttcccctgtcctcagaaatctctggtaataagtggatttttaatttttgacaatatagtaatgaaacttcttataaagaagcatctcagagttgtattaatttgcatttttctgttcacaggcaacaaaattccctacggcagcacccaaaggcttgaaattagccattccaagtgtgtccaaaaaactaaaggaaaccatgattaaacaagtaaaggtagaaatgatatgcatcaaatagagaagaataaaaggatcccatcaatatagggatagaactgtaagaaaatagaaattctagagttaaaaactacaataactgaaatgaaaaatccactagaggtgctcaagaatagatctgaactggcagaagaattagtgawctttatagatcaaaaaagattagcaatttgaagaacagagaggaaaaagaattagaaatttacagagcctcagaaaaatgtgggacaccattaagcacaccaactaatgcataaggtgaatgctagaaggagaggagaaagagaaaggaacagaaaaaacattttcataaataattgctgaaaatattataaatttattgggaaacaccagtgtacacatataggaagctcaatgaactccaagtaggaaaaacacaaagagttccacaaacagacacattttggcaaaaataatgaaagctaaagatgagaagaaaattttgaaagcatcaatagaaaaatgactgatcacttacaaaagagtcccaataagattaatagcagatatctcagcaacaacaacggaagccagaagagaatgggataacatgttcaaagtgcttaaagaaaaagctgtcaaacaaaaatcctgcaaagctatcttttagaactaaaggtgaaaaaaaattaccaaaaaaactgaaaaaatatgttgctagcagatatgacttacagaaaatactaaaggaaatcctttaggttgaaagcaagttactccagatagtaattcaaatccacacaaaacaaagagcactggtaaaggtaattataaaagacaatataaatatatatttcatcatcttttagctgatttaaaaagcaattgtaggaaacaatatgcatataatatactgttgttgctataacatatagaaatgtaatatatttcccagtaatagcacacaaatggtgggtgggaacaaatgtgtaccrgattaaagaaatgacttcagtggtaactcaaactcaagaaacaaatgaaaagaaccagaaatgatagtaaaggttaacataaaaagactataaatatataattgctccccattytaacctcagcttctttaaaatatataaaattatataaggtaataattataagaatatgtyattggggtttgtaacactcataratgtaatatatataacaatattaccattaaaaaggggaaagggaaggtagctatgtggcaataacatttctatatgttactagcattaagttagtatgaaattgaatcaaactgaatctgattataatgagttaaagtgtgtatggtaagccctaagaaataattaaaagtatatagggaaaaataattaaagatattaaaacactaccttaaaattttacttaatgtgaaagaaggcatagagaggaacagaagaacaaaaaccccatgatacacacacacaaaaatggtagacataaattcaactataccagtaataacattaaatgtgaactgattaaacaatccaatcaaaagagattgtcagactggataaaaaaagattaaattatatgatgtgtataagagacacagtttggaatcaaagatacaaatatattgagagtaaaaggatgaaaaaagatataccatacaaacagcaacaacaaaaatgctggtgtggttacagtaagatcaggcaaaataggcttcaaaatagaaaatgttactagaaatagagacatattttataatgcaaaatggtcaacccatcaggaaaatatattaattgtaaagatatgtgcacctaaaaatagagcacccaaatgtataaagtaaaaattgtcaagaatgaaggggaaaatagacagctcaacaataggagttgaagattgcaatataccactttctttctttttatttttttttttgagatggagttttcactcttgttgcccaggctggagtacaatggcatgatctcggctcaccgcaacctccacctcccgggttctagcaattctcctgcctcagcctcctgagtagctgggattacaggcatgtgccaccacgcccagctaatttttttgtatttttaatagagactgggtttcgccatgttggtcaggctggtctcgacctctcgaccttagatgatccacccacctcggcctcccaaagtgctaggattacaggtgtgagccaccactcccggcttttttattgatttatttttgagatggagtttcactcttattgcccaggctggagtgcaatggcacaatcttggctcaccacaacctctgcctcctgggttcaagcgattctcctgcctcagcctcctgagtagctgggattataggcatgcgccaccacgcctggctaattttgtatttttttagtagacacggggtttctccatgttgatcaggctggtcatgaactcctgacctcaggtgatctgcccaccttggcctcccgaagtgctgggattacaggcgtgagccaccacaccaggccatgcaatacaccactttcaaaaacaatcaagacaagtaggcagaagatgacaagaaacagaagatctgaacaacactaaaaaccaaccagacctaacagacgtatatagaacacccaactcaataataacagaatatacattcttctcaagtgcatatagagcagtctccagaatagattatatgccaggccaaaaacaaaccttaataaatttaaaagaatagaaataatacaaaatatattctctaagcacagtgtaattaaattaataattaataacaaacagaaagaaactggaaaactcacaaataagcagaaatttaacaacacactcctaaaaccaatgggtcaaaaagaaatcaaaagagaaattccaaaatatttgagattaatgaaaataaagacataacatagcaaaatttatggtaagcaatattaagaggagtttttttctggctgcaaatacctacattttcaaaaaagaaagatcttaaataaataacctaatcttctaccttaagacactggaaaaaaaaaaaagagcaacctaaacctaaagcaagccaaaggaaggaaacagtaaagattagagtgaacattaatgaaatagagaatagcaaagcaatagagaaaaatcaatgaaaccgaaagctgattctttaaagagataaaaaaaaatggggggaggaggaaaatcatattaatacaatcagaaatgaaggagggaatattacttttttttttttttttttttgagacggagtcttgctttgtcacccatgctggagtgcagtggcacgatcttggctcactgcaagccctgcttcccgggttcacgccattctcctgcctcagcctcccgagtagctgggaccacaggcgcccaccaccatgcctggctaattttttgtatttttagtagagacggggtttcactgtgttagccaggatggtctcaatctcctgagctcgtgacctgcctggctcagcctcccaaagtgctgggattgcaggcgtgagccaccacgcccggccaaaagagggaatattaccattaagcttacagaaataaaaaggatcataaaggaatactatgaacaattgcatgccactatattagacaaatagacaaattcctagaatgacacaaaaactgaaactggctcaagaagaaatagacaatctaaatagatgaaaataggtaaagagattaattagaaaaagaaactttccacaaagaaaagcccaggcccagatgacttcactggtgaattctaccaaacacttaaagaagaattaataccaattcttcacaaaccttcaaaaaattagaagaggctggaacacttcccaactcattctatgaggccctgatgcaaaagcagtcaaagacatcacaagaaaactacagatcactatttcttataaatatggatacaaaaatcctcaacaaaatactagtaaattgaatatactaatatgaaaatgattatatactatggccaagtggattttatcccaagaatgcaaggrtggtttaacatctgaaaatcacttagtataatatactatattaataaagtaaaaaacgaaaactcacacaataatttcaatagacacaggaaaaaaaaaatgtgacaaaatccaacagccgttcatgataaaaacattcaacaaactaggaatagaagggaactttttcagcctgataaacagtatcttcaaaaaaacctacagacagcatcaaacttaatcgttaaagactggatgcagccgggcacggtgactcacgcctgtaatcccagcactttaggaggccgaggcaggcggatcacaagatcaggagatcgagaccatcctggctaacatggtgaaaccccgtctctaytaaaaatacaaaaaattagctgggcatggtggcgggcgcctgtagctccagctactcgggagtctgaggcaggagaatggcatgaacccggtaggcggagcttgcagtgagccaagattgcgccaytgccctccagcctgggtgacagagcgagactccgtctcaaaaaaaaaaaaaaaaaaaaaagagactrgatgctttctccctaagattaggaacaagacaaggatctgcwctcatcactgatatttgacatgatactagaggttctagccatggcaactaggcaaggaaaataagtaacaggcattcacagattggaaaggaagactaaaactacctctattgcagatgtcatgatcttatatatagaaaatcctaaggaattcactaaaaacgctgataaaatttggatatttgtctcctccaaatctcatgttgaaatgtaaccccagtgttgaaggtgggacctggtgggaggtgcttggatcattgggggcatatccctcatgaatggtttatgaatggtttagtgacatccccttggtgatgagtgagttcatgagagatctggttgtttaacagtgtgtggcatctctcacctccctctcttgctcctgctctcaccatgtgatgtgcatactaccccttcatcttccactatgattgtaagcttcctgaacccttaccagaagcagatgccagcaccatgcttcctgtacaccctgcagaaccatgagccaattaaacttcctttctttataaattactcagtctcaggtactcgtttatagcaatgccagaataacctaacacaaaaactactggaactaataaatgagtttggcaaggttgcaggagacaagatcagtatgcaaaaattaattgtatttctatacacttagaatgaacaatccaaaaatgaaattaggaaaataattcaatttacaatagcatcatgaagaaaatttttcagaatatatttaacaaaagaagtgcaaaagttatactctgaaaattacaaaatgttcttgaaacaaattaaagacaatctaaataaatggaaaatatctcatgctcaagaattggaaggcttagtattgttaagatggcaacactccccacattgatctataaattcaatgcaatcccggtgaggatcccagatggcttcttgtagaaattgaaaagctgactgtaaaatccatatggaattgcaagggacacagactacccaaaacaatcttgataaagtagactacatttgcaagattcacaattcccaattttaaagtttgctacaaagcagcagtaatcaagacagtgtggtactggcataaagatagacagatcaatggaacagaattggaagtcctgaaacaaacccatgtgtcaactgatttccaacaagatgccaagactactcaatggagaaagactagccttttcaacaaatgatgctgtgacgactggatatctacatgccaaagaatgaagttggacccctataccatcccatatactcaaatgaattcaaaacggattaaagacctagatgtaagagctagcactatgaaactcttagaagaaatacagaggtaaatcttcatggcctcaggcattggcttcttaaatataacayggaaagcacaaccaacaaaagaaaaatagataaattcaatytcatcaaaattgaaaacttcatcaaaagacaacatcaaaaaagtgaaaagacaacccacagaatgggacatagtatttgcaaatcacatatctgataaaggacttatatctagaattataaataactgttacaactcaataataaaaagacatatgactcaattttttaaatgrgcaaaaaatctgaatagayatttcttcaaagaagaattagaaattcttgaaaagacgttcatcattaatcaccaggtaaatgcaaatcaaaaccacaatgagataccacttcttacccactaagatggctataataaaaaagataataacaagttttggcaagaatatagagaaatcagaatgctcatatactgcttatgggaatataaaayggtccagcaactttggaaaacagtatggcagttcctcaaataattgaacatgaagttaccatatgactcagcaattccacttctaggaagagaaatgaaaacccatccacataaaaactagttgcattattcataaaagccaaaaggtagaaaaaacccaaatatacaaatttgatgaataaaatatagtatatccatataattaaatattatttggccataaaaaaggaatgaagtactgatacctgctacaacatggatgaacattgaaaacatgctggccaggtgtggcggctcacacttgtaatcccaacactttgggaggatgaggcgggtggactgcttgagctcaggaactcaagaccagcctgggaaacatggcaaaaccctgtctctactaaaaatacaaaagctagctgggtgtggtggcgtgcacctgtagtcctaactacttgggaagctgaggtgggaagattgctggagcccaggaggtcaaggctgcagtgagccatgatcacaccactgcactcccacctgggtgacagagcaagaccctgtctcaaaacaacaacaaaacccattatgctaagtcaaagaagccagtcataaaagtccacacgttttatgattccatttgaatgaaatgtccagaataggcaaatctatatatagagacatgaagtaggtaagtagtggcctagggctggggtggggaggggtgataattgggaggatggaggaataataatagctaaagggtatgcgctttttttttttttgaggtgataaaaatgtcctaaggctgtctatgataaatggttgcayaactttttgaatatactaaagaccactgaattgtatactttgaataggcaatttgtatgtgaatcataactcaattaagttgttattaaaaaaaggaccattactgagaaagatatgttaaatcttctactatgattgtagatggtctattttccttgttctgcccagatttgctttatatattttgaatctatggtattaggtacatgcaaacttaaaattgtaatatcttattggtactgagccattttaagtacaatatgatctctatctttaatagtgcttttttgttgtaatgtctgcagtgtatttatactagctttctttgttattccaaaacagtaaaaaggaaaaagaaacatttttatatatacatatttgtgtacatgagcaaatatagcaatagattaaatgccttaaaatgcaatttctgggtaaaaggatatgtgagatttaaatttgatggacaatgccaatacgtctgtcctccaaagttactgtagcaatcacagccccactgagtctatcagcatgcttctatgtgaatatcttaaaattagaattttgttttgctctgtattaaggggatgcatgagtttatgctaacttatttggattaaaatttgcccacatggtgactagtcccccagcaggcagataggtcctggtctggaaggaccattgctggaaagactcaccttgctgatctctgtcagggacatggtgatgctgtagagttggttcttactggtgctggcaaccagagtttcctctgaggggctgaagsacaggcagagaacgtcctgtttgtcagactgacttggatcattgctctgcgggtccacaggaatctgcccaagatgcaaaacagctatcagtaatgtccccacgttgtcattgtggccttaggctttcagagttttcttttttttttttttttttttttgagacggagtctcgctcttttgcccaggccagagtgcagtggcactatctcagctcactgcaagctccgcctcccgggttcacgccattctcctgcctcagcctcccgagtagctgggacaacagccgcccaccaccgcgcttggctaattttttgtatttttagtagagacagggtttcaccgcgttagccaggatggtctcgatctcctgacctcatgatccgcccgcctcggccttccaaagtgctgggattacaggcgtgagcaactgcgcccggcctaggctttcagagttttcttggataactttagcttacagactcccagaccaggctgcttcctgggatcctcctattctttgtttttttgagagagggtctggctctgtcacccagactggaatacagtggcatgatcttggctcaatgcaacttccacctgccaggctcaagccatcctctcacctcagcctctcaagtaactgggactacaggtgcacaccaccacatctggctaattttttttttttttgagacagagtcttgctctgtcacccaggctggagtgcagtggtgtgatcttggctttctacaacctctgctgcccgggttcaagcaattctagctgggattacagacacgtgccaccatacctggctactttttgtattttgtatttttttttctttttttgagacagagtctcaatctgtcgaccaggctggagtgcagtggagcgatcttggctcactgcaacctctgcttcctgggttcaagctattctcctgcctcagcctctcaagtagctgggactacaggcacacactgccacgcttggctaatttttgtatttttagtacagacggggtttcaccatgttggccaggctggtctcaaactcctgacctcataatttttttttttttttttttgtagagatggggtttcaccatgttgcccaggctggtctagaactcctgagttcaagagacccacccaccttggcctcccaaagtgctgggattacaggcataagccaatatgctggtcgattttcctatttttaaactctaattctgttcacctcatcctaaaatctctctcaggacagacatctcgagtcaccatttcaccatttctgctcagcaatcctgccctatccctccccatcagatgccttctcagagaactgctgctggggaacaaatgccaataggacccccattttacttcttttttttcttcccgccttaccctgatttctctgctctcacggtaaaaatccttttcttccatcttctcaaacagcagaactctccctggcccagcagaacaggcaaatccctttgaataggctgcaatggcaaacacctggggcatggacatctggctatggctactggccgccaccatctgttcataggaagggagtggagaactgactggtggaaattcaatcaggctggaaacaaaaaaacagcatacataatttatagagacaatcttgaggagatgaattctgctggggaggagaaagaagrctgtcactgggtgtgacagaaaccacccaatgatccccttttccacagtcaaatactaccctttggcttgggaaccgtacacaaactgcacatggccaagcctagaagcaagagagtgcttggggcgtgtggagtagacagaggcgagagttgtagaggaaaacagtcgcaggtatgcttgggccaaaccaagaagtctgggctttgttctgggaggcctggaccccagagctgaaggactgtgaacacagctcctggagaaggttatagagacttttcaggaagctcctacatactcacaaaaaaaaaaaaaaaaaaaaaaaaaaaaaggatatgccattggcayggggggatggtagtgaaaatgggtggattgaaggttactgaggaagaagaatctacaggatgtcattggggttgagggcccaggctctggcatcagagagatctgggtttgaatcctgagcctgccacttatcagcggaatgatcttgggtagttcacttacctctttgatcctcagtttccttgtctacaaaatgggcacgataatagtatgaactatacagggtaagaatcaaattgggaatatttataaaatgtttaaagcagtgtctggtgcatgtaacggtacattccaatacacaggagatatgatttttactggttgtcatagagataacgtggcatctctattataatggtcaataaccactccttcctgagattgcactttacccctatcctctgtcagatttacctaaaacatttccttgcacttgttggtctgtcgcctcctgctgaattataagttccttgaggacttgtgtccccagcatctagcaagagatgccttttgcatactacaagggcttggtggacatgaatcaattcattaaattagccactggaaaatatattttctaaaaactatagttttgaagaccagtaatactataatgtttataaaatgaggttaggtataaaaaataaaaagaattgtatttagtctatggttataactgttaaatctgtgcttaaatatagacgaaaactagagaggaagagggaaaatgggcatagttgacttttayggtagaggggttatgagtggtttctaaagagtgctgtcttctgcataatgctgtcagtacaatgaatgtgggagcaccagcccaggaagcaccattacctctctgattcctgaatgacatccaggctctttgagccatyggtaggttccttgaccattatgctggtctcccaacgctgatctccagattcaaagaggaagagtttgcctgtgtcagtgccaacgacaatcttgtcatcagccacccaggtgtgrgctagatagttttggggttctcccctctgaaagctggtttgcttcagggttccctcagmaaaacggagaagcttaaacatcccatttccagtgacacacacctgagtgttatcctgtggactgaagctcacctgtaaaatgtgagagaattgaagaaaaaaatttatgaaactattcttgatggaattatttcccattttacaaattaatatttatttcaggctgctcagaatatctccaaaacatcacaaaatcatgtaactttatgctgcatttgataagggcacacatctataatccattatatttatagggatatgagtccaactaggagtcaaactaggaaatctacaaaggccaaagagcagaatgaacagcttttgacaagagccacacccagtgccaacaaaatggaataaagctcagctggaaacacagaaaaagagggtctgataggtttacatagccctgtccaagaggaaagaaaccacatgtcaggggatgctatgtggtctcctaccaactgaacatccttyaatcacagctcttatcccaatgtacacctgctcctctacttacaatgggatcatgtcctgataaacccatcataagktgaaaacaccataagttgaaaatgggcaaagccatgtggccacacagcaccacactgtagagtatcttggttgttaccctagtgattgagcggctgaccgggggctgtggctgcagctgctgccctgcatcatgaaagcgtattacttggtctctttctcctgagtgcatatcactcttgtaccattgtaaagacgaatattttaagttgaaccatagtaagttggggactacctgtacagtaataggcagtcaacctgctgtcctgactatatagtgagcaacttgaggggctgtgactttttcatctgttttcccagtgctggattcatcatgggcatccaataaatggttgctgaatctactagtcagagcaggaggtscttcatcaggcctcactgtggcctggttgaaatacccttctggttctacctgcctttggtctgattctggaataatcacccagcagccttctgattactattataatttcacctctcaacttctctattactaggaagggaatacactggataaatgatgtgagcattctggttgtgatatgctggtttacacatcagtatcttgtgagttgaataattgagtctatgccagagacactgattagctagaatctctgaacatgaacacaactgagtcgttgaacttgtggaattgagtgctagatcctagactagggtgagtgaaccaagatcaaacctccttgggaccccctgcctaagccatcaatcaggttcctgaggggtcttcttccttttgccctcgagacacaatagaaggttctgttccttacataactgcaacttcagcaacagcttcctaaagacctaccatgttacatcacatttcggaaatcttcctactgcccggcaatgctgctggaaaaagaggctaggaccagggagagaaagcaagttttattaatccacttctgggccaaacctgtgaccagaaagcagttctgggccagagtagagaagacaggagctggagttggggaactcctagctctgctattcactacctctgtgatcttgagtgagttacttaacctcttggatcctcagttctctcatctgtaaaatggggataatgattgtgcataccttatacggttgttgtaagaataaattttaaaatgcatggaggaaattagaactgtggtacacagaaaacattcaataaaaagtagttctattttttataattttcacgatacttgtcacactactaggtacctggtagacagggttgttctgagtgtcgattctaacaatggccattactttctgtttttcccacagccagtagacaagatttgactctggaggtgacgtctgagccaataggtatttggagtctggagaaaaagccatgctaataaatttctgaacttggaagtcaaaattattaagaactttgcgcttccggcaagggatggatgacaattcataaatggtgatggcaggtttttcttgcacagtctcagagatagcgaggtaccgccgattgggactgatggacaaggccaacatgccctgactcttctctgagcctgcaaacagaggaaaaaggaaataatcagggtagatcacactttcaccagggttcaacaggaaccaggcactgtggtgggcactggagtggacagtggtggacacaaagaagaaaggcggccttggcatagctgtgtttgggtattatgaaaatgactaggggccaggtgtggtggctcacgcctgtaatcccggcacttcagggggccgaggtgggcagatgacttgaaatggggagttcaagaccagcctggccaacatggtgaaaccccatctctactaaaaataaaaaaattagccgggtgtggtggcaggcacctgtaatcccagctactcgggaggctgaggcaggagaatcacttgaacctgggaggtggagattgcagtgagctgagatcatgccactgtactccagcccgggagacagagcgagactgtccccaaaagaaaatgactagggcaggcaccttggaggatgaggtgggaggagaagtcagggaaaccttcctgaaggagggcagggggtgaggtgagatggggrctgggtggtagatagcaggaagagcttgagccacggggtggatgtgacaaagggtacagcatagtgcgggaactgcaagcagtgggtgttgctggagcattgcatgtgagatggggtgaccaaagatgggcctaaaggggtggaatagggtcagaccatagaggtctttattccctgagtggctagctcatcactcctcctctactccagaggttgggatgccaactactggattcctcagcctcccttgcactcacccttcctaaaatttttcagcagcctcccaggtgaagtccaaacttttgtgcaaggctctcagtgacctagaacctgggatcttctctgagccacagctactctctgcatcccttccagagaattcccatgggctgggcatgcacgcctgctgagcaacttgctgcatctctccttggcgtgttgtgaagcagcagcatgagggcccaacacatggggacccrtcacatcactctctagctcatcctcccttgcctcactcacgctccctgccctgggcctgtatccaccatccacttatccactagacacagtgcccaggacccacaatacttttgaggacctaggaaaatgttttagtatttatttgaaaatcagaaaaaacatgaatatataatggtgaatccagcctagattatattcctctttataccaatacagtcataaagtatattactgcatatatttttaaataatatatgtgtgtatatatattttatatatatatatataaaatatatatattttttgagatagagtttcactcttgtcgcccaggctggagtgcaatggctcaatctcggctcaccacaaccaccacctcccaggttcaggtgattctcctgcctcagcctcccgagtagcagggattacagkcatgtgccaccatgcctggctaattttgtatttttagtagagacagggtttctccatgttggtcaggctggtctcgaactcccaacttcaggtgatccgcccacctcggcctcccagagtgttgggattacaggcatgagccaccacgcctggcctataaatatatttttaaacattttttaatgaaggagggggccatgaaatcaaaagtacctagagccctcgaaaacaataatgtgaccctgattgcatttcccaaagagagggagaagaaaggaaaagataaactcaatctcagatatattgtgtgtgaggtacactctgtggaacagttgggtayggaggtccagcaggtggacatggttctaaagctggcgggaggggttgaggctgaaaatacagatttgaggtaaaaagcataagggaaagttaaaactaggagtatgtaatagcctagatgaggcaaaggaacactgctcactccctcctattgtgcttttgtgccaggttcctacctggtatagcatctgtccagctcatttgcacagtcctactcatttgaattacacaacctgcctccactacaatactgagagctcctggagggcagaggccattcttgctcattcattcattcattcaatcaccagtgtctggaacttagtatgttcttgatatatgttgactggttttagagtttgtaaaatgcttttgcattgtttcgacccagctgatgcctyrcctctcctccttaaaacattttcgcctctcacatagatatccttttattattattattatactttaagttctagggtacatgtgcacaatgtacaggtttgttacatatgtatacatgtgccatgttggtgtgctgcacccattaactagtcatttacattaggtatatctcctaatgctatccctccccctcccygcaccccacaacaggcccyggtgtgtgatgttccctttcctgtgtccaagtgttctcattgttcaattctcacctatgagtgagaacatgcggtgtttggttttttgtccttgcgayagtttgctcagaatgatggtttccagcttcatctgtatccctataaagggcatgaactcatccttttttatggctgcatagtattccatggtgtatatgtgccacattttcttaatccagtctatcgttgatggacatttgggttggttccaagtctttgctattgtgaacagtgccacaataaacatacgtgtgcatgtgtctttatagcagcatgatttataatcctttgggtatataccatgtaatggcatggctgggtcaaatggtatttctagttctagatccctgaggaatcaccacactgtcttccacaatgcttgaactagtttacagtcccaccaacaatgtaaaagtgttcttatttctctacattctctccagtacctgttgtttcctgactttttaatgatcgccattctaactggtgtgagatggtatctcattgtggttttgatttgcatttctctgatggccagtaatgatgagcattttttcatgtgtcggttggctgcataaatgtcttcttttgagaagtgtctgttcatatcctttgcccactttttgatggggttgtttttttcttgtaaatttgtttaagttctttgtagattctggatattagccctttgtcagatgagtagattgcaaaaattttctcccattctgtaggttgcctgttcactctaatggtagtttcttttgctgtgcagaagctctttagtttaattagatcccatttgtcaattttggcttttgtcgccattgcttttggtgtttcagacatgaagtccttgcccatgcctatatcctgaatggtattgcctaggttttcttctagggtttttatggtttcaggtctaacacttaagtctttaatccatcttgaattaatttttgtataaggtgtaaggaagggatccggtttcagctttctacatatggctagccagttttcccagcaccatttattaaatagggaatccttcacctctcacatagatatcctgtgatctttttggccactcctccaaagcctcttttgctgattcttccccatttccccagcactaaatgcaggagtgctcagagctcactctttcagctgcttctcttttgtaaatatattcatgccctagggcaggggtccccaacccacggtgctgggctacacagcaggaggtgagcaagcattaccgcctgagctcagatcagtggcggcattagattctcatagcagcacaaaccctgttgtgaactgtgcatgcgagggatctagattgtgtgctctctgtgagaatcttaactaatgcctgatgatctggggcagaacagtttcatcctgaaaccatcccccataccctctccatcctgtccatggaaaaactgtttttcatgaaacctaccccgatgccagaaaggttggggaccactgccctagggaagtctcatctactctaagggctttacatttcacctctaggctgatgaccctcaaattcctttcctagcctggacttccctcccttaaatccagacctgaaatcaacctgcttactgagcatctccatgaaaatatctagcaggcacatcaatcttaacaggtccaaaaccaacctgctccttctttagccctttctatcacaatcaacagcaactccatgctttccatgctcaggcccaaaaccttgcttcttcctgcttccaccccacatggtgtctatgaagaaatctgtcaaagcatatccattattgatctcttcacaccaccctgtcgcctgcctctacctgctccaagtgccattatctctcacctgaattacagcaatcatccctcagctgttctccctgcttcctttctttctcctccttaaatctgtcctctgtacagcagccagaatgaacctgaggaaacacagatcatgttgccactcagaacgcacccctttatggcttctcatttgactctgagtaagagctcatgaactgcaagcccctctgtggtgttgctccccattctttctttgcctcccctcttgctcctcaccccccggttcttaccactccagccacactggcctcccagctattcctccaacacaataagcaccctcctaactctgagcctttgctagtctctcggctactccccctgccctcccacatcagcacagccagctccttcctttccttcagtcttcactcaaaaatcactgctcagtgagccctccccagcctccctatctacaacttcttactcccccaacggcttcactttccatrcttygtttgttcttattagcatctatcactatctagcatgtagactgtacttctttttattttgtttgtcactctsccctcttagaatggaagcactgtgaggacagcattttatgtgcatatgtgcrtgtctattttgtgcctggaacacagggggtacttaatacatttttgttgagtgaacaaatgaatatgttgagcctcatcatgactctgagctgaacaagctgagcatcatctgcatcttacagatgaggagactgaggctctgtgagcctataaaatggggagccagatcaaagccaggtctcccaatgtcatgacctttatatttttcccttcaccggtaatacccttagacttggtcagtggagatcctcccttgggcctcaaattttagagcatcccggagtctttctctggctgtaccccttaccattaagtgggatacagtggctgcctggagtttgtcctgcctcttctagatcacgttgcaggtackcaggactctggagttccctgctcagatagtcttgagcctgctgacaagaccaacattgggggtttcttcccaggctgtctctactcaacctgggcctgaaggatgggcacagggtggttgcttatagaatatatgggtagaatttgaacatatgggctgcaaggatccacccacatgtgtacaaggcccctggtgatataagatggagttaggagcagaagagaagtgatacagtaagaagtgtaagaatatgagcacaataactgaaagtaaaatctcaatggatacattaaacattaagttagatgcagcagaaaagagaagcaatgaactacgagatacatctaaagtaattatctagaatgcaacacagagagagtaaggtataaaaaatccaaataagagttcaaaaaaaaaaaaacccaaaaacatgaacgtcaggtgtggtggcttgcacctgtaatcccagctacttgggaggctgaggtgggaggatgagttgagttcaggagttcaagaccagcctcagcaacatagccagaccccatctccataaaaacaattagctggtcaaggtggtgcatgcctgtattcccagctattcaggaggttaaggtggggaggatggcttgagcccaggagtttgagactgctgtgagctatgattgtgccagtgcactccagcctgggcaacagagtgagacctggtttcttaaaaaataaataaataaaataaaataaaataaaaaactggaaggatggagttgagatggtttggagttccagaaggagataacagaacaaaaaagatacctgtccttagatccaggaatctcaaataatccctaggaggataaaaaatgaaaataaaaactatactgatgtgtgtgtctgtatctatatgtatgtatatatactatgtatatatacatgtacatatagtatatggtgtgtgtatatatggtgtgtattttatacgtatatatgtatatggtgtatgtgtatagatacatacacacacacaccatagacagagaagatattaaacatccagaaaaaaagatcatctacagaaagacgatgctgatagctaatttcttaaccacagcaacaaaagagaagccaaaaaaacacaatggaatatgatctataatatgctgataaaaatttcacacctgttgaaactatctttcagaaatgaggataaaataaagtcattttcagacaaaaactgggagaatttattaatacattatcagtaaatrcagaaggaaaatgatcccagctggaatatctgatttgtaaagagtaatggtgggaaaaagtttggtaagtatgagagcaaatataaattaatgttgtctgtagaaaaccataatttaatttatattggaaagtcatatgatcttttttatttttgtttttgagacagggtcttgcttggtttcccaggctggagtgcagtggtgcgatcttggctcaccacaacctctgcctcccgggttcaagcaattctcctgcttcagcctcccgagtagctgggactacaggcacgtgccaccacgcccagctgatttttgtatttttagtagagacggggtttcactatgttggcgaggatggtcttgatctcttgacctcgtgatctgcccaccttggcctcccaaagtgctggaattacaggcatgagccaccacacctggccagatgtccatttttattgcccctaatcaacactgtctggaggtgcttaccagcacaggtaacacaagaaaaaggaagaaagtcatcgttatttgtagataacatgatagtctatgtagaagtctctgcataatctatagacaaatcattagaattaataataatttagcaaatatgctggaaataaacatcaataaattaaagtcaactgtatttaatacagcttattccaacagaatattatgtggttgataaatttgactttattaaaactaataatttttgtccatcaaaagatacttgtaagatgggagaaaaatgccccaaactgaaagaaattatttgcaagacatatatatatatctgacaaattattgatatacagaatatataaattgtgcatgtaaatcaataaaattgcccaaaaatatcctgcacaacaaactgtaaaaaacaagtaaaagacttgaacaaggcatttaacatacgactaaataggaatagcccataaacagatactcatcatcattaatgatagcaaaatgcaaacgaaaaccacaattccttttctcaaccattgggttagcaaaaaattacgaagttggacaataccaagggttggcagggttgctgaggaataagaactcttatgcacttctagtgggagtgtaaattggtactatcatattgctcagtaattttagtcctggctgtgtgccctagagaatctgcacaaatagatgaatgtatatgcatgcaagaatgtttatagtagtatagtttgtaatagcaaatgattgttatttcccaaatgtccctcaatattagagtgaatacatatatttgagacattatattcatatgatggaacactacatagcaataaaatgaacttggctatatgtatcgagatgtgtgaatctcaaaagcatgacattgaactgatgcagcaagacacagaatacagggagaagcactagaactggtaatattctgyttcctatgctgggtggctgggttcacagatctacattctattgtaattctttaaatatgacatatatgtagggtacattcttttgtatgtatatgtcacaataaaaggtgtcaatgcaacaaagaatgggaaaatggattcggttgttgaaataatgaatatcattaacaggaccactgtgaacaaaaataagggctgtaatgctatacaaatggttatttgcgacttgggataaagtttacagtgtcttcatcayacttggattcaaacggtgatataatgaaggtggtgtgctcaggaaaactgttagacaactcaaaaagtggctctggtgatracaaaggcagtgatattgaagacaccaaaagaggggttcttaacatattttcatgaaattacagtgaaamaagtacttttaaattaacattttatatgtgattttaactacatatgcgtgactgattaatctagtttcataatacaagtcgccatttatttcctctacatttataatactgcatatatattcaaattggccaaaatctttctttccaatcatcatgctgggattatggggttatatgtggcacataccattcctgtatatgtcaggatggaaaaagttttacctggaatgaatttttgccatttctgatccacattgtacttcacacagtgatttcctgaaggaaatataatgatctgttcatcgaagtagaagatattgttggccacgtgggatcgaagaccaaawacatgcagcgtctgagctacmacggctgacatgatctcccgccaaasagttctgctgaagaccaaggcagcgcttcagagtggagagcaccgccccgctccgaccccgcccccggcccggacwcgccctccccgccctttgctcctccccttgtctctccccttkcycctccccttgtcyctccccttkcccctccccttgyccctccccyccccttcccctcccccggggtcctcctccgcgccaccccacccccgcggctcctttttctgcctyttcctttgtaccctcactgctaccagctccttctggcgacccccaggtaccccctcccacctttcgtttctctctgggtcagcagaccacgcatgtatccagaggcgctacctgtagggatcctaagcaacccggacactttcaaacgccgtagcggttcctatagcaacgacaaaccggaagtatggtttgccgccggaagcggaagtcccaatcaaaagttgagcagtagctgtgagttgctggcgctggrgcgattcggtggcacgtggagccacggcgtgggagtagggggctgaaggcaggcagcagcggccagggccgcccyctgctagccgcttgggtctcgggataccccgtttcttcctgtaggtgtgggacgtgcgtgcggcgagatggacactcccccgctctcggattcggagtcggaatccgatgaatcccttgtcacagacagagaggtaggtgtcagccgagctcgtggggctgggcgtgggagagggggccttacacccctgggagtgaccgtgattgtgtcctgcagttgcaggatgcgttttcccgagggcttctgaagccaggcctcaatgtcgtgctagaggggccgaagaaggccgtgaacgacgtggtgagcgygggcacagggtcgggggtactcggacatgggatgcgcttcaggcgctgttgggcttgggagaccgattcttgtcccaggaaagatgcaccctgcgcctcgccaagagggtcaattacctgtctgggtattggggattagcactttgtcccttcgcctaacagcctgtgcttgggaaagacaaactcagagttcccttcttgtgagctcagtgtctggatttcctagaatggcctgaagcaatgtttggcagaattcaagcgggatctggaatgggttgaaaggctcgatgtgacactgggtccggtaccggagatcggtggatctgaggcgccagcacctcagaacaaggaccagaaagctgttgatccagaagacgacttccagcgagagatgagtttgtatgtttgttttcaaatgttggagaagttgaggatccttgtgcaggagagtgggaaagaggggaaattagtaagtctgcactcagaataagcctaggagtagagagagcggcttcttttgactaagaatagctaggagattcttcctgtttgagagaagagctctttggtccacrgtcacgatccaaaatccactttatgggctaatttgaaatattcatgttaaaactttttgtgcatgcttcagttattaggaaaacaaacaaacaaacattgcttatgggatgttcttgtgtggaattgctttagtaattacataagaatccataatcgacattcgtttgtgttaatgggtacctttagagtagtcattctcttaaactatttttagcaacacccctcccctttttaaaaactagtatacggctacatttcttttagatactaaatcagtgagrcagtttttgtttgtttgttcttgctaatggaggtcagattttgagagtccttctgagcttggataactcatgattggcggtgaaaaggaacgtaaggcctcctccttcacctcattacacattttgtcctacgattctcagctatcgccaagcccaggccgcagtgcttgcagtcttaccccgcctccatcagctcaaagtccctacsaagcgacccactgattattttgcggaaatggccaaatctgatctgcagatgcagaaggtaagaaatagaagttttcctytggaaagtcaaaactttgtacttaagcatattcagctggcttagaaagatagctatgagcccaataacggggagccagttgtcagaggacaattattacctcttccatagattggctacttcagagtcatgccagttaccaccaattagatgcatataaaaatgacattttttctaaaatcagcaattaaggagaggaacagtgctgtgtgaagtgtggtccccraggtgaagatggcccagtgcatttcctagctggcatggtcatgacatggtgtgcagagaggacagcattcttgtgcccttgccactgtcagtgctagaacttgtagacaattacttttctctgggcctcagttttctcytctgtaaaatgagggattcttagatggttcagatatagtacaatttagagttgggtagaacttggacctcatttaactttggaagaagggattgccagcatgtaatccaacatacattcagccctccatagccatgggttcagcatctgtggattcaaccaacctyggatcaaaaatattggggaaaaaaatttgaaaatatygcaaaaggaaaactgaattttccgtgtgccgagaactacattgaatccatgagaatgaggtgatgcatagcattgtattyggtattataagtaatctagagactatttaaagaagcggtctggcactagagactagtttcgtggatgacaattttttcatgaacttggggaggggatagttttgggatgaaaccgttccatctcagatcatcaggcattagattctcataaggagcaggcaacctagatcctttgcatgcatagttccatgcatagttcacagtagagttcgcactcctatgagaatttaacgccaccaccaatctgacaggaggtggagctcaggtggtaatgcttgcttgcctgtcactcactttctgctgtgcggcctggttcctaacaggccacagattcatagtgggttcgtagcggtctgtggcctgggagttgaggtccyctgactttaaaggatactggaggcgagtgtaggttatatgcaaatgctgcaccatttttatataaaggacttgagcatctgtggattttgatatctgtagtgggtcctagaactaatcctctatggatactgagggataagtatatttaaatagtaccctggggtctcaagctggattttagggagcttttgtcrtggtagtagttcaccttcttactgtgaactctgtacaaattctcactgacaacttctcatcctttaactaaaatgtgtatgtttgactgaaaaggctaggcacctggtatctgcctgggtttttattrtgtatgtggtatactagaaaaggacactgaggccgcatactggtttccagcctcagtctactgacagtagaaatggggagaagtttgtcttctttcctgggctacaaataggcagtttgtataatgaaacagacagcacactgggagcgggaaggtgactttcaatctctggcttcactctggcacttttrgtaaagtgctcagcctgtgggccccattgtcctcaggggttggaactgatgatttataagttccgcagtttaaagaacagggaatatctgttccctgctcyagcgaatcctaagtagtggtcattccagattcaaatgacatgaactgacagcattttgtgttgtagattcgacagaagctgcagactaaacaggctgccatggagaggtctgaaaaagctaagcaactgcgagcacttaggaaatacgggaagaaggtgagaagaaaagtgtgcagggaacaggaagaggcggagtgtgtgttagatgagattgccgtggtctgacttggtcccctgaactgaacggaactgtgtgttgatcatgtatttaccgtctctcagtgtatgtgctggtattcatgagcacaatcttgcctggacatgagtggttccccaggagtagtatggtgactgcaggtgagccaatcacctctctgggcgttagttttcacatctgtacactgggtccagatgagtggtttccaaacctgaccttatagcaaaatcaccaggggaaatttttcaaaacagaattctagacttcagaatccccaggaatctgtgcctgttttcccctcttccccaaaagctttccaggtgattctgaaatgcatcctgrtttgggattcactgatctatgtgataatcacgtacctgaagaaattatcataatgattgtcatccaatctgaaagattgcctgcgtgtttgaactatgaatgtctgagttctaatgtaacaccagatcaggcataccctaaaacttttcttggttttccttttttatttcatggtcatctaagaaagaagatgacagattttaaagttaggattgtgggaagaaatgaatgtgaggaagattggygtgggtgttaagacttcgtcaacatttggacataagcacttgkgatctgggctgcagaactcttgtccacgtttggagtcatttcactgatacattctcagcaaagtaggaataggctgggatcctgtcctctacaaaaggcctgctgcggatttattatttctttgatctggaggtggatggctgagattctctcaaagacaccagtaattaatttaacatagccaaagttaccaaaagcaaagacaaactcacttgggcctattagttcactgttcctaatttaaggaaacactggggaagagtttgttaactgggggtgaatttgctccccaagagttttctgtgactgcctggagatatttttagttgtcaaatttgggagggagggtactactggcatctagtaggtagagggcaggggtgccgctaaatatcctacagtgtaggacaggcccctaccccccagcaaagaattattctctccacactgtagcagtatcaagattgagaaaccctctgttagagtattataaagtgtctccttttatccttcaaacttttttcttttctttacctggggacattgtttttttctcttccttttggtactttcatgcctagtaacagtgagttagataattaatctgtccaaatgtgatgcgaaaaatcgatgtagtcttaaacatgatttacttcagttttgtaggcaggattgtataatagggtgagtgctggctttggagtcaaacagcctgggtcatcttggctgtgcattttttcactgtgcgacttgggcaagttaactyccctgtgcttcagtttaggggataacacaaatttcaacttcactggattgttatgagacagatatatcttcatctatgaagaatatacctagatctgagaatatacttagagtccctaacacagtttttggcacgtagtaaatgtcagagggtagyggtattaatcatggtgttgctattaagacaatgtagacactggagtaatggtatggaatggctgtaacggtccttgtgttcatatcacaggtgcaaacggaggttcttcagaagaggcagcaggagaaagcccatatgatgaatgctattaagaaatatcagaaaggttggtacatctctrmtaggggaacgagggtagcaggtactttagagttgatttgaayacttagtgctttggagccttcttggttgatgtggacctgtcggatcaaagttttgggaatggtgttggagagcaggatgtgacycttaaaatcagtgtagcaaataacagcctcatatggtggtttaaacttttattcttaaaatacratggtgctgatcaaaactacttcttcacttacaggcttctctgataaactggatttccttgagggagatcagaaacctctggcacagcrcaagaaggcaggagccaaaggccagcagatgaggaaggggtgagaagggttttggcatggtttctttggttctgtgaggtgcgatggggccacaggtcacgagtatggcagacatagcacctccaccggcgcagccatagagtccagagagtgcagctgctgcctggggccaggacccctaksactgtgtgatgggcccttttagccatgtcagtctttgaagagtaaaagaaggcactttttaaacttcttttttttttggacagtctcattctrtcactcaggctacagtgcactggtacagtcttggctcactgcaacctctgccacctgggctcaagtaattctgtgcctcagcctcctgagtagctggaactacaggtgcctgccatcacacccagctaatttttgtatttgtagtagagacagggtttcaccatgttggccaggctggttgtgaactcctggcctcaagtgattcactcacctcagcctcccaaagtgctgggattataggtgtgaaccactgcacccatcctaagaaggtacttttaagtatgtggcaccctttaagtgaatgctgagtaaagttgattycccatcacacagtgcgatggttgagagttcagacctagggttcagatcccgactctaccactcagtaggagggcagttttgaacgagttaccatgcctttctaaatgctaattgcctcatctgctaagttgaggaaatagtgtctgcctcatagtatgaagactgaaagagagaatgtgggctctcattgttttttctagtctgcttttttgcatacctggataccaggcctaggggaaatgataatttccatgtaagatagtaagtgctatgatagaggcatttggggattagtactgagtcagcttttataaatacctgacagggtctggggtggatttctggaggagcgttcgacttgagcattgcttgaagcatgagtaggaattaaccacgagaatagaagagaagctgggtttgggaagaagtaagagcttgaacgagcaaagccatcgagatgtgaaacctcagggttttgtgaggaacagtaagcccttggtgtcactgggaatacagtgcaaagcaaggaggggtgcratgtgtttggggggacctgggctgtgggtttgccttgttgaggagcttgggctttgtcagaaggcagtggagagactaggttgtaggttgtactaacagtaatgagcaggttatattcatgtttttaaaaagatcacagtggattttgtataagtgacagacttgagggaagctgggaaattgacaagggtactattgcaaaagtcgagataaggattgaagaaacatttaagaggtgaaatgagcaggactcagtaattgaattgggtataaagagtgagagaagaaccaaggctgactcccacatgtttagcctgtgtgtctgggttggtgggagcagcgccagcctcaagtgagggcatatgtacaggaagcagagccagtccaggagatgatgtgaatttggagatgctgaattcaagattcctattggatgaccagttttacatttgaatgttattccatttgaatgttatttgaatgcctataattacatttgaatgtttacatttgaacgtattcattacattacatttgaatgttacaaatgtaacatattacatttggatgttaactgcatgtatttacccttgagaggaatagacacaactgagggtgatttaataagatttggttaaaatagaaagctttctaaagacagcaggaagccatgtaatatatgtagagccttccctgcttcttgctttattttcctgccctggtggtcaaaactgtaaataggtgagctagatgagtttgtctagagaggctgtagcataggattgtggggccaaggatgagattctgggttacagacgtgcctaaggggctttgcttatagaaaggaaactgagagcattgctgggccatcaggttcatcaggctttacagtgctgtagtgatgtctaggaccattcttttccaggcccagtgctaaacgacggtataaaaaccagaagtttggttttggtggaaagaagaaaggctcaaagtggaacactcgggagagctatgatgatgtatctagcttccgggccaagacagctcatggcagaggcctcaagaggcctggcaagaaagggtcaaatgtaagtgagcccaggtgcccgggtgaggagcaggctcagcctcccctcccactcccaaccctgccctctcccttcagttctgttcgtcctcaccctggggcagaaggcaagctgctatgtgaccagatgtggtatgtctttttctgtagaagagacckggaaaacgaacaagagagaagatgaagaacagaacmcmctaaatagcatctttgaatacaaagaaccaagaaaaaggaatgaagactcgcaatttcacgacacactttgatcccttctgttggtgtcatgttgtaaacatttctttcaataaactaaagaaaaattattaaaggaacamatacctttggttaaatagtytagactaaaagattgagaagttactttccattgctatctattgataatttagacattgagttcaaattgccttcattttatgataaataatgatttaactgacaccttctcatttcctttgtctcatccttctaaatagttatattacgatcaatccctgtaaagctcaatgcccatattttacaggtgtgagccaccgtgattttctttgtggtacagcttttggtttttcctccagttaaccttcaccttacattcttctgcttgcctaattttccttctatattcttagttctttccagatgctttgtcattttacccactttataatttttctcctacaacctagttatgccacacaactgtcaccttttttctagaccgtttaagttggcaccattatttccagaatcccatgttttcccatcttagcatatgccttcttttgctgtgtaccattttttggtatcttactaagaaagggaagatgagaggtaaactttttatctccttgcatttctgaaattgcctttaatttgggctgataggaatttcctccttagaattttagaatttcgcaggcactgtttttaagttttatttcagttctacttttggggggagatatatctttgttttttaaaatctttttttttttttttttttttttttgagacacagtctcactccatcgcccaggctggagtgcagtgatacaatcttggctcactgcaacctccacttcccaggttcaagtgattctgcctaagcctcctgagtagctgggattacaggcgtgcgccaccacacccagctaatttttgtatttttagtagagacagggtttcaccacgttggccaggctggtctcaaactcctgacatcaagtgatccacctgcctcttcctcccaaagtgctgggattacaggcgtgagccaccatgcccggcctaaaatcattttattgaatatgaagtttagctttcatttcatttatcccccaagagtttcttattctctatttggtcatttttcatatcattttactcttatcctctagatgcagtatcttatatctctcagaatatgattatagttttaatttttttgataaagtttccctctgttcccttcattctgtttctgcagcccatgcattttgatctcctctttcccgtgtttgagcagtagagtattgtagaagctaagaagcgtggattctggggcctggctgtgttgcttacttgctgtttgaccgtagggaatttaatttttatttgccttgtcatctctagcataatgtagatgtatctacctcattgggttcctgtcagtattcggttaatcaatgtaaaacacttagaacattatcctaatataatccgataatctgataatcctctcatattcctttgattaggattgttttgctggggtttctttccttaatatctggcaagccttggttgttcatacataagcggaagctctgcgtaggtggtacattgagtaggcaggccacattaattgttgggctttactctgtgttgatagggtggtaaaccattttacctgccccttctctctccattccagtttagaaatcatactttatttttaaagaagttagaaatgcctgagagctatatagtatctttagcagaaagaataatttattttcacattttcttgtagcattattggcacatgaaaaggatatttctggattcatataatactaagattgtaatgtagaacaaagagaatttagtttttgtaaactaatttcaactaacaaaactggtcacacaggtcatatcaagaagacaaaaatatttactctgtcctctttcataattcatgccatattattgaatggggataatgtgtaacaggctcagaagcagtttgagactttgaattatgcaagtaaatattgagagtttcacaaaagaaagcacaggttaacaacatttcacattgataaagccaaaagtaagtttttaataacaacatacctctaaaggctttcttgaaaactatgtcccccctcttttacttcttgtttttttctcttttttattacagagcaaagatttacatatggactcactttccttagttttagaaatatcctctgtagaactcatttacatcacttctatcattccaaccctcaaaataaagggtgatcaaggtgcaggtagcattatgccttctttttctttttgtatagacagggtctcactctattgcccatgctggattacagtgatgtgatcatagctcactgtatcctcaaactccttggctcaagcaatcctcctgcctcagcctcccaagtagctgggactacaagtgcatgccactatgcctggctaggtgtttttatttatttatttatttatttatttatttatttatttattgtagggacagggtcttgctctattgcctaggctggtctcaaacttctgggcttaagcaatcctgccttggcctcacaaagtgctgggactacaggtatgagccactgcactcagcctccttcatattgctttaaaataaatacaatcccatcaattgaaaaataagtaggaacctaggagtccccaatacagattctaatatgcatgaattcagttatcatgatgtaattaaataagtttctcaacaatgttcacatttcagttaccaaagtaataactgagtagatgcgtaaagtagaaacagtcgctgctagctctttagtccacaaatcacttcataaatgacagatgcacgaagactagtgaccatcacttctttcaaagtctgtcccaagatcagtcactgcatcagttattcatttcacacacacacacagcaaagtgtgtagttgtgttgcctctttgtctttagcaataaactcctcatgcattttatagaagtagatacctgagagggaattgaccaccaaggattaatgtacaccaaagaaacaaaaagtgatagggcacggtgactcacgcctgtaatcccagcactttgggaggccgaggtgggcggatcacgaggtcaggagatcgagaccatcccggctaacacggtgaaaccctgtctctactaaaaatacaaaaaattagccaggtgtggtggcgggcgcctgtagtcccagctactcgggaggctgaggcaggagaatggcatgaacccaggaggcggagcttgcagtgagccgagatcgcgccactgcactccagcctgggcgacagagcaagactccatctcaaaaaaaaatagagtaaaattttttttagattggccaggtattggtggtatgcacttgtcccagctactgaggaggctgaggtgggagaatctcttgagcctgggagtttgaggctgcagtgagctatgtttgtgccactgtacaccagcctgggtgatagagtgagaacctgtctcaaaagaaaaaaaaaatattttttaaatggtgaggctggaagtaaaatttgagtgcaatgcaaatggaattgtagatgaaatagctgatattggactgtgaatgctgttgcccttctagagactagatatacagccagagaaaccttgtgaaggcaaacttacaaatgaggaaagagatggaaaggatgaagatgtctccagagagtgacactagtaaaaaactgtacattaaagggactcttggagctatctaatgacattggaagatcaagtgataaaatgttgaaactaaatccaaacttagaaaggagtaaagacaatttgccaaggcacggaaaaaatgcttgttcttcatcgtaagttatagaagggaaaaaagaagacaagcatggtttttcatacagaaataaaacacttgattctcaatatttctactgttttaaagtgagtctactaaattttagtattttaattttgttacgcattgaacagagtttttaatactttcacacaaatttttttttcattgtttagttttgtttcgaagacttaaagattcatacttttttttttttttttttttttttttgagacagagtcttgctccgttgcccagactggagtgcagtggtgccatcttggttcactgcaagccccgcctcctgggttttcaccattctcctgcctcagcctcccgagtagctgggactacaggcacccgccaccacgcctggctaattttttgtatttttagtagtgacggggtttcaccatgttagccaggatggtttcgatctccctaccttgtgatccgcccgccttggcctcccaaagtgttgggattacaggcgtgagccaccgcgcccggccagattggtactttttttttttttttttttttttttttgaggcggagtctcgctctgccgcccaggctggagtgcaatgagcgatctcggctcactgcaagctccgcctcccgggttcgtgctgttctcctgcctcagcctcccgagtagctgggaccacaggtgcccgccactgcccccggctaattttttgtatttttagtagagacggggtttcaccgtgttagccaggatggtctcgatctcatgacctcgtgatctgcccacctcaaggacttttggacaattttttttaaaggtcacagaacaattgtaattttcccccaatgatgattaagatcactttgcatagtttcagcaagcaggacatctttgtagtcctgcactattgtgcaaagtgaagactgactttatatgcttttttagatgagtatacaaagtaagagctttctgtttttcgggcagagttgggaaggagatgaaagcagaaaatgtggttgctctctttgcaggagcagagctgcagaagcacactgattgctttcagagcacaaccttgtgatgaaaacattcaggcatttaatctattttataatttacactagattataaaactagattcacctttctgcatatcaacaaatccactttttatgctgtcctgaaaattcaaatattcatgatgatgaattcaagtgtaattataataggtacctttctcacattgaagacaagatgtccaataatgttgcagaatcttttggtataagatttttttgttgttgtttgttttttattttttgagatggagtttcgctttgtcacccaggctggagtgcaatggcgtgatcttggctcactgcaacctccgcctcctgggttcaagtgattctcctgcttcagcctcccaagtagctgggattacaggcgcccacgaccaagcctggctaatttttgtagtgtggagatgggggtttcaccatgtgggccaggctggtctcgaactcctgacctcaggtgatccgcccgccttggccacccaaagtgctgggattacaggtgtgagccaccacgccaggcctaagatctttaattggaagtcattggacctcaactgcatgcatgtaaactcactcttctggccaatcagaaatgatatctgatcattatcctgtatattacctactacattgctggttgaattacttccagtactagatatgcagtttcgctgtagatgatggtagctatgatgataccaaagaaaaggctctttttagcccaacaaaaattttaaaagaacattgaaaacaagcagagtggatacataagaaatatgcaaacagatatgtagaggaaaattaacctgttctattctgatataaaaacgatgcatagtatttcatttgtattttacaaaagagaaccgagattatatgcagcatttacaagtatcttaccttgtaccacaatgcaggattccactgctcctcatcaatgtactctgaatttctgtatatgagcttctgtgacataaaatggggcgaatctgctgagacttgccctcagggtttccatccttaaccaaaccctactatatattggagggtccatggccttcttctcaaaacaaataattaaaataaaaatcaagatcctaagacaaaatatacctagctctttttaaataatgagcaatgatttcttgtcattagatgcattccccctcactcaggaataagagatctttaacagtttcttctttatccgcttaggccaaaggaaaagc

SEQ ID NO: 12286 - DNA, 28252 bp, Homo sapiens
tcatgtctatctacctcttcatttgacaaagggttcctaattatctcccatgtggcagacacagtgctaggtacccagaggtttgtccttagatgctccccttttcattccacatctcaggggctcttgttcattctgatggcttcaattctgaaatccataactccagcccagactttgtttcctgagcttctagctcatatatgtaactgcttcctggacattcccatttctcataggtaacctcaaagttgatttgttcaaaaattacttcatggctgggtgctgtggcttatgcctgtaatcccagcattttgggaggctgaagtgggaggatttcttgagcccaagagttcaagaaatttcaagacagcttctttcaatttctgtagctatccagttgcagactggtgaaatttgcaaaccattgttaaccacagaccacactttgagtagcaccaaagagaggcaacagaacagaatgtacatatgtggtccttagagcaggacagcagaaggcagaaaaagaagattcttttaagcaaacaggtaataatgacatcatcagtaactacagttactgatgtagttctctactaagttctctgtactcaatcagttctctgtactaagatatgggtaacccggggcagtgcaagtgcagaggaggcacctaggccagcctgggtatcagggaaggcataagacaggtaggagttgggtgggggaagcattagtgacgagtgggaaggacactccaggcagagaaacaagttctggagtcattctgcagcatatgggttagaagatgacctttcctgtgatttgatggctacttgtctctgcgcatcagcattagtttccatgtgtataaaatggatatgataatcctttctttgaatcacaaaaagataaagcatgagatgtacctgttataatgcctggtgcttgctaatattgctgttctgtgtgtaaaagatacaggagtcagagctgccacagacagcgagttacagcactttgcaggggacagctcatggacccaggactggagcccagaatgacaagggttctggaaggtaacagggaaaatggcagtggggtgggcagcatgcctgcccctgagtcattcccaggcctaggtgtgtgtctacaggatggactgtcaggggaggatagggtgcattgtaaggttgggggaggaggcaggacctcagggcaaactcctctgacctacaaggcccaggcattccagatgtccacgcaaaaattggctccaaattaaaaggctgaaaggtggggctggctctgtcctattttgatatgctttgaggcattcgataaagatgttaatgggatcattcataaatcaggaaactaatcctctgaggtgctggttgctaatgaagcgagaatcaggaagattaaatcacagatttcaaaatctcaggctggaatttaatcccagaccttgagtccagacttcatctcaaacagatggcatggttcgaaacatatcccgactgcagtagtcacttggaaatgagttcccagtagtccttgcagttcaaccaaatactacttctgggaatggggcatggaaatgggacgtcggggtgcagcaaaggcttcctggaggtgaccccaagggagagtggcctatagtagacactcattaaatattggtaaaacaaatggagttagtagatgaagaaaagggggaagagcattccaggcagagataatacagggccacctggcagggtcaagaagacttggggccccttggcatattaaagtgggcggtggtagcagtctgtccacatgcaggctagaaggggtgcatatctataaagagcttaacaataatagatccaactaaaagttggtctgccttttattattgctgtgtgccagtgatttttaaatactgttgaaatactcctctcctaaaaaatcttttgttggtttaagttctaaataattgctgtagatactgaattttatttgtacatgtaaacttcacactaacacatttttattagcgatcctttaataaatattgcattctatgtggaagttcatttggagaatgcttggttatatagtcacaccaatacccatctttggagctcactttaggcaagggtcacatctcctacccctgtggtattagacacatccaagtttacactgtagattcagaataaacaatcatgagttactgtcagtgatgacaaagacaaacagggcttgacttttttcaattctgtcattctatgtaaccagttggacttttgtgttaaaacagtgggacaggccaggcgcggtggctcatgcctgtaatcccaacactttgggaggccgaggtgggcggatcatgaggtcaggagatcgagaccatcctggctaacacagtgaaaccccgtctctactacaaatacacacacaaaaaaaaattagccaagagtggtggcaggcgcctgtagtcacagctacttgggaggctgaggcaggagaatggcatgaacccgggaggcggagcttgcagtgagccgagatcgcgccactgcactctagcctgggcaatggagcgagactctgtgtcaaaaaaaaaaaaaaaaaaaaaccaaaacaaaaaaaaaacaaaaaccagtgggacagagtgcaaactgagaggcaaaacatttttgtttgttaagtgcaaatttttaatttgtacatgaaatatgttactgaatttgaataaaaatttacctttgaaatgaaaacctattcctttatacttgttaatggttttaaaatgaaagatgaataaaggaaataaatgttatagcctaagtattattgcctaaattgtatcttatttagatgctttggttttattaaaatttgcttgttggttgctggatgaccatttacataagggagtatatcagattgtaaagaaaggatcaaaatttaaacaggtagatgtgaaaatgattgaaataaatagttgtgcctttttcattttttggagccataatattaattttatgtatttattttatgatgtgagtatgcatacaaattttggcaaataaatttttcacttttgcctttcctttttctggccattattatgatttgtttcattttatgatgatttgaaaatatgaaatttgaattatggaaataattttatttttagaggaggggggtataaaaatgatctgctctgtgtgtcaaacatgatccattctacaaatatttcctaaatgccatgttgggagaaacactaggtatgtgggaactgaaagaggcatcaaatgggagtcagagatggccccaggaggaggtgatcctggagttgagagctgagccattgttagccatagaatcatagccaccatttctcaagggcctgctctcagccccactccatactagtagttggggaccctaagatacataagagccttcttaccccacttgttatgatagagcaaatgtccctgctctcactaaaggcccacttgtctattggtactccagatcctgtcctttcttgattcatccatgactttgctcttataatagagccctctgtttctatatcagtttctcctttggtgcatccccatcagcctataacatgccctcccttaactgccacctcatttttctgctctcattcgtagcaaaacttcttgtttagagtttagagataatgtcccactccatcaactcctcttcccttggcagcccagtccaatcaggcttccttcctactgcacttggttttgtcagagtcaccagtgacctccgtcttgccaaatccagtagtcacttacctgtttatttcaacctctcaggttctttggatgactttgctgttctgctgggccttaaatgtaggagtccccaggctctgtcctctgtcctgttgtcaaactatctccagtgttgatagcatccactctaatggccttctaactaccatctctatgctgacaacacccaagtttacatttacagccctgaccttctctgagcataattaatagacatctcaaaatcagtgtctaaaatggaattcttgtttcagttgcctccaaatctgctcctcttcctatctttccatataccaagtggcacgatcatcatgcagttgctcaagccaataatctaggagcctttttgattcctctttccctccctccctacccccttctgatccattacaaattctgtttttcattctttttttttagagatgggatctcactatgttgccaaggttggagtgcactggccattcacaggtgtagtaatcccattaccaatcagcataggagttttgacctactctatttctgacctgggccagttcatccctccttaggcaacctggtggtgccccactcctgggagctcaccatactgatgctgaacttagtgtggacacccaatcagcacagcacactgcagcccagacctcctgggctcaagtggtctcccgcctcagcctcctgagtagctgggactacaggtgggcaccacctccatgaccaaacactgacatctctttcttggacagctccttttttatttattttattttattttattttatttattttattttattttattttatattttattttattttattttttgagacggaattttgctcttgttgcccaggctggagtgcaatggcgcgatctcgacacactggaacctccaccacccggattcaagcgattctcctgcctcagcctcctgagtagctgggattacaggcacgcgccaccacgcctggctaattttttatttttagtagagacggggtttcaccatgttggccaggctggtctcaaactcctgacctcaagtgatctgcccgcctcagcctcccaaagtgctggcgttgcaggcgtgaaccactgcgcccagcctcatctcctttagatttctaactggtgtctctgcacccctctggccctttataatccataaggagccaaatggtttattttaaaaacatatatcagatcacatcaaattcctgtttaaaagcatcagtggcttcccgccacacttagaataaaatccaaattcctttctatggtcttcaaggccctatccctctgtcctcgtgtcactgtccatgtggtatcaccgtggtcaccttgccttcaatttccttctagcaccgttgggctcttttttgccttagagcccttcaatcttcctatggctggctcctttcaggcatttcattttcagctcacatttctgttttggttttccatagcactcaccaccacctaaaattataatagttaacaactttattactcatttcttgtcttcccgtataagatggaaattgacagcaaggactttgttctgtcctgtttactattttacccctagttcagagatcagtgcccaacacacacggggcactcagtaaacactgcggaataaacaggttgtgccatgaagctcccagtcttcagttcgtacagacaagggacagaggtgcacagactgtagcagaaaagctccagcccttccaaagcttatggcaagatcccgacctgagagagtgctggtggaggctctcctatcggtagaggccctacacccaaccttgcctctctctccagcctcgcctctctctccagcctcctcctggctggagttggagacctgggtgtcctcagtccccacttgggtgaaacagttgctcagactgaggggtggaatgggtcggttgggtgggcggaccaaattcctttaagaagcgttcaaggcctgaagtggctggctgtccgtgaggctgccttggttggggcatggtgagggtgggtggcagcctggggcagggctgcgagggcggcgcagggcgggacgggtggggcctgaccccgccccttggcgcagctgtaaataggtaaatagaaggtgattgtggcgtggcgatgtaccgatacccgcctgcgacgccgtggtggctggttccctgtctcttcagtagagagtctagaccccacccagtcttcatgtacggccgaccgcaggctgagatggaacaggaggctggggagctgagccggtggcaggcggcgcaccaggctgcccaggtgagtcaggtgccagcccctggcaggccgggcgggcccaggctagggggcggcggggaggggaggccttggaggagaggtgaggcggagggaagcagaaacccgaggggtagaaatccgaggggaggggtggcaaaggaaggaatgggagattggggaggggttgcaaagggagggatgggagattggggaggggttgcaaagggagggatgggagactggggagggattggaaagggagggttgtgagattgagggtgtaaatcatacgtcgtttattccaacaatgttcgcccagcagtagagcttgtgttggccgcgtggcgggtaagagggttctaggcaactttctggtgagggacttgagtaggcaggacagcaaagaccaagttaggaagtgagcaggaaacaacaggaaaaaaaaaaaaaaccccaaaaatgttaattggagccctactaagtggtaggcttttcccagaccctggaaatacaatgatgaatttaccatgaaacagatatatataaaattgtatgaataaatcgttaactgaatgattggaattgtacagcgttacatgaagaagaagtcaggggcgcgtgggagcagataccagaggtgtttgacccgatttgggaggcttaggagacagctgagactctgttctgggactaaagaacccgtcaggtgaaaggttcccaggtctgagaccacaggctgcatgcttcctcttaggaggaactgaaagaccagggcctagacagtgatggaagggtggccccagggacaccattgagatcattcagggcttgtttattccaagaacagtgggaagccattgatgagtttaaacataatctgtctcaattagatttgcattttcaaaggagtgccctggtggatgtgggctggattcaaggcaacagttagaaagcttttgtgataatccaggtgagarttcaaatggcggcctacctgcagaagtgagagtggagatggagaagctaaatatatcatagattgtggagatgttttggaggcagagaccacaatcattggtccccgggtggtgagggagacatctagagtaacagatttcttgcttgcacaattgggtgacaatagtgacattttctgagagagagtgaaggatgagawggacaagattaatttgttgtttgagggaggtgggcaaagatgctagtgaattttggccatagtccattagaagagcatgtgggccatccgaaaggactcaaacaataggtagctggaaaattcaggagccatcttcgccagagcgaagattccagatttaggaatagttggactgtaaacagaaacaaaaccactggcatggggaagcttgcccagagagagcagggaaagggaaatctgcaaaagaaactgtgaaggagggggtctgagagaagggaaggagaaaaacttggaaagtgtggccatgcgtgttagagaggccaagcattctaagaagggtgtggccagtggtcgtataagctcctgagagttcaagcgaggagtctggaaagtgctgcttggtcatagtgggatggaagtcatcagtggtgacctttatgaaagctggttctgtggagagatagaggccagagcaaatttgggagactcataaggcaaagtagtggtgaaggcatgtttagacaacttaatttgccatgaaggactgggaaaacaagagggccattgctgagagttagggaggagaggctgagcaccccagaggtgcccacccaatagtcatttacctagttcctattatatgtctgtcttatgctagttgctgagcatatagtggtaaataaaacagataaggctgggcatggtggctcacacctgtagtcccagcagcccaggaggctgaagcagaaggctcgtttgagctcaggagttttaggctgtggtccacaacgatcacacctgggcatagccactgcacttcagcctgggcaacatrgtgagatcctgtctctaaaattaattaaataaaaaataaaacaagatcttcccaactcttctagagttttttttaaaaaatgaacatttttctctatagccaaaaccacataatcaaacgtatcaaaattgtatatatatatacactttcttttgagacaggstcttggtgctgttgtccaggctggggtgcagtggcaccatctcagctcactgaaacctccgcttcccaggttcaagcaattctcgtgcctcagcctcccaagtagctgggattacaggcgtgtgccactccacccagctaattttttgtaattttagtagcgggattttgctatgtttgtcaggctggtctcaatcttctgccctcaaatgatctacccgcctcagcctcccaaagaggtgggattacaggcatgagccgccacgcccagccgataattcctttaaattatcttagatgcaagccttattcaaatgcycctagctattcctaaaatgtacttcgtagctggtacgtccaaaccagaatttaagaccatacactgtatctggtgattatgtcccttgagtctctgaaattagaatagttttattttttcatgattgggattcagtttttcatgatgctaacttttgtcttatagaatgttcctttccgatatatcagattgcttcctcatgataacatttagctttatcttctatcacttgtattacctttaagttatgattagatcttacagcttaactggattcaagatttttggcaagaatgcctcatgtgtatggtaggtttcatcttgcattacatcaggagacacatctggctaccatttggtgatacttgtattaaggtagygaaaagcctcattgatctctctgtagaaatttaccttgtggtcagaaagtaatctgtgtgattctgccttttgtgtatccagtgtccagttccctaccagccattcacctactggttttaacaccaaatttaaatttttcctcaattaaatttccttagggatggcaaaataaatttccttttcctttatgtcttttccttttttcatttttttgtcccacttttatgtttattaaaaactgacataaacacaacctgtacaaaaaatatcccaaatcccgtatgactttgaaacagtaatcctgagagacattatcgcctaggaccccctcttcctctgccacggccacgtcctcttcctcttcctctgcctctgcctcttyctgcaacagcttcccttttcttagatttcaccttaggttcaacatccacaagtagtgtatccagaggtaaactgtctagtagaataaaataccgaatgttatttcctcgaatactcagcgtttccagctgtacaggttctctgttcttcggggtcattttcacagctttaagatgtgtattcatgctgacatccacacctgtgactgttccatggacctgtgttctgttcttcaatgcaatggttacagtttcatgactcaatttcatcaaaaatctcacgagcttcatcctagcggtgccatcaccctttgggtccgatagcacactgaatccaacaaccgaatactgaccgactgcagtatgaatggccgtttttggttttttttttgagatagagtctcactctctcccccaggctggagtgcagtggcacgatcttggctcactgctgcaacttctgcctcccaaattcaagcgattctcatgcctcagcctcccgagtagctgggattacaggcatgcaccaccacgcccggctacttttttgtatttttagtagagacagggttttgccatgttggccaggctggtcttgaactcctgacctcaagtgatccaccccccttggcctcccaaagtactagaattacaggcatgagccactgcacctggcagcaaaataaattttctaattccaccattcattctacatttattagtttgtattcttctgtaaagtaggaagtaatatttaactgcaattatttggtaattttgaatttttttttcttttagaggcagaataaatgcttaatttattcacttctattagcaatcttcaaagttaggataagagctgagcttttgtcacgtgaggctgcagtgagccatgatcataccactgtattccagcccaaaatgaaccatgattgatcgcaccattcacatctcagcctctggagtagctgggactacagacacttgccactatacctggcaatttttagggtttttttgtagaaatggggggtctcaccatgttgccctggctggtctcgaactcctggcctcaagcgatccacctgcttcgtagtctcaaaatgctcagcctgtaacagtcttgataggttttgtgtttctaggaatttgtccattttatccmggttgtccaatttgttggtgtgcaatttttcataatattgtattataatcctttttacttctgtaaaattggtaataatgtccccgatttcatttctcatgttcaatcatttgagtcttttctttttccttagttgatctagctaagtgtttggcaatgttgttaatctttcctaagaacttttagtttcattgatttttttcattcctttcttctgctggtttggggtttagtgtatttttctagttccttaaggtataaagttaggttgttggtttgagatcttttttactgaaagcatttaaaccagtaggttttccccttatgactgcttttgctgtatctatcccattagttttgatagttatgttttcatttttattggtctctaagtattttctaattttcattgtgatttttttatttgacccattgattgtttcagagagtgctatttaatttccacacagatttgtaaattttctagtttatctggttgtgggtcagagaagatactttgtatgatacctttttttttttatttttttctaaaagcrgcaagagaaaagtttattttgaaatctattgagacttaatttgtgatctactatatggtcttctgaagaatgtcccatgaacactttcgaagaatggatattctattgttgagtggagtgttctgtgtatgtctgttagatctacttggtttattgtggtgtttggatctaaatatatatacagcatatatttggatcatgtttttaatccattctgccaaattgtcttttggaaagtattatccatttactttccaaagtattttactttcaaggaatgatttaattctgccattcttttcctcatttccagcattgtctttttgtttgattttttttttgtagtgaaaatacatttccttaaaacacaatttccttttgtatatattctttttttttttttgagacagagtctcgctgtgttgcccaggctggagtgcagtggctggatctcagctgactgcaacctctacctcctgggttcaagtgattctcctgcctcagcctctgagtagctaggactacaggcacgtgccaccacacttggctaatttttttttttttttttttgagatggagtctcactgtcgcccaggctgtagtgcagtggcacgatctcggctcactgcaggctccgcccccggggttcacgccattctcctgcctcagcctcccgagtaggtgggactacaggcgcccgccacctygcccggctaattttttgtatttttagtagagatggggttttaccatgttggccaggcttgtctcgaaytcctgacctcaagtgatccacccacctcggtctcccaaagtgctgggattacaggtgtgagctgctgtgcctggccccttttgtatgtattctctagctatgtcctttgtggttgccatggggattacatttgacatcctagtttataacattctaatttgaatttataccagattaacttcaatagcacataaaaactgcttctgtatagctccattcccacctcttttcagttactgatctcactaaattacatttttatgcatcgtatgtcaaaaaataaaagtataaattttatgcattcttttaaatcatgtagaaaacaaaaagtggagttatatatcaaagttaaaataatactcacttttacaattgtccatatatttacccttatcagaaatttttcttatgacagatttcttcacatggcttcaagctactatctagtgtcatttcatttcaaccttaaggactgccattagcatttcttgcaggacatgtctagtggtaatgatctctcagcttttgtctacctgggaatgtctaatttcttcctcattttgcaaagacagttttgccgtatataggatggttaatagttatttttcctttagtactttgaatatatcaacccatggtcttttagtgtccaaggtttttgatgaaagagctactggtaatttgtgggatcccctataagygatgagtcacttctcttgctattttcaagattctctctttgtcytgggctttcgacagttttattttttatttttgagacggggtctcactctctggaatgcaatagtgcgatcttggctcactgcaamctctgtctcctggattcaagcaattctcgtgcctcagcctcctgagtagctgggattacaggtgcccgccaccacacctggctaatttttgtatttttagttgagacggggtttcactatgttggccaggctggccttgaacttctgacctcaagagatccacctgcttcagcctcccaaagtgttggaattacaggcatgagccaccgcacctggcctcaactgttttattataatgtttcttggtataggtctgtgagtttatcctacttgaattttgttgagcttcttggatatttgtattcatatctggaagtctcttcagtgggaaggggagggggttgtaacattgggggttgagttgccataatggctgccaacctctgtctgcacctcataatcagaaacagcaaataacaatcaggatatagattccctaatagttggaggacaaggttttttttgttttgttttgttttgttttgtttttttgagacagagtcttgctgtgtcrcccaggctggagtgcagtggcatgatcttggctcactgcaagctctgcctcccgggttcacaccattctcctgcctcagcctcctgagtagctgggaccacaggcatccaccagcacaccyggctaatttttttgtatttttagtggagacatgggtctcaccatgttagctgggatggtctcgatcttctgaccttgcgatccacccgcctcggcctcccaaagtgctgggataacaggcgtgagccaccgcacccggccaaggacaaggtttttattgcccactctggctcctgcaagctgcatgcaagttgctccaggaacatggggtgtgtatcggtagctactacctacctaagaatttaggttgaccaaaattaactgcaatttactttcaaagccttcctttggaagttacaagcctttaatacccttcattgttccaaaaaacttataacagacaaatgctgccagtgtgatagttaccttgctgaggatacaggttcctggtgcttcctaccctgctatcttccttgatgtcacttcctgtctccttttgacccagtcctaatctttgaaagctcccttattttctggcacgaaatgtaccagtctcccttaaaccttccttttcccagtcttggagtcaggaaattcttggtctaacttttagcaaggaatagaattagagacaagtctaggctctagaggcacacgttgttattasagtcacaaatgcttcgataggctattttactggacagagctagaaaaaawatatatattttttaccttgtgaattagtatagaatatttcctatttaaatttagcattattattatttattttgagatggggtctcactctgtcacccaggctggacagcagtgatgcgatcacagctcgctgcagcttcgacttcccaggctcaagtgatcctttccacttcagcctcctgagtggctgggaccacaggcgcatgctaccatgcctggcttgttttttttttttttttttaattctttgtagagatgaggattccctatgttgctcaggctggtcttgaactcctggactcaagagatccttccacctgggcctcccaaagagctaggatcataggcatgagccactgtgcctagcaatactaacttattttaaaccatattgctaaaaatgacattcaaacagaaaagtgaatgtaagtacagcttctacaaagtaatgaactgtttgttacaaagtaaaacctgtgaaactgtcactcaggtcaagaaatagaagcccgtccagtgtccctttcttatctttccccattccctactctctaatataaccccatcctgttgtctggatgtaacttttttgaatttccctatttctgacctgtgatgttcctataactgctgcaaaatttgtaattgcttcaagtttttacttccttccttccttccctccctccctccttccctccttccttccttccttccttgaactcctgacctcaagtgatccacccgcctcggtggatctttccctttctttctttcttttcttttcttttcttttcttttctttctttctttctttctttcattctttctttctttctttctttttctttctttctttcttctcttttctttctttcttctcttttctttcttctcttttctttctttcttctcttctttctttcttctcttttctttcttttcttatcttttctttcttgtgtttgattgttgttacgttttcccttgatttgtagcaacaattttcgggtgacttttttttttaattgcaatcttcaatttctgtcttggtggtttattatcttgtatggatattgtattttaaacttctcttttggttgtcatatttgaatggattgttcttttctggaccatcccaattgaagagtgaataggagatgataggatagctttattcgtttctcaactcaagagctccctcttctattgctacagtaatggacttttttgttgctgttgtcttgagacagagtctcactctgtcagcacaggctggagtgcaatggcacaatctcagcttactgcaacctctggctcctggactcaagtgattctcctgcctcagcctcccaagtagctgggactacaggcacacgccaccacacctagctgattttgtttttctttttgaaatttctgagctcaagcaatccacctgcctcggcctcccaaagtgctgggattacctagttgtgagccgctgcgcctggactactgacagcttttaaaaatatggttcttggcttctatcctattttaagaccttctaccaccaatctctttcttacccttcatgcaagtcagtcattaaggaaactgcccctgacttccagacaacccccatccctttttttaagaagtgtttttttcacatctgccttttccccatctctcctccagtgcttgatctcagacctgcccaggcagttcccactcagggcagacgctgtaaatatttgcagatgatgtctaagttttgccaaagccgagacccatctgcagcctcaattcctttcatctctgtggctttctgcacccgttctgctggtttgggatgttctttcactttcacacttatgtataatttggagtttgggccaggcgcggtggctcacgcctgtaatcccagcactttgggaggccaaggtgggcagatcacctgaggtcaggagctcaagaccagcttgaccaacatggagaaaccccgtctctactaaaaatacaaaattagctgggcatggtggtgcatgcctgtaatcccagctactcaggaggctgaggcaggagaatcacttgaacccgggagacagaggtcgtggtgagccaagatcacgccattgcactccagcctgggcaacaagagcgaaactccgtctcaataaaaagaaaaaaaaaaactggagtttgaacattttctcagttttgctgaaggtgtaggttatggactgttttatttgctctctttgttgctttgtgtgaaataaaaaccaaaaacatgtccaagggaaggtggcatgagttacatttaggcttccgtggggcttgtatcagccagaccgcatgttagaaagcccaagctgggaaatggtctggaggcaggataattcaagcaagagatggaaatagagggctggattaggatggggtctggggatgaaraggaggaacatgtggaactggaatttgagcaaaaatcacctgactctttttccccaaggataacgagaactcagcgcccawcttgaacatgtcttcatcttctggaagctctggagtgcacacctcttggaaccaaggcctaccaascattcagcactttcctcacagcgcagagatgctggggtcccctttggtgtctgttgaggcgccggggcakaatgtgaatgaaggggggccacagttcagtatgccactgcctgagcgtggtatgagctactgcccccaagcgactctcactccttcccggatgatttactgtcagagaatgtctccccctcagcaagagatgacgattttcagtgggccccaactaatgcccgtaggagagcccaatattccaagggtagccaggcccttcggtgggaatctaaggatgccccccartgggctgccagtctcrgcttccactggaatcccaataatgtcccacactgggaaccctccagtgccttaccctggcctctcgacagtaccttctgacgaaacattgttgggcccgactgtgccttccactgaggcccaggcagtgctcccctccatggctcagatgttgcccccgcaagatgcccatgaccttgggatgcccccagctgagtcccagtcattgctggttttaggatctcaggactctcttgtcagtcagccagactctcaagaaggcccatttctaccagagcagcccggacctgctccacagacagtagagaagaactccaggcctcaggaagggactggtagaaggggctcctcagaggcaaggccttactgctgcaactacgagaactgcggaaaagcttataccaaacgctcccacctcgtgagccaccagcgcaagcacacaggtgaaggaggtgtcaggtggggtggggatggaggagtctctgggctttagatttgtcctgggccactggtgggtaattgtttgggatgagcctttcatcttccaagcttggaactaagctagactggccccccgacttgccatacaggaggactgtgccaagatgactggggcgggcactcctgattgtgttgcccctccctggttccctggaccttcccttttgaatcctcaacctggactgctctgcctcacagagttagaccccttccttcctactgtattctaaattccatctctcccttgtcattcccaggtgagaggccatattcttgcaactgggaaagttgttcatggtctttcttccgttctgatgagcttagacgacatatgcgggtacacaccagatatcgaccatataaatgtgatcagtgcagccgggagttcatgaggtctgaccatctcaagcaacaccagaagactcatcggccgggaccctcagacccacaggccaacaacaacaatggagagcaggacagtcctcctgctgctggtccttaggtcagtctcctctcctcattctgggttttctttttccttttttcctttttatttttttgagacggagtctcactctgtctcccaggctggagtgcagtggcgcaattcggttcactgcaccttccacctcccaggttcaagtgattttcctgcctcagcctcccgagtagctaggactacaggcacgtgccaccaggcccgggtaattttttgtatttttagtagagacggggtttcactgtgttagccaggatggtctcgatctcctgacctcatgatccgcccacgctggcctcccaaagtgctgggattacaggcgtgagccaccgcagccggcctcattctggcttttctacacagatcctacctgcctctgaccagttcttctctttggtgggtgtaggattagatgaagacaggaagattatggatcagtgttgaagcctacacggagctctggagccagagactcctcaaaccctgtctcggatgcccttaacctctctggggccacctgcttctgctggagtttagtcagatgcgaatgtggagcacagtagagactgggagcttcattaaaatgctctttatttcttgtcgctccccagcttaaaaccctttagtgactcctttgcttgctacataaaatccagtttccagagccagactattttcaaatcctgaatttgccacttaatatccatgtgaccttgagaaagttcttggatcactatgctttgtttcttccagaaaatgaaaaaactagttttggactgtattagacgtggcacatatactgcatcattctccctggcactcactggccatgtacccagagtttctgtttcttcccaccactttacagacttggatggaatgccctggcatagggcatgggatctggcatcccaagttgctgctagcaaacttagaagtgtggggaaatttatttatttgagacagagtcttgctctgccaccatggctggagtacagtggtgtgatctcagctcactgcaacctctgcctcccgggttcaaacgattctcctgcttcagcctcctgaatagctgggattacaggcacgcaccaccacacccagctaatttttgtattttttgtagagacggggtttcaccatgttggccagactaatctcaaactcctggcttcaagtagtctgcccacctcagcttcccaaaatgctgggattacaagcataagccatggtgtctggctgggagttaatatttatgggataaaatttgaggccgggcgcagtggctcacgcctgtaatcccaatactttgggaggctgaggcgggtggatcacaaggtcaggagtcttgagactagcctggctaatatggtgaaaccctgtctctacaaaaaatacaaaaattagctaggcatggtggcgtgcgcctgtagtcccagttattcgagaggctgaggcaggagaatggcttgaacccgggaggtggaggttgcggtgagccaagattgtgccattgcactccagcctgggtgacagcaagactccatctcaaaaaaaaaattttttttttgactagtggaaaatgggagataggtgagactcaggcaaatcaattcccccttttcccctgcctttcataaattgctgcatggcaccaactctccaaaacagtaccatcaatggggaggcctcccaagtagccggtggacagaactactgtgacctctgcaaggcttgtcatgaagcagtgcccaccccagcctattaaatacatcaccttacgttacttcccattctttcccgcctttcttccattttctcacttccaatgccttgggtttgcacctctccaaataaaacaccagtacttagttcttgttttcaggctctgtattctaggtgactgaggactaggagggagaggaggacctaagcctggggcagataaagatgaatctcactgtaacttcttctcctcccaccttccttaggtccctggactacaaagcaccagatattaagtggcctatctttccttgctctcccttggggttaaggggataatgactatcttggcaaaccagccaggtagtttagaacctcatatttagactcggcaggctgttttactccaggaaattgatagagagaaaggaacttggccaagctatcaagtgcagatctagaatcccaaccaggatctgtctgccccagaggtggtctcttccgtaagaagatggtgccttctatgggtgtttcctgaacgaggctggtgccaagcacagagagatgaatcagagctggtttctgtgctcaagggaccgtcttgatctgggggctcagaggtccacctcggtacagtagccatggggaagaggagcccctaatggaagggtcagaaaggctctctggaggaggtaatccctgggcccagtaagagtgtaacacctagtaatccctcaaattttgaaataaactgaacaggtgaatgaagaaggaagaggattccaggctgagagcactggacgtggcaactgttcagaggagaggcagtcttcaagttctacattcattcagaaaaatgttttttgagcctacaatactgagcgcaacaaggctgtggagacccatggtgaggagcatggagttaactaaaggatgtgtcagggaagaaagacttctcaaggaggtgcctccatcagacccaaaggactcatgggggctagctgcacctcacatttcttggacatataccgttggacatgtctatcttctggaaactatggcatggacagtaaggattcagaagtgcatgaaggcaccctgcctctgcagagcagaaagatcatagacaacatttatgaatgtgcccagtgctgccaagaagagaagccggtcctctgcaggctcaagcctatctgggcctctggggaagccccacagccttggctgtgcctgcccctgccctctcacccctaccctgaccttgtcctacttcactgcctttgtctgtgttactagtggccccagtatacctgggatggacatccaggtgcccttcatccaagctcctatgtgaggggaatggacattattaaaagaacaggggcagaagtggctcatttatgacccattcactagccccagggattgaagtcttgggtactcaaagtgtctttctaccagggcaccagatcccttccatggagcaggtcatctcgggttcactgggccagggatggtctctgttccccagcccacctggctcacacacagcctcatgggtagggtcagcaaaccagatggcttgttgttggaatgtaggatgagaggcctgcttggtgacctagcattttcaccaagaagtggacgtggagaggaccagagtgatcaagggtgtatgatgtgcactacaatggtgggcaaaacaggctcctgctcttgtggaggtcacaatctagcggagaaaggatgttactagaagtacacaaattgggcccggcgcgatggctcacgcctgtaatcccagcacttttggaggccgaggcaggcggatcatttgaggttagagattcgagaccagccgggccaacatggtgaaaccccatctctacaaaaaatacaaaaattagcctggcatatggcgggtaccgtaatcctagctactcgggagactgacgggagaatcgcttgaacccaggaggcggaggttgcagtgagctcagatctcaccattgcactccagcctgggcgactgagcgagactctatctcaaaacaatcaaaacaaaaaagacctgtggactctagtagattttgaatcctgcctctgccatttcctggctatgaggtgtcttgagaaatttacttgtcactcttgcttctgatagtaaaggggatggtgcgatagattcaagatggagagataaggttaagtgttttctttggctgcaacatggagattagattagagcaaggatgtaagggagaggaagggacatagcagtatttcaggtgagagtcaaggtggctttggctagggtgtgagagtggaggtagggagaagtaggaaagtgatagttaactggatttgttaggtgagggtgaggccaagggtgacttccaggttcctgacttgtgttataagtaacacagaagaagaatggatgaacttgattcgttttccattgattgtgatatctatcatacctgcaaaaaatattttgtatatatccaatttaataataaatgcactcatgttaggaaggtcaaaaaaaaggaaaaaagaaaaataataaaaaataataaaaatccttaggataacttgaggccaggagtttgagaccagtgtgaccttgtctctgtaaaaaataaaattaaaagaaaaagaagggaaagtgatctactagtacatttaaagctttgaattccccatccttctttgcagaggtaaccactatactgaattttgattaatcttgccttagctatttattgtttttaccacataatgtatctgttcttaaatatagtgattgattttgtatggttttgaacttacctttattctgtttaggattcatcaaactttttcaatctaaatgtttagtggtcttaataaaatttggaaaaattttgggcattgttttgtcaaattttggggttctcctccaccttctatttctgacacagtctgcctatatgatggagcacttgatattgtccctcaggttactgacaccctgttcatttttttcggttcttttttttctttttttttttttttttttgagactgagtcttgctctgtcgcccaggctggagtgcaatggcacagtctcggctcaccacatcctccgtctcctgggttcaagtgattctcgtgcctcagcctcccgagtagctgggattacagctgtgtgccaccacacccagctaattttgtatttttagtagagactgtttctccatgttggtcaggctggtctcaaactcccaacctcaggtgatctgcctgccttggcctcccaaagtgctgggactataggtgtgagccaccacacctgggggttttatataatgtgaaatccttggtggattgttagaatatataagggttgtagtgaaatctgaagaaatgtttggggtttttggatgggttgggaatatgttactatttttcatatttaggttaatgaaataaaaactttagtctaaaaatttatgatctagcagattagatctggataatgaacagctgtatgatcttttctttttatagttgttgtacttcacgtaagactctagcgcactctcagatttctttggtctctcactcccccacgcccaccctgctgtgttgacaatgtagagaagttttgtttggggttgttatggattctttttattggccttagtaataacatggatgaaatcttagagataatgtgttgaaaacaagggagtttcagaagaaacttagtataagttatatagcttagtataatatttatgaagctcaaaacaaaaaaaccctgcaaattatctttgaatacatgcatttttgataaatgtatcaagggatttatatatacaaaatgcagggtagtcatcaattctagaagatagacagaaggatgggtaggggagctcaccagacttggcacatagccggggcattgcagttttctgaaaggagctatagtcaaggacttggcatccccactgtaaagcaggttcactgtgcactggttatcagcttgtctgagtccagtgagatccaatgacacccatacacacaacaagttaaataaaataggtttattacaggcagcaagggacaacaatctaggattcactgggagtgagtcccccaaggctcaggaaagctgcccagcggggatggagtcttaactgcatgtatcccacttgtaccacagctgaaggaccccagaaagcagccagtgcacagttttataccctgggtttatgtggatggttgaaggacgatggtgcttccatgcagaggcctccttatttggggtcttggctaaggctatctcccccatctgctctgcagcagtcagtaaataaggcttgatcattcctttccatctggctcattgttccgattggccatatcaacccctgattgcatgacactgggtgatgagctcttacaggtgctcattttttctacttataacttaaatatcttattcaatatatttcatatataatattacacaatatcttttttttttttttgagacaggatctcgctatgtcgcccagactggagtgaagtggtgtgaatatagctcactgcaactccaactactgagctcaagtgatcctcccagctcagcctcccaagtagctgggactacaggcatgcaccaccacacccggctaatttttgtattttttttttgtagagacagagtttcgccacgttgcccaggctagtctagaactcccaggctcaagcaatctgcccaccttggcctcccaaagtgctaggattacaggcgtgagccaccacacctgcctgaggttgaacctttgaataggctaagtactcttctaagcaaagtccatttaacctgagaccactttacactggacgtgactgagcgtcccctccttttcacctcataggaatgaagctccaaagaaacatggactcagctacagacaaaaaatgtttcattctttaccctctgagctatacacatatcaatctcaatcacctacatagatacgttttaaaagtacacatacaggtaaatacagagtaagatctagaaggattcacagcatgctgataaaagccgttaccctgagagaggggaatgaatgaagagggcttctggtttcaagttgaaagtcatccagtttttacatgaaaatgcatacctactttttttgtatattttagaaaacttatgaataatattaagcacctactagctactggcatagggaaataggggagcttgttcaagggaaacaacctcaatagggagaatcttttagctgtacacatttccacatgggctgaagggttcataatcctgggcgaatgttgtggacctttgcatgctgctttaggtgatcagatcttgcaaaattcttgctgcatattgaacacaggtagggcctttccccagtgtgccttttcttgtgtctgttgagctcatctgagcgggcaaatttccacgtacatccctctacatcgcatacatagggcttctcccctggaccagacagagagagagagacctgtcatacatcagggtgaggtagggcagggacatttaaagtgaacaagaaaacgtttttgaacaagttggagtgggagagggagagccagaagagacgggagtggtggaggtgagtgaaggaggaggggaatgagggccgcaaaagctggagagacaagaggaaaactgtgaagaagggaagaagaggaaaggaagaagaaaaaaaacaaacaggaggagagacagttattggcaggcaagttagtggggggaataaggaggatgagggaagtggggcctgggggccctgtcactacgaagtgacggtcccagtagaaatagcatcaagaacatctacctgcaagaggccaaagaaatccctccacttattcccatcaaaccagcagtcaacaccactaaaggctatagccagcctggctctggtccaggactagagcctgtccctggtccaggactagagcctgtccctaggactgctttatctacccttctgaaggtgccaaccttttctattatagaattttttgaatccctggcttaaaggaagtggcagcaatctcaaatgcttccgggcacaaatctgtagccacttgcccctcacccctgtttctgggccctcactcaccggtgtgcttgcgcatgtgggttcggaggtggcaagcctttgaataagacatcttgcagtcctcgtaagtgcagacatagggccttgaaacctcaggattcttccagaactggcagctctgtgtcttctgttttgggagttgtccttgaatcaaatgggaacttgaaaagcataggaatcctgggtatggcaatgatgagaactgatgggacatcatatatcccccataaaggctgtggtcatcagtgagcgttgtcatattgcccacctgaagagtcagcatctggtccccatagagggtctggttgccactatatgttgccatctggcctccatagagggcctggttatcagtggaggtcatattctgccccccgtagaggttctggttaccagtggaggtcatcatctgccccccatagagggcctggttaccagtggaggtcgtcacctgctccccacagagggtctggttactagtggaggtcgtcatctgctctccacagagggtctggttactagtggaggtcgtgatctgccccctgtagagggcctggttaccagtggaggtcgtcacctgctccccacagagggtctggttactagtgggggtcgtcatctgctctccacagagggtctggttactagtagaggtcgtcatctgccccccgtagagggcctggttaccagtggaggttgtcatctgctctccacagaggttctggttaccagtggaggtcatcatctgcccccagtagagggtctggttaccagtggaggtcatcatctgccccccatagagggcctggttaccagtggaggtcgtcacctgctccccacagagggtctggttactagtggaggtcgtcgtctgctctccacagagggtctggttactagtggaggtcgtcatctgccccccgtagagggcctggttaccagtggaggttgtcatctgctctccacagagggcctggttaccagtggaggtcatcacctgctcctcacagagggtctggttactagtggaggttgtcatctgctctccacagagggtctggttactagcagaggttgtcatctgccccccgtagagggcctggttaccagtggaggtcatcatctgccccccatagagggcctggttaccagtggaggtcgtcacctgctccccacaaagggtctggttactagtggaggtcgtcatctgctctccacagagggtctggttactagtggaggtcgtgatctgccccccgtagagggcctggttaccagtggaggtcgtcacctgctccccacagagggtctggttactagtgggggtcgtcatctgctctccacagagggtctggttactagtagaggttgtcatctgccccccgtagagggcctggttaccagtggaggttgtcatctgctctccacagaggttctggttaccagtggaggtcatcatctgcccccagtagagggtctggttaccagtggaggtcatcatctgccccccgtagagggcctggttaccagtggaggtcgtcacctgctccccacagagggtctggttactagtggaggtcgtcgtctgcccccagtagagggtctggttaccagtggaggtcatcatctgccccccatagaggttctggttaccagtggaggtcgtcatctgccctccacagagggcttggttaccagtggaggtcatcacttgctctccacagaggttctggttaccagtggaggtcatcatctgcccccagtagagggtctggttaccagtggaggtcatcatctgccccccatagaggttctggttaccagtggaggtcgtcatctgccctccacagagggcttggttaccagtggaggtcatcacttgctccccacagagggtctggttactagtggaggttgtcatctgctctccacagagggtctggttactagcggaggtcgtcatctgccccccatagagggcctggttaccagtggaggttgtcatctgctctccacagagggtctggttaccagtggaggtcgtcatctgtctcccgtagaaggcctggttaccactggaggtcgtcatctgctccccacagagggtctggttatcaatggaagtcatcatttgccctccatagaggtctagactggttgtcatttggcccccagagagggtctcatcgctaccggaagtcactgtatgaccatcagtgagggtctggtcactactgaaggtcacctggtccccacagagagtctggttatcactgagggtcttcatctgatctccaagcagggctggtatctgactctcattgagggtctggtcactgcttggggtgttcagctggctactttcattggagattgtcatgttgcttgcagtgatggttgtcttctggcaatcagtgggtgatgactttggggtgacagtaacatctgtcatc

SEQ ID NO: 12287 - DNA, 50525 bp, Homo sapiens
taatcccagcactttgggaggctgaggtgagtgaatcacttgaggccaggagttcacaaccagcctggccaacatggtgaaaccctgtctctactacaaatacaaaaattagctgggtgtgatggcaggcacctgtagttccagctactcaggaggctgaggcacagaattacttgagcccaggtggcagaggttgcagtgagccaagactgtaccagtgcactgtagcctgagtgacagaatgagactgtccaaaaaaaaaagaagtttaaaaagtgccttcttttactcttcaaagactgacatggctaaaagggcccatcacacagtcataggggtcctggccccaggcagcagctgcactctctggactctatggctgcgccggtggaggtgctatgtctgccatactcgtgacctgtggccccatcgcacctcacagaaccaaagaaaccatgccaaaacccttctcaccccttcctcatctgctggcctttggctcctgccttcttgygctgtgccagaggtttctgatctccctcaaggaaatccagtttatcagagaagcctgtaagtgaagaagtagttttgatcagcaccattgtattttaagaataaaagtttaaaccaccatatgaggctgttatttgctacactgattttaagagtcacatcctgctctccaacaccattcccaaaactttgatccgacaggtccacatcaaccaagaaggctccaaagcactaagtgttcaaatcaactctaaagtacctgctaccctcgttcccctattagagatgtaccaacctttctgatatttcttaatagcattcatcatatgggctttctcctgctgcctcttctgaagaacctccgtttgcacctgtgatatgaacacaaggaccgttacagccattccataccattactccagtgtctacattgtcttaatagcaacaccatgattaataccactaccctctgacatttactacgtgccaaaaactgtgttagggactctaagtatattctcagatctaggtatattcttcatagatgaagatatatctgtctcataacaatccagtgaagttgaaatttgtgttatcccctaaactgaagcacagggaagttaacttgcccaagtcgcacagtgaaaaaatgcacagccaagatgacccaggctgtttgactccaaagccagcactcaccctattatacaatcctgcctacaaaactgaagtaaatcatgtttaagactacatcgatttttcgcatcacatttggacagattaattatctaactcactgttactaggcatgaaagtaccaaaaggaagagaaaaaaacaatgtccccaggtaaagaaaagaaaaaagtttgaaggataaaaggagacactttataatactctaacagagggtttctcaatcttgatactgctacagtgtggagagaataattctttgctggggggtaggggcctgtcctacactgtaggatatttagcggcacccctgccctctacctactagatgccagtagtaccctccctcccaaatttgacaactaaaaatatctccaggcagtcacagaaaactcttggggagcaaattcacccccagttaacaaactcttccccagtgtttccttaaattaggaacagtgaactaataggcccaagtgagtttgtctttgcttttggtaactttggctatgttaaattaattactggtgtctttgagagaatctcagccatccacctccagatcaaagaaataataaatccgcagcaggccttttgtagaggacaggatcccagcctattcctactttgctgagaatgtatcagtgaaatgactccaaacgtggacaagagttctgcagcccagatcccaagtgcttatgtccaaatgttgacgaagtcttaacacccacrccaatcttcctcacattcatttcttcccacaatcctaactttaaaatctgtcatcttctttcttagatgaccatgaaataaaaaaggaaaaccaagaaaagttttagggtatgcctgatctggtgttacattagaactcagacattcatagttcaaacacgcaggcaatctttcagattggatgacaatcattatgataatttcttcaggtacgtgattatcacatagatcagtgaatcccaaaccaggatgcatttcagaatcacctggaaagcttttggggaagaggggaaaacaggcacagattcctggggattctgaagtctagaattctgttttgaaaaatttcccctggtgattttgctataaggtcaggtttggaaaccactcatctggacccagtgtacagatgtgaaaactaacgcccagagaggtgattggctcacctgcagtcaccatactactcctggggaaccactcatgtccaggcaagattgtgctcatgaataccagcacatacactgagagacggtaaatacatgatcaacacacagttccgttcagttcaggggaccaagtcagaccacggcaatctcatctaacacacactccgcctcttcctgttccctgcacacttttcttctcaccttcttcccgtatttcctaagtgctcgcagttgcttagctttttcagacctctccatggcagcctgtttagtctgcagcttctgtcgaatctacaacacaaaatgctgtcagttcatgtcatttgaatctggaatgaccactacttaggattcgctagagcagggaacagatattccctgttctttaaactgcggaacttataaatcatcagttccaacccctgaggacaatggggcccacaggctgagcactttaccaaaagtgccagagtgaagccagagattgaaagtcaccttcccgctcccagtgtgctgtctgtttcattatacaaactgcctatttgtagcccaggaaagaagacaaacttctccccatttctactgtcagtagactgaggctggaaaccagtatgcggcctcagtgtccttttctagtataccacatacacaataaaaacccaggcagataccaggtgcctagccttttcagtcaaacatacacattttagttaaaggatgagaagttgtcagtgagaatttgtacagagttcacagtaagaaggtgaactactaccacgacaaaagctccctaaaatccagcttgagaccccagggtactatttaaatatacttatccctcagtatccatagaggattagttctaggacccactacagatatcaaaatccacagatgctcaagtcctttatataaaaatggtgcagcatttgcatataacctacactcgcctccagtatcctttaaagtcagrggacctcaactcccaggccacagaccgctacgaacccactatgaatctgtggcctgttaggaaccaggccgcacagcagaaagtgagtgacaggcaagcaagcattaccacctgagctccacctcctgtcagattggtggtggcgttaaattctcataggagtgcgaactctactgtgaactatgcatggaactatgcatgcaaaggatctaggttgcctgctccttatgagaatctaatgcctgatgatctgagatggaacggtttcatcccaaaactatcccctccccaagttcatgaaaaaattgtcatccacgaaactagtctctagtgccagaccgcttctttaaatagtctctagattacttataataccgaatacaatgctatgcatcacctcattctcatggattcaatgtagttctcggcacacggaaaattcagttttccttttgcratattttcaaatttttttccccaatatttttgatccaaggttggttgaatccacagatgctgaacccatggctatggagggctgaatgtatgttggattacatgctggcaatcccttcttccaaagttaaatgaggtccaagttctacccaactctaaattgtactatatctgaaccatctaagaatccctcattttacagaggagaaaactgaggcccagagaaaagtaattgtctacaagttctagcactgacagtggcaagggcacaagaatgctgtcctctctgcacaccatgtcatgaccatgccagctaggaaatgcactgggccatcttcacctyggggaccacacttcacacagcactgttcctctccttaattgctgattttagaaaaaatgtcatttttatatgcatctaattggtggtaactggcatgactctgaagtagccaatctatggaagaggtaataattgtcctctgacaactggctccccgttattgggctcatagctatctttctaagccagctgaatatgcttaagtacaaagttttgactttccaraggaaaacttctatttcttaccttctgcatctgcagatcagatttggccatttccgcaaaataatcagtgggtcgcttsgtagggactttgagctgatggaggcggggtaagactgcaagcactgcggcctgggcttggcgatagctgagaatcgtaggacaaaatgtgtaatgaggtgaaggaggaggccttacgttccttttcaccgccaatcatgagttatccaagctcagaaggactctcaaaatctgacctccattagcaagaacaaacaaacaaaaactgtctcactgatttagtatctaaaagaaatgtagccgtatactagtttttaaaaaggggaggggtgttgctaaaaatagtttaagagaatgactactctaaaggtacccattaacacaaacgaatgtcgattatggattcttatgtaattactaaagcaattccacacaagaacatcccataagcaatgtttgtttgtttgttttcctaataactgaagcatgcacaaaaagttttaacatgaatatttcaaattagcccataaagtggattttggatcgtgacygtggaccaaagagctcttctctcaaacaggaagaatctcctagctattcttagtcaaaagaagccgctctctctactcctaggcttattctgagtgcagacttactaatttcccctctttcccactctcctgcacaaggatcctcaacttctccaacatttgaaaacaaacatacaaactcatctctcgctggaagtcgtcttctggatcaacagctttctggtccttgttctgaggtgctggcgcctcagatccaccgatctccggtaccggacccagtgtcacatcgagcctttcaacccattccagatcccgcttgaattctgccaaacattgcttcaggccattctaggaaatccagacactgagctcacaagaagggaactctgagtttgtctttcccaagcacaggctgttaggcgaagggacaaagtgctaatccccaatacccagacaggtaattgaccctcttggcgaggcgcagggtgcatctttcctgggacaagaatcggtctcccaagcccaacagcgcctgaagcgcatcccatgtccgagtacccccgaccctgtgcccrcgctcaccacgtcgttcacggccttcttcggcccctctagcacgacattgaggcctggcttcagaagccctcgggaaaacgcatcctgcaactgcaggacacaatcacggtcactcccaggggtgtaaggccccctctcccacgcccagccccacgagctcggctgacacctacctctctgtctgtgacaagggattcatcggattccgactccgaatccgagagcgggggagtgtccatctcgccgcacgcacgtcccacacctacaggaagaaacggggtatcccgagacccaagcggctagcagagggcggccctggccgctgctgcctgccttcagccccctactcccacgccgtggctccacgtgccaccgaatcgcyccagcgccagcaactcacagctactgctcaacttttgattgggacttccgcttccggcggcaaaccatacttccggtttgtcgttgctataggaaccgctacggcgtttgaaagtgtccgggttgcttaggatccctacaggtagcgcctctggatacatgcgtggtctgctgacccagagagaaacgaaaggtgggagggggtacctgggggtcgccagaaggagctggtagcagtgagggtacaaaggaaaaggcagaaaaaggagccgcgggggtggggtggcgcggaggaggaccccgggggaggggaaggggaggggagggacaaggggaggggaaaggggagggacaaggggaggagaaaggggagagacaaggggaggagcaaagggcggggagggcgagtccgggccgggggcggggtcggagcggggcggtgctctccactctgaagcgctgccttggtcttcagcagaactgtttggcgggagatcatgtcagccgtkgtagctcagacgctgcatgtwtttggtcttcgatcccacgtggccaacaatatcttctacttcgatgaacagatcattatatttccttcaggaaatcactgtgtgaagtacaatgtggatcagaaatggcaaaaattcattccaggtaaaactttttccatcctgacatatacaggaatggtatgtgccacatataaccccataatcccagcatgatgattggaaagaaagattttggccaatttgaatatatatgcagtattataaatgtagaggaaataaatggcgacttgtattatgaaactagattaatcagtcacgcatatgtagttaaaatcacatataaaatgttaatttaaaagtacttktttcactgtaatttcatgaaaatatgttaagaacccctcttttggtgtcttcaatatcactgcctttgtyatcaccagagccactttttgagttgtctaacagttttcctgagcacaccaccttcattatatcaccgtttgaatccaagtrtgatgaagacactgtaaactttatcccaagtcgcaaataaccatttgtatagcattacagcccttatttttgttcacagtggtcctgttaatgatattcattatttcaacaaccgaatccattttcccattctttgttgcattgacaccttttattgtgacatatacatacaaaagaatgtaccctacatatatgtcatatttaaagaattacaatagaatgtagatctgtgaacccagccacccagcataggaarcagaatattaccagttctagtgcttctccctgtattctgtgtcttgctgcatcagttcaatgtcatgcttttgagattcacacatctcgatacatatagccaagttcattttattgctatgtagtgttccatcatatgaatataatgtctcaaatatatgtattcactctaatattgagggacatttgggaaataacaatcatttgctattacaaactatactactataaacattcttgcatgcatatacattcatctatttgtgcagattctctagggcacacagccaggactaaaattactgagcaatatgatagtaccaatttacactcccactagaagtgcataagagttcttattcctcagcaaccctgccaacccttggtattgtccaacttcgtaattttttgctaacccaatggttgagaaaaggaattgtggttttcgtttgcattttgctatcattaatgatgatgagtatctgtttatgggctattcctatttagtcgtatgttaaatgccttgttcaagtcttttacttgttttttacagtttgttgtgcaggatatttttgggcaattttattgatttacatgcacaatttatatattctgtatatcaataatttgtcagatatatatatatgtcttgcaaataatttctttcagtttggggcatttttctcccatcttacaagtatcttttgatggacaaaaattattagttttaataaagtcaaatttatcaaccacataatattctgttggaataagctgtattaaatacagttgactttaatttattgatgtttatttccagcatatttgctaaattattattaattctaatgatttgtctatagattatgcagagacttctacatagactatcatgttatctacaaataacgatgactttcttcctttttcttgtgttacctgtgctggtaagcacctccagacagtgttgattaggggcaataaaaatggacatctggccaggtgtggtggctcatgcctgtaattccagcactttgggaggccaaggtgggcagatcacgaggtcaagagatcaagaccatcctcgccaacatagtgaaaccccgtctctactaaaaatacaaaaatcagctgggcgtggtggcacgtgcctgtagtcccagctactcgggaggctgaagcaggagaattgcttgaacccgggaggcagaggttgtggtgagccaagatcgcaccactgcactccagcctgggaaaccaagcaagaccctgtctcaaaaacaaaaataaaaaagatcatatgactttccaatataaattaaattatggttttctacagacaacattaatttatatttgctctcatacttaccaaactttttcccaccattactctttacaaatcagatattccagctgggatcattttccttctgyatttactgataatgtattaataaattctcccagtttttgtctgaaaatgactttattttatcctcatttctgaaagatagtttcaacaggtgtgaaatttttatcagcatattatagatcatattccattgtgtttttttggcttctcttttgttgctgtggttaagaaattagctatcagcatcgtctttctgtagatgatctttttttctggatgtttaatatcttctctgtctatggtgtgtgtgtgtatgtatctatacacatacaccatatacatatatacgtataaaatacacaccatatatacacacaccatatactatatgtacatgtatatatacatagtatatatacatacatatagatacagacacacacatcagtatagtttttattttcattttttatcctcctagggattatttgagattcctggatctaaggacaggtatcttttttgttctgttatctccttctggaactccaaaccatctcaactccatccttccagttttttattttattttattttatttatttattttttaagaaaccaggtctcactctgttgcccaggctggagtgcactggcacaatcatagctcacagcagtctcaaactcctgggctcaagccatcctccccaccttaacctcctgaatagctgggaatacaggcatgcaccaccttgaccagctaattgtttttatggagatggggtctggctatgttgctgaggctggtcttgaactcctgaactcaactcatcctcccacctcagcctcccaagtagctgggattacaggtgcaagccaccacacctgacgttcatgtttttgggtttttttttttttgaactcttatttggattttttataccttactctctctgtgttgcattctagataattactttagatgtatctcgtagttcattgcttctcttttctgctgcatctaacttaatgtttaatgtatccattgagattttactttcagttattgtgctcatattcttacacttcttactgtatcacttctcttctgctcctaactccatcttatatcaccaggggccttgtacacatgtgggtggatccttgcagcccatatgttcaaattctacccatatattctataagcaaccaccctgtgcccatccttcaggcccaggttgagtagagacagcctgggaagaaacccccaatgttggtcttgtcagcaggctcaagactatctgagcagggaactccagagtcctgmgtacctgcaacgtgatctagaagaggcaggacaaactccaggcagccactgtatcccacttaatggtaaggggtacagccagagaaagactccgggatgctctaaaatttgaggcccaagggaggatctccactgaccaagtctaagggtattaccggtgaagggaaaaatataaaggtcatgacattgggagacctggctttgatctggctccccattttataggctcacagagcctcagtctcctcatctgtaagatgcagatgatgctcagcttgttcagctcagagtcatgatgaggctcaacatattcatttgttcactcaacaaaaatgtattaagtaccccctgtgttccaggcacaaaatagacaygcacatatgcacataaaatgctgtcctcacagtgcttccattctaagagggsagagtgacaaacaaaataaaaagaagtacagtctacatgctagatagtgatagatgctaataagaacaaacraagyatggaaagtgaagccgttgggggagtaagaagttgtagatagggaggctggggagggctcactgagcagtgatttttgagtgaagactgaaggaaaggaaggagctggctgtgctgatgtgggagggcagggggagtagccgagagactagcaaaggctcagagttaggagggtgcttattgtgttggaggaatagctgggaggccagtgtggctggagtggtaagaaccggggggtgaggagcaagaggggaggcaaagaaagaatggggagcaacaccacagaggggcttgcagttcatgagctcttactcagagtcaaatgagaagccataaaggggtgcgttctgagtggcaacatgatctgtgtttcctcaggttcattctggctgctgtacagaggacagatttaaggaggagaaagaaaggaagcagggagaacagctgagggatgattgctgtaattcaggtgagagataatggcacttggagcaggtagaggcaggcgacagggtggtgtgaagagatcaataatggatatgctttgacagatttcttcatagacaccatgtggggtggaagcaggaagaagcaaggttttgggcctgagcatggaaagcatggagttgctgttgattgtgatagaaagggctaaagaaggagcaggttggttttggacctgttaagattgatgtgcctgctagatattttcatggagatgctcagtaagcaggttgatttcaggtctggatttaagggagggaagtccaggctaggaaaggaatttgagggtcatcagcctagaggtgaaatgtaaagcccttagagtagatgagacttccctagggcagtggtccccaacctttctggcatcggggtaggtttcatgaaaaacagtttttccatggacaggatggagagggtatgggggatggtttcaggatgaaactgttctgccccagatcatcaggcattagttaagattctcacagagagcacacaatctagatccctcgcatgcacagttcacaacagggtttgtgctgctatgagaatctaatgccgccactgatctgagctcaggcggtaatgcttgctcacctcctgctgtgtagcccagcaccgtgggttggggacccctgccctagggcatgaatatatttacaaaagagaagcagctgaaagagtgagctctgagcactcctgcatttagtgctggggaaatggggaagaatcagcaaaagaggctttggaggagtggccaaaaagatcacaggatatctatgtgagaggtgaaggattccctatttaataaatggtgctgggaaaactggctagccatatgtagaaagctgaaaccggatcccttccttacaccttatacaaaaattaattcaagatggattaaagacttaagtgttagacctgaaaccataaaaaccctagaagaaaacctaggcaataccattcaggatataggcatgggcaaggacttcatgtctgaaacaccaaaagcaatggcgacaaaagccaaaattgacaaatgggatctaattaaactaaagagcttctgcacagcaaaagaaactaccattagagtgaacaggcaacctacagaatgggagaaaatttttgcaatctactcatctgacaaagggctaatatccagaatctacaaagaacttaaacaaatttacaagaaaaaaacaaccccatcaaaaagtgggcaaaggatatgaacagacacttctcaaaagaagacatttatgcagccaaccgacacatgaaaaaatgctcatcattactggccatcagagaaatgcaaatcaaaaccacaatgagataccatctcacaccagttagaatggcgatcattaaaaagtcaggaaacaacaggtactggagagaatgtagagaaataagaacacttttacattgttggtgggactgtaaactagttcaagcattgtggaagacagtgtggtgattcctcagggatctagaactagaaataccatttgacccagccatgccattacatggtatatacccaaaggattataaatcatgctgctataaagacacatgcacacgtatgtttattgtggcactgttcacaatagcaaagacttggaaccaacccaaatgtccatcaacgatagactggattaagaaaatgtggcacatatacaccatggaatactatgcagccataaaaaaggatgagttcatgccctttatagggatacagatgaagctggaaaccatcattctgagcaaactrtcgcaaggacaaaaaaccaaacaccgcatgttctcactcataggtgagaattgaacaatgagaacacttggacacaggaaagggaacatcacacaccrgggcctgttgtggggtgcrgggagggggagggatagcattaggagatatacctaatgtaaatgactagttaatgggtgcagcacaccaacatggcacatgtatacatatgtaacaaacctgtacattgtgcacatgtaccctagaacttaaagtataataataataataaaaggatatctatgtgagaggcgaaaatgttttaaggaggagaggyraggcatcagctgggtcgaaacaatgcaaaagcattttacaaactctaaaaccagtcaacatatatcaagaacatactaagttccagacactggtgattgaatgaatgaatgaatgagcaagaatggcctctgccctccaggagctctcagtattgtagtggaggcaggttgtgtaattcaaatgagtaggactgtgcaaatgagctggacagatgctataccaggtaggaacctggcacaaaagcacaataggagggagtgagcagtgttcctttgcctcatctaggctattacatactcctagttttaactttcccttatgctttttacctcaaatctgtattttcagcctcaacccctcccgccagctttagaaccatgtccacctgctggacctccrtacccaactgttccacagagtgtacctcacacacaatatatctgagattgagtttatcttttcctttcttctccctctctttgggaaatgcaatcagggtcacattattgttttcgagggctctaggtacttttgatttcatggccccctccttcattaaaaaatgtttaaaaatatatttataggccaggcgtggtggctcatgcctgtaatcccaacactctgggaggccgaggtgggcggatcacctgaagttgggagttcgagaccagcctgaccaacatggagaaaccctgtctctactaaaaatacaaaattagccaggcatggtggcacatgmctgtaatccctgctactcgggaggctgaggcaggagaatcacctgaacctgggaggtggtggttgtggtgagccgagattgagccattgcactccagcctgggcgacaagagtgaaactctatctcaaaaaatatatatattttatatatatatatataaaatatatatacacacatatattatttaaaaatatatgcagtaatatactttatgactgtattggtataaagaggaatataatctaggctggattcaccattatatattcatgttttttctgattttcaaataaatactaaaacattttcctaggtcctcaaaagtattgtgggtcctgggcactgtgtctagtggataagtggatggtggatacaggcccagggcagggagcgtgagtgaggcaagggaggatgagctagagagtgatgtgaygggtccccatgtgttgggccctcatgctgctgcttcacaacacgccaaggagagatgcagcaagttgctcagcaggcgtgcatgcccagcccatgggaattctctggaagggatgcagagagtagctgtggctcagagaagatcccaggttctaggtcactgagagccttgcacaaaagtttggacttcacctgggaggctgctgaaaaattttaggaagggtgagtgcaagggaggctgaggaatccagtagttggcatcccaacctctggagtagaggaggagtgatgagctagccactcagggaataaagacctctatggtctgaccctattccacccctttaggcccatctttggtcaccccatctcacatgcaatgctccagcaacacccactgcttgcagttcccgcactatgctgtaccctttgtcacatccaccccgtggctcaagctcttcctgctatctaccacccagyccccatctcacctcaccccctgccctccttcaggaaggtttccctgacttctcctcccacctcatcctccaaggtgcctgccctagtcattttcttttggggacagtctcgctctgtctcccgggctggagtacagtggcatgatctcagctcactgcaatctccacctcccaggttcaagtgattctcctgcctcagcctcccgagtagctgggattacaggtgcctgccaccacacccggctaatttttttatttttagtagagatggggtttcaccatgttggccaggctggtcttgaactccccatttcaagtcatctgcccacctcggccccctgaagtgccgggattacaggcgtgagccaccacacctggcccctagtcattttcataatacccaaacacagctatgccaaggccgcctttcttctttgtgtccaccactgtccactccagtgcccaccacagtgcctggttcctgttgaaccctggtgaaagtgtgatctaccctgattatttcctttttcctctgtttgcaggctcagagaagagtcagggcatgttggccttgtccatcagtcccaatcggcggtacctcgctatctctgagactgtgcaagaaaaacctgccatcaccatttatgaattgtcatccatcccttgccggaagcgcaaagttcttaataattttgacttccaagttcagaaatttattagcatggctttttctccagactccaaatacctattggctcagacgtcacctccagagtcaaatcttgtctactggctgtgggaaaaacagaaagtaatggccattgttagaatcgacactcagaacaaccctgtctaccaggtacctagtagtgtgacaagtatcgtgaaaattataaaaaatagaactactttttattgaatgttttctgtgtaccacagttctaatttcctccatgcattttaaaatttattcttacaacaaccgtataaggtatgcacaatcattatccccattttacagatgagagaactgaggatccaagaggttaagtaactcactcaagatcacagaggtagtgaatagcagagctaggagttccccaactccagctcctgtcttctctactctggcccagaactgctttctggtcacaggtttggcccagaagtggattaataaaacttgctttctctccctggtcctagcctctttttccagcagcattgccgggcagtaggaagatttccgaaatgtgatgtaacatggtaggtctttaggaagctgttgctgaagttgcagttatgtaaggaacagaaccttctattgtgtctcgagggcaaaaggaagaagacccctcaggaacctgattgatggcttaggcagggggtcccaaggaggtttgatcttggttcactcaccctagtctaggatctagcactcaattccacaagttcaacgactcagttgtgttcatgttcagagattctagctaatcagtgtctctggcatagactcaattattcaactcacaagatactgatgtgtaaaccagcatatcacaaccagaatgctcacatcatttatccagtgtattcccttcctagtaatagagaagttgagaggtgaaattataatagtaatcagaaggctgctgggtgattattccagaatcagaccaaaggcaggtagaaccagaagggtatttcaaccaggccacagtgaggcctgatgaagsacctcctgctctgactagtagattcagcaaccatttattggatgcccatgatgaatccagcactgggaaaacagatgaaaaagtcacagcccctcaagttgctcactatatagtcaggacagcaggttgactgcctattactgtacaggtagtccccaacttactatggttcaacttaaaatattcgtctttacaatggtacaagagtgatatgcactcaggagaaagagaccaagtaatacgctttcatgatgcagggcagcagctgcagccacagcccccggtcagccgctcaatcactagggtaacaaccaagatactctacagtgtggtgctgtgtggccacatggctttgcccattttcaacttatggtgttttcamcttatgatgggtttatcaggacatgatcccattgtaagtagaggagcaggtgtacattgggataagagctgtgattraaggatgttcagttggtaggagaccacatagcatcccctgacatgtggtttctttcctcttggacagggctatgtaaacctatcagaccctctttttctgtgtttccagctgagctttattccattttgttggcactgggtgtggctcttgtcaaaagctgttcattctgctctttggcctttgtagatttcctagtttgactcctagttggactcatatccctataaatataatggattatagatgtgtgcccttatcaaatgcagcataaagttacatgattttgtgatgttttggagatattctgagcagcctgaaataaatattaatttgtaaaatgggaaataattccatcaagaatagtttcataaatttttttcttcaattctctcacattttacaggtgagcttcagtccacaggataacactcaggtgtgtgtcactggaaatgggatgtttaagcttctccgttttkctgagggaaccctgaagcaaaccagctttcagaggggagaaccccaaaactatctagcycacacctgggtggctgatgacaagattgtcgttggcactgacacaggcaaactcttcctctttgaatctggagatcagcgttgggagaccagcataatggtcaaggaacctaccratggctcaaagagcctggatgtcattcaggaatcagagaggtaatggtgcttcctgggctggtgctcccacattcattgtactgacagcattatgcagaagacagcactctttagaaaccactcataacccctctaccrtaaaagtcaactatgcccattttccctcttcctctctagttttcgtctatatttaagcacagatttaacagttataaccatagactaaatacaattctttttattttttatacctaacctcattttataaacattatagtattactggtcttcaaaactatagtttttagaaaatatattttccagtggctaatttaatgaattgattcatgtccaccaagcccttgtagtatgcaaaaggcatctcttgctagatgctggggacacaagtcctcaaggaacttataattcagcaggaggcgacagaccaacaagtgcaaggaaatgttttaggtaaatctgacagaggataggggtaaagtgcaatctcaggaaggagtggttattgaccattataatagagatgccacgttatctctatgacaaccagtaaaaatcatatctcctgtgtattggaatgtaccgttacatgcaccagacactgctttaaacattttataaatattcccaatttgattcttaccctgtatagttcatactattatcgtgcccattttgtagacaaggaaactgaggatcaaagaggtaagtgaactacccaagatcattccgctgataagtggcaggctcaggattcaaacccagatctctctgatgccagagcctgggccctcaaccccaatgacatcctgtagattcttcttcctcagtaaccttcaatccacccattttcactaccatccccccrtgccaatggcatatcctttttttttttttttttttttttttttttgtgagtatgtaggagcttcctgaaaagtctctataaccttctccaggagctgtgttcacagtccttcagctctggggtccaggcctcccagaacaaagcccagacttcttggtttggcccaagcatacctgcgactgttttcctctacaactctcgcctctgtctactccacacgccccaagcactctcttgcttctaggcttggccatgtgcagtttgtgtacggttcccaagccaaagggtagtatttgactgtggaaaaggggatcattgggtggtttctgtcacacccagtgacagycttctttctcctccccagcagaattcatctcctcaagattgtctctataaattatgtatgctgtttttttgtttccagcctgattgaatttccaccagtcagttctccactcccttcctatgaacagatggtggcggccagtagccatagccagatgtccatgccccaggtgtttgccattgcagcctattcaaagggatttgcctgttctgctgggccagggagagttctgctgtttgagaagatggaagaaaaggatttttaccgtgagagcagagaaatcagggtaaggcgggaagaaaaaaaagaagtaaaatgggggtcctattggcatttgttccccagcagcagttctctgagaaggcatctgatggggagggatagggcaggattgctgagcagaaatggtgaaatggtgactcgagatgtctgtcctgagagagattttaggatgaggtgaacagaattagagtttaaaaataggaaaatcgaccagcatattggcttatgcctgtaatcccagcactttgggaggccaaggtgggtgggtctcttgaactcaggagttctagaccagcctgggcaacatggtgaaaccccatctctacaaaaaaaaaaaaaaaaaaattatgaggtcaggagtttgagaccagcctggccaacatggtgaaaccccgtctgtactaaaaatacaaaaattagccaagcgtggcagtgtgtgcctgtagtcccagctacttgagaggctgaggcaggagaatagcttgaacccaggaagcagaggttgcagtgagccaagatcgctccactgcactccagcctggtcgacagattgagactctgtctcaaaaaaagaaaaaaaaatacaaaatacaaaaagtagccaggtatggtggcacgtgtctgtaatcccagctagaattgcttgaacccgggcagcagaggttgtagaaagccaagatcacaccactgcactccagcctgggtgacagagcaagactctgtctcaaaaaaaaaaaaaattagccagatgtggtggtgtgcacctgtagtcccagttacttgagaggctgaggtgagaggatggcttgagcctggcaggtggaagttgcattgagccaagatcatgccactgtattccagtctgggtgacagagccagaccctctctcaaaaaaacaaagaataggaggatcccaggaagcagcctggtctgggagtctgtaagctaaagttatccaagaaaactctgaaagcctaggccgggcgcagttgctcacgcctgtaatcccagcactttggaaggccgaggcgggcggatcatgaggtcaggagatcgagaccatcctggctaacgcggtgaaaccctgtctctactaaaaatacaaaaaattagccaagcgcggtggtgggcggctgttgtcccagctactcgggaggctgaggcaggagaatggcgtgaacccgggaggcggagcttgcagtgagctgagatagtgccactgcactctggcctgggcaaaagagcgagactccgtctcaaaaaaaaaaaaaaaaaaaaaagaaaactctgaaagcctaaggccacaatgacaacgtggggacattactgatagctgttttgcatcttgggcagattcctgtggacccgcagagcaatgatccaagtcagtctgacaaacaggacgttctctgcctgtscttcagcccctcagaggaaactctggttgccagcaccagtaagaaccaactctacagcatcaccatgtccctgacagagatcagcaaggtgagtctttccagcaatggtccttccagaccaggacctatctgcctgctgggggactagtcaccatgtgggcaaattttaatccaaataagttagcataaactcatgcatccccttaatacagagcaaaacaaaattctaattttaagatattcacatagaagcatgctgatagactcagtggggctgtgattgctacagtaactttggaggacagacgtattggcattgtccatcaaatttaaatctcacatatccttttacccagaaattgcattttaaggcatttaatctattgctatatttgctcatgtacacaaatatgtatatataaaaatgtttctttttcctttttactgttttggaataacaaagaaagctagtataaatacactgcagacattacaacaaaaaagcactattaaagatagagatcatattgtacttaaaatggctcagtaccaataagatattacaattttaagtttgcatgtacctaataccatagattcaaaatatataaagcaaatctgggcagaacaaggaaaatagaccatctacaatcatagtagaagatttaacatatctttctcagtaatggtcctttttttaataacaacttaattgagttatgattcacatacaaattgcctattcaaagtatacaattcagtggtctttagtatattcaaaaagttrtgcaaccatttatcatagacagccttaggacatttttatcacctcaaaaaaaaaaaaagcgcataccctttagctattattattcctccatcctcccaattatcacccctccccaccccagccctaggccactacttacctacttcatgtctctatatatagatttgcctattctggacatttcattcaaatggaatcataaaacgtgtggacttttatgactggcttctttgacttagcataatgggttttgttgttgttttgagacagggtcttgctctgtcacccaggtgggagtgcagtggtgtgatcatggctcactgcagccttgacctcctgggctccagcaatcttcccacctcagcttcccaagtagttaggactacaggtgcacgccaccacacccagctagcttttgtatttttagtagagacagggttttgccatgtttcccaggctggtcttgagttcctgagctcaagcagtccacccgcctcatcctcccaaagtgttgggattacaagtgtgagccgccacacctggccagcatgttttcaatgttcatccatgttgtagcaggtatcagtacttcattccttttttatggccaaataatatttaattatatggatatactatattttattcatcaaatttgtatatttgggttttttctaccttttggcttttatgaataatgcaactagtttttatgtggatgggttttcatttctcttcctagaagtggaattgctgagtcatatggtaacttcatgttcaattatttgaggaactgccatactgttttccaaagttgctggaccrttttatattcccataagcagtatatgagcattctgatttctctatattcttgccaaaacttgttattatcttttttattatagccatcttagtgggtaagaagtggtatctcattgtggttttgatttgcatttacctggtgattaatgatgaacgtcttttcaagaatttctaattcttctttgaagaaatrtctattcagattttttgcycatttaaaaaattgagtcatatgtctttttattattgagttgtaacagttatttataattctagatataagtcctttatcagatatgtgatttgcaaatactatgtcccattctgtgggttgtcttttcacttttttgatgttgtcttttgatgaagttttcaattttgatgarattgaatttatctatttttcttttgttggttgtgctttccrtgttatatttaagaagccaatgcctgaggccatgaagatttacctctgtatttcttctaagagtttcatagtgctagctcttacatctaggtctttaatccgttttgaattcatttgagtatatgggatggtataggggtccaacttcattctttggcatgtagatatccagtcgtcacagcatcatttgttgaaaaggctagtctttctccattgagtagtcttggcatcttgttggaaatcagttgacacatgggtttgtttcaggacttccaattctgttccattgatctgtctatctttatgccagtaccacactgtcttgattactgctgctttgtagcaaactttaaaattgggaattgtgaatcttgcaaatgtagtctactttatcaagattgttttgggtagtctgtgtcccttgcaattccatatggattttacagtcagcttttcaatttctacaagaagccatctgggatcctcaccgggattgcattgaatttatagatcaatgtggggagtgttgccatcttaacaatactaagccttccaattcttgagcatgagatattttccatttatttagattgtctttaatttgtttcaagaacattttgtaattttcagagtataacttttgcacttcttttgttaaatatattctgaaaaattttcttcatgatgctattgtaaattgaattattttcctaatttcatttttggattgttcattctaagtgtatagaaatacaattaatttttgcatactgatcttgtctcctgcaaccttgccaaactcatttattagttccagtagtttttgtgttaggttattctggcattgctataaacgagtacctgagactgagtaatttataaagaaaggaagtttaattggctcatggttctgcagggtgtacaggaagcatggtgctggcatctgcttctggtaagggttcaggaagcttacaatcatagtggaagatgaaggggtagtatgcacatcacatggtgagagcaggagcaagagagggaggtgagagatgccacacactgttaaacaaccagatctctcatgaactcactcatcaccaaggggatgtcactaaaccattcataaaccattcatgagggatatgcccccaatgatccaagcacctcccaccaggtcccaccttcaacactggggttacatttcaacatgagatttggaggagacaaatatccaaattttatcagcgtttttagtgaattccttaggattttctatatataagatcatgacatctgcaatagaggtagttttagtcttcctttccaatctgtgaatgcctgttacttattttccttgcctagttgccatggctagaacctctagtatcatgtcaaatatcagtgatgagwgcagatccttgtcttgttcctaatcttagggagaaagcatcyagtctcttttttttttttttttttttttgagacggagtctcgctctgtcacccaggctggagggcartggcgcaatcttggctcactgcaagctccgcctaccgggttcatgccattctcctgcctcagactcccgagtagctggagctacaggcgcccgccaccatgcccagctaattttttgtatttttartagagacggggtttcaccatgttagccaggatggtctcgatctcctgatcttgtgatccgcctgcctcggcctcctaaagtgctgggattacaggcgtgagtcaccgtgcccggctgcatccagtctttaacgattaagtttgatgctgtctgtaggtttttttgaagatactgtttatcaggctgaaaaagttcccttctattcctagtttgttgaatgtttttatcatgaacggctgttggattttgtcacattttttttttcctgtgtctattgaaattattgtgtgagttttcgttttttactttattaatatagtatattatactaagtgattttcagatgttaaaccayccttgcattcttgggataaaatccacttggccatagtatataatcattttcatattagtatattcaatttactagtattttgttgaggatttttgtatccatatttataagaaatagtgatctgtagttttcttgtgatgtctttgactgcttttgcatcagggcctcatagaatgagttgggaagtgttccagcctcttctaattttttgaaggtttgtgaagaattggtattaattcttctttaagtgtttggtagaattcaccagtgaagtcatctgggcctgggcttttctttgtggaaagtttctttttctaattaatctctttacctattttcatctatttagattgtctatttcttcttgagccagtttcagtttttgtgtcattctaggaatttgtctatttgtctaatatagtggcatgcaattgttcatagtattcctttatgatcctttttatttctgtaagcttaatggtaatattccctcttttggccgggcgtggtggctcacgcctgcaatcccagcactttgggaggctgagccaggcaggtcacgagctcaggagattgagaccatcctggctaacacagtgaaaccccgtctctactaaaaatacaaaaaattagccaggcatggtggtgggcgcctgtggtcccagctactcgggaggctgaggcaggagaatggcgtgaacccgggaagcagggcttgcagtgagccaagatcgtgccactgcactccagcatgggtgacaaagcaagactccgtctcaaaaaaaaaaaaaaaaaaaagtaatattccctccttcatttctgattgtattaatatgattttcctcctccccccatttttttttatctctttaaagaatcagctttcggtttcattgatttttctctattgctttgctattctctatttcattaatgttcactctaatctttactgtttccttcctttggcttgctttaggtttaggttgctcttttttttttttccagtgtcttaaggtagaagattaggttatttatttaagatctttcttttttgaaaatgtaggtatttgcagccagaaaaaaactcctcttaatattgcttaccataaattttgctatgttatgtctttattttcattaatctcaaatattttggaatttctcttttgatttctttttgacccattggttttaggagtgtgttgttaaatttctgcttatttgtgagttttccagtttctttctgtttgttattaattattaatttaattacactgtgcttagagaatatattttgtattatttctattcttttaaatttattaaggtttgtttttggcctggcatataatctattctggagactgctctatatgcacttgagaagaatgtatattctgttattattgagttgggtgttctatatacgtctgttaggtctggttggtttttagtgttgttcagatcttctgtttcttgtcatcttctgcctacttgtcttgattgtttttgaaagtggtgtattgcatggcctggtgtggtggctcacgcctgtaatcccagcacttcgggaggccaaggtgggcagatcacctgaggtcaggagttcatgaccagcctgatcaacatggagaaaccccgtgtctactaaaaaaatacaaaattagccaggcgtggtggcgcatgcctataatcccagctactcaggaggctgaggcaggagaatcgcttgaacccaggaggcagaggttgtggtgagccaagattgtgccattgcactccagcctgggcaataagagtgaaactccatctcaaaaataaatcaataaaaaagccgggagtggtggctcacacctgtaatcctagcactttgggaggccgaggtgggtggatcatctaaggtcgagaggtcgagaccagcctgaccaacatggcgaaacccagtctctattaaaaatacaaaaaaattagctgggcgtggtggcacatgcctgtaatcccagctactcaggaggctgaggcaggagaattgctagaacccgggaggtggaggttgcggtgagccgagatcatgccattgtactccagcctgggcaacaagagtgaaaactccatctcaaaaaaaaaaataaaaagaaagaaagtggtatattgcaatcttcaactcctattgttgagctgtctattttccccttcattcttgacaatttttactttatacatttgggtgctctatttttaggtgcacatatctttacaattaatatattttcctgatgggttgaccattttgcattataaaatatgtctctatttctagtaacattttctattttgaagcctattttgcctgatcttactgtaaccacaccagcatttttgttgttgctgtttgtatggtatatcttttttcatccttttactctcaatatatttgtatctttgattccaaactgtgtctcttatacacatcatataatttaatctttttttatccagtctgacaatctcttttgattggattgtttaatcagttcacatttaatgttattactggtatagttgaatttatgtctaccatttttgtgtgtgtgtatcatggggtttttgttcttctgttcctctctatgccttctttcacattaagtaaaattttaaggtagtgttttaatatctttaattatttttccctatatacttttaattatttcttagggcttaccatacacactttaactcattataatcagattcagtttgattcaatttcatactaacttaatgctagtaacatatagaaatgttattgccacatagctaccttccctttcccctttttaatggtaatattgttatatatattacatytatgagtgttacaaaccccaatracatattcttataattattaccttatataattttatatattttaaagaagctgaggttaraatggggagcaattatatatttatagtctttttatgttaacctttactatcatttctggttcttttcatttgtttcttgagtttgagttaccactgaagtcatttctttaatcyggtacacatttgttcccacccaccatttgtgtgctattactgggaaatatattacatttctatatgttatagcaacaacagtatattatatgcatattgtttcctacaattgctttttaaatcagctaaaagatgatgaaatatatatttatattgtcttttataattacctttaccagtgctctttgttttgtgtggatttgaattactatctggagtaacttgctttcaacctaaaggatttcctttagtattttctgtaagtcatatctgctagcaacatattttttcagtttttttggtaattttttttcacctttagttctaaaagatagctttgcaggatttttgtttgacagctttttctttaagcactttgaacatgttatcccattctcttctggcttccgttgttgttgctgagatatctgctattaatcttattgggactcttttgtaagtgatcagtcatttttctattgatgctttcaaaattttcttctcatctttagctttcattatttttgccaaaatgtgtctgtttgtggaactctttgtgtttttcctacttggagttcattgagcttcctatatgtgtacactggtgtttcccaataaatttataatattttcagcaattatttatgaaaatgttttttctgttcctttctctttctcctctccttctagcattcaccttatgcattagttggtgtgcttaatggtgtcccacatttttctgaggctctgtaaatttctaattctttttcctctctgttcttcaaattgctaatcttttttgatctataaagwtcactaattcttctgccagttcagatctattcttgagcacctctagtggatttttcatttcagttattgtagtttttaactctagaatttctattttcttacagttctatccctatattgatgggatccttttattcttctctatttgatgcatatcatttctacctttacttgtttaatcatggtttcctttagttttttggacacacttggaatggctaatttcaagcctttgggtgctgccgtagggaattttgttgcctgtgaacagaaaaatgcaaattaatacaactctgagatgcttctttataagaagtttcattactatattgtcaaaaattaaaaatccacttattaccagagatttctgaggacaggggaaaatgataaccctaatatggtgatgatgggagtgtaaactgatacagccattctagcaaggaatccgataattcttggtcaaatagagagtgcatgtaccttgttatccagtagtctgcactggatacacaccaggaatttgaccccacagagccattaaagaacatggacaggccaggtgtgatggctcacacctataatcccagcactttgggaagctgaggcgggtggatcacaaggtcaagagatcgagaccatcctggccaacatggtgaaaccccgtctctactaaaaatacaaaaattagctgggcatggtggcatgtgcctgcagtcccagctactagggaggttgaggcaggagaatcgcttgaacctgggaggcggagttgcagtgagccgagatcacgccactgcactccagcctggcatcagagcgagactccatctcaaaagaaaaaaagaaaaaaaaaaaaacatggacaaagatattcaccatagtgtttgtagcaatggacggttgaagacaatccacatgttcattcctagtggtaatgaagaagtaaagtagctagatgcacactgtagaatatcaaacatcagttagaagcaaattatacatactgcaacatagatgattccttaaaaatttcgtgttgagaaaaaagtaaaagtacagaaagagatytgaagcacaatatcatttatagaaatataaaacacatatgtatrtagtcagtgacatacatgaaatccttttgttggtgcctacttatcatagggaggaacagaagtaaaaattgagaaagaaaggagcgaaataaaataaaatttgtcttatatgaatttatgatgaatctctgcaagtctgcttctgagatacaaaatgaaaacaaagacacagaaagcaaggaaatatgagataatgtcatcagatgagatttagaattggaagaaaaaggttggaatgtttgaaaaggagaataaacagtatgaaatacttatcttggatatttagaatgtgaatttattgaaaaaatatggtagagttaccagacagggttaaatgcccactggaggtttgtggtcatgcatttgcagtgaaaccggtaagcccacttgtgtgattccccatcattgcatgactcctcaggcagagggggaagagagagcattgcttttgtttttwagacaagagagatttgagtgtgtaaaagctaataggaatgtgctcatagagacaggcaggttgaagatattggagaaagaaagcgtaacagatggagaagaataacaataacctgtgcctgcctacccagcatagcatctctttctctgagatagtagggtctacagccataacaccgtgaatgcacctgatcttgtctgatctcagaagctaagcagggtcaggcctggttaatacttggatgggagatactagcgtaggatagagtggatgcagataaatttataagtggcagaggggcagaatttgaaaaaaaaaatccatttcagcctttgtcttggcttgcgaacagacctaaatatgtacatctcattaaatttcccaacgatcactcctcattcaggtgttccagaaacaatgcctctgatgacagacatctgtaacctacataaccagtgcagtaggatgcatttcaatttaaaatcatccatccaactctcatttgctactggtgataattagtgcagtctctccagagagaaacttggcattatttatccagatccttaaaaatcattcatacaatttttcccagtattccacttctagaactgtatactaaggaaataatcagagagatacaaagacttgtgcaaggatatttagtctagtgttattcctataataaataacaaaaattggaagccacttaaatgttcctacagcagaggaagggttaaattaaattctaagatatccattgaagaaaatattttattgccattaaaataatgtttaaaaataatattggctcagccaagcatggtggctcacgcctgtaatcccagcactttgggaggccaaggtgggcggatcataaggtcaggagatcgagaccatcctgggctaacatagtgaaaccgcgtctctactaaaaatacaaaaaaaaattagccgggcatggtggcaggcgcctgcagtcccagctactcgggaggctgaggcaggagaatggtgtgaacccgggaggcggagcttgcagtgagatgagattgcgccactgcactccagcctgggggacagagcgagactccatctcaaacataaaataaaataaaataaaaaataataataatattggctcaggaaaatatgcataatattcaaacagtttagccacagcctgatttctgtgcacccaggctaattaatgttcatgggaactaattagagctgacatgtacagccagccttttgcttactctgcgggatcttgttctgtgtgatttctctagggggagcctgctcactttgagtatttgatgtatccattgcactcagcacccatcaccggtctagctacctgcatccgcaaaccccttatagccacctgttctctggatcgatccatccgcctttggaattatgaaacaaagtaaggaatgaarggcttgcctactttattatgcaagaccccagttgtgaatttatgtgaattattttaattacagtgttccaaactttaattatttagaagctttcagttggaaaagatttttaaaaaatcaagtcagtcaacctacctgtttctcactcttgcgtgggctagaaaactactttgtggtttatttaatgcttaccacatgctagacactggggacatgaagagatgaagacaacacctcagtctctcaccttcttacataaactcctgggtccctccagctctcytatccccttgtttcccacaggaactgctctttgcttcagggagctctccagaccctttcttcctcatctttctcccaggacatcactatctcaaccacccccaactccctcctgactttaccttccagcacagcttccctgggaagctccaaccctaggtggacccccaccccctactgttttctttgttcttatgtacaacttctggggcttctggggaaaaaatacttggacaatactcatgaattttggaatataaacagagctatgtcttcagcatcgctagaccacaccttgaccagtctccctatctaccatgctccacgctggacattatcccctaataaccaagatctagaaaagagaggaaccaacaattgcaaacagtagtgtgtctcaaatacgatgataacaatatatatcagatacagtagatgactggaaggatttagtgagctargcttacaattcagtaattgatctttttcacagcaccctggaactatttaaggaataccaagaagaggcatattccatcagccttcatccatctggacayttcattgtagtagggtttgctgacaaactacgcctcatgaatctactcattgatgatatacgttctttcaaagaatactctgttagaggatgcggagaggtaaaaaaaaaactgctgaagacaaaagtccagtttcttagaaagccacggctgaaatatcaggaactaacatgatctggggaggtgggaccaaaatctgtcttggagaactacagtggcttaaaaaaagggggaaggaggaaatccagttattttcccagcaaccttattgagtatatggttccatccccatattcttatgtccaccmgactatttcattgaacctaaaaccttgtgagatccccgctatgataagtcctgtctgtaattgtggaatattaacaaatattttaaaagaaaagtaatctcagaatcagagtcacagctaagaaggtgaggttggagacggaggagccagggaaaaataagcatcaatggtgagaggtaataaagagcgcatcagctttccctgaggtgtcttgcagaaacaaggcaatgatttcaggaattacttccccggctctgaaacatgcttctacaggcaaaatgattgcttgtggtcccaacggcttaatgatttgtgggcctgacagtgtcagcatctggccactatgagttacaggaataatgaaagtgtctgaaaatgtcagccactcctcagtctcatttgcaccttccccccactcccaccctcacacgtagtttcagtctgaactcgttgggaaaagcacctcttgactgtaacctctaattagactgctcacttcctgcttgcttgctctcttgctgtctttccctatagtgttcctttagcaatggaggtcacctgtttgctgcagtcaatggaaatgtgattcacgtttacaccaccacgagcctagagaacatctcaagcctgaaaggacacacagggaaggtaagtgagtgaacagtctctggggaaacaaggggcacggagccaagtatgccgccagccagtgggatacaggtgaacaaaagagagatggttcctttcctcatgggttcactgtctacttggggaaagagacaataaaacaaatgcacagacaaatgtagttactaattgcagttccactgaaagaaaaacatggtgttgttgtgagagaaataatgaagggggcggcataatttaggtggctgtatttgcaaaggcttggtcctataagagtgagtaggagttaatcagacacaactggtggggataatcactgcagatagggatccaaaggccagagatgggagactcatagggtgtcagagaacgtgaaagtctgtgggcctggaatgtggtgccaggataaaccgtggggtaaagatgggctgagattggagaggtcacaagggcccaaatgcatggaaacttgtaggccttgtaaggatttatccttcttatttcttgaaatcatggaagactttcagggcagagaatatgaccggatttgcattttgaaggattactttggcagcagagtgaagactattgaagggggcgagggtagaaatggtgaggaggctattgtggatatctacaccatagataatagtggtggtgatacagttagggagaagtggatggattcaaatgattttagaaagtaaagtcgtggtggcttatgcctataatctaagcactttgggaagctgatgtaggaggatcgcttgcactcaggagttcgagactagcctgggcaacataaggagaccctgtttctacaaaaagtaaaaaatattagccaggtgtkgtggcacacacctgtggtcccagttacttgggakgctgcggtgggaggatcacttgggcccaggaggtcaaggctgcaataagccatgatcacaccactgcactccagcctgggtgacaagagtaagaccctgtctgaaaaaaaaaaagaaagaaagaaagaaagaaaagcaaaagaaaaaaagaaagtaaaatcactaggtcctagagtagtagattagatgtgaggcatgattaagagggagaggcatagaaagggtaagaagtcagcagatgaatttggagataagaggccattggaaaagagaggcattctaggcagaaggacttgttggagatgatgaaatggaggtatgaaataggacagtgctcattggttcatatggctggaacactggacacatttgagcaatgatagagggagtaggaaaggytggctgcatcgcagaaggtagtgtatgccatgccaaggaattggactttagtctctaggtgacgagaaacaacggaaaggatttaagcaagaaagtaatgggatcagaaaggtaactctctgaacagtattgaggaaggattagagtggaaggaaattggagtgatggagagcagttaggatgtgaaggtgaaagctgggttaggaactaaaccatgactttagtagcggaggcagagagaagaaagagatgaagttccattttggccatgtgatatttgacgtgcccagaagtgtgatgtatgtgtgtggaggtcaggagagaagtcagggctgagtatgaagattcggggaattagaaagtagaggaagtcagaggcatagattagatcaccaagrgcctatgtagaatctgagaagaatattggacagcagagggaagaccaacatwtaagagactggtgaaagaagaggagccgatgaaagactgaaaataaagatacaaagagaacttggaatcagataattatctcaaagaagccaaggaactaaacaatttctgaaaggttgaagtggtcagtggtactagatgtcagagggaggtcatgtaaagtccaaaactgaccgttgactttagcaaataacagatcattggaaggaaaagtaaaaatgtgtggaaagtgaaagtgctatgtaaacacaagcatttttgtttgtttttgagacggagtctcactctgtcacccaggctggagtgcagaggcgtgatctcggctcactgcaacctccacctcctgagttcaagcgattctcctgcctcagcctcccaagtaacacaaactctttttttgagacagagtttcgctttcgttgcccaggctggagtgcaatggcacaatctcagctcaccgcaacctccgcctcccaggttcaagcgattctcctgcctcagcctcctgagtagctgggattacaggcatgtaccaccacacccgggtaattttgtatttttaatagagacggggtttctccatgttggtcaggctggtcttgaactactgacctcaggtgatccacccacctcggcctcccaaagtcctgggattacaggcgtgagccaccgcgcctggcccacggacattattaatgagagctgctgagyctcctcagcttcagcaatataattagtcttcaagtgactgtggagatgcggatgaaagtacagaaagtgattctgatgcccaagctcaccagtccaggaaaacagccatttgtttcatcactttacaagtacttaaaacactggtctctaattagggatatatgttagaatgacatgtgtaacattttttacaaatacagatacaggatgcagctaaagctatgcatacagggaaatgtataaccttaaatacatatactgtgttagaaatgaaaaaagatacataagcatccatctcaagaagttagaaaaagaacagcaaattaaattcaaataaaaggcaggaaataaagataagagcagaagttaataaaatagaaaacagacaaaagatcatcaaagccaaaatttgattctttgaaaacacgaaatagacaaacccttggcatgactgatgaagaaaaaattaagagtgtggagataccaacaaccaatatgaggattaaaaaggggatatcactaaaggtcctatagacattaaaaagatctgaaaggggtccgggcgcagtcactcackcctgtaatctcagtacttcgggaggctgaggcaggcggatcccttgagatcgggagttcgagaccagcctggccaacatggtgaaacttcatctctactaaaactacaaaaatcagccgggtgtggtggcacacacctgtaatcccagctactcaggaggctgagacaggaggatcgcttgaacctcggaggcggaggttgcagtgagccgagattatgccactgcactctaccttgggtaacagagtgagaccctacctcaaaaaaaaaacaaaatgaaaaaaaaattgaaaggatattatgaactttatgcaaataaattttaatatatagatgaaactgacaaattcctataaaaattgaatctgtaggccgggcgcagtggctcacacctgtaatcccagcactttgggaggctgaggtgggcggatcacgaggtcaggagatggagatcatcctggataacacggtgaaactccgtctctactaaaaatacaaaatattagccgagcatggtggtgggcacctgtagtcccagctactcgggaggctgaggcaggagaatggcatgaacctgggggatggaggttgcagtgagccgagatcatgccagtgcagtctagcctgggcagcagagtgagactctgcctcaaaacaaaacaaaacaaaacaaaacaagaagaatctgtaacttaaaacctttctacaaagaaaactctaggcccagatcttatcactggggaattttatcaacatttaaggaaaaaaaaataacactatcactaatcttgaaaaaaactcttctagagaattggaaaaagaaggaatactttccagttatgttctatgaggccaaaataatygtgataccaaaatctgtcaaagacaccacaagaaaaaaaaataagctagtctttttcatgagcacagatagaaatatatatttatatatatattttagacggagtcttgctgtgtcaccaggctggagtgcagtggcaccatctcggctcactgcaacctctgcctcctgggttcaaacgattctcctgcctcagcctcctgagtagctgagattacaggtgtgcgccaccatgcccagctaatttttgtatttttagtagagacagggtttcaccattttggccagkatggtctcgatctcttcacctcatgatccacctgcctyrgcctcccaaagtgctgggattacaggtgtgagccaccgtggccggccagctttcaagattttcttatctttggctttcaacattttgtttttgatgtgtctggatctagatttctttgcatttatcctacttggagtttattgtacttcttggatgtgtaggttaatgtttttcaacaaatttgagatttttcagcattatttatttgaatatttgttgtttttctctcttctcctagtgctctcattacagtaccataygtgggtgcatttaatggatgcccacatttctctgaaactctgttaatgttaatttttcttgattagtgtttctctctgttcttccaattgcacaatctctattgagctatttcaagtttgccagckcaaatctactgttgagccttccagtgaatttttcgttttggttattgtacttttcaactccagaatttccatttgatttttraactaatttctgttttcttattatattctttatttgatgaggcttgtcatcctaccttcctttaattatttaagcgtagtttcctttagttaattgaacttatttgtattagctactttgaagtctttgtccgcaaaatctaccatctgggccccttcaaaggcaatttctattgcctgaatgctttctttctttctttttcttattggttacactctttttgtttgtttgtttgtttgtttatgtttcaattttttgttggctgaatattttagacaatatattgtagcagttctgaatatgtgtccccccagggcattgttgttggttggttggctgattatctgtttcgtgacttggctgagctaattctgtaaagtctgtttcccctgtagtgwgcagtgtctcatatcactactcagatctatttttcatcttttcttttagcctggctacctagggttgcccatgagttgcctaagctgcttattagttacagatggtgcataaacccccttagacaattaggtttttaccttttactaccagatttatgtgtggcttggaaaatgctatcacagttcagagagtgatggcttttgcatcatgttcagccagagactggtagtttggatgrcccctttctgattgttcataagagggtacagccttgggcatgcacagagtcttccaggctgcgagggatgaatatgatttcatttttaagcctggcttcctaggagatgcccctgggtcgggagagcttaatgttcmgcatttggtagactgttgtgtttggtaggcccgttgtgccagtgagactctgccctatgttaacgggtctttgtgtagcttaggagatgctttcaagttttcctcatatcccactctgactgcacctgaatcagtacagtctaacacatacacaagaccttccagcctctagagttgtctgttatccctgaaggactcttcttctctgtccctttcccttgttctatcaaaattccactcctctatatcattttgcttacatcctggagttatcagcctcctcttaatcactttccaccaagatctccactgttttagacaatgcccataggcatggacttttccatgttctattccaaataaagtcagccccctcaagcagagctgtagagctccctgtcttagcacctgactttcccacagacagaacctttgctccactgcaccagagctggggcggggacctgcttttccaggagtaacatcctcacttctgtgagtgacacttgaggtgtgtgcrtgtgtgtgcacatgcgtgtgtatgtgtgtgtgcacgtrtgtaagcccctggtctttttggcttgcccttcatggcttggaactttcactctataagcaaactgggtcaggaatcattagggcacagttattctcagtatgctgagcttagagtggagtttcttccaacaagtgacaatgggccgaggggaagagagtctgagccctcttggccacacctgcttggaatagagcttctgcaacatggggctggggtaagaataagaaatcccagcagtttccctttccagaccgaaaccatagcccaagatcaggagctatggggagagggagtcgcttatcttggccacayctgcccagagtgcacagcagtgaagtttctggagctgaggccgtaacagagcgagtcatggcttaaatgcagcagactctgttcttactgggattgagtagattttcttgaataaatgtttttccatttgctgtattccctgaggacaatttccagagacattttatttattttattttagacagggtctcactctgtcactgaggccagagggcagaggtacactcatagctcactgcagcctcagcctccccagttcaaaccatcttcctgcctcaggcacatgccaccatgcccagcttattatttttatttttataaagacagggtttcactatgttacccaggctattctcaaactgctgggctcaagtgatccttccacctcagcctcccaaagtgttgggactacagatgtgatccactgcacccagccttctaaagactttaaatgattattttttatcatatttaccagttaacctacattgtcagagagaaggtcaagttgaggtycttaccgtgccattccagaagtccactctctctgtgctatttttgcaagtttctgtgaatacataattatttcaaaaatgttttgaaaaaacagcaataattggttggttctagccttaagaaacctgtaggattcagtctttacgttcataaagtgaaaaagaaatgagagtgtttcatcttcagtaatttgcaagcgtcatagaaaacagaatgtgaacgttcacaagaagctatgttttgtgctaacagaagggcctacagcaggaaaggacgttctgctcagtctagtggagcacctaaggagtttgcacccttttctgtgttagggtgtaagtgtgtgtacactcttcactggatatgtcttcctctcctgcagattcgctcaattgtgtggaatgcagatgatagcaaactgatttctggtggcacagatggtgctgtgtatgaatggaatctgtccacaggaaagagagagacagaatgcgtgctcaagtcttgcagctacaactgtgttactgtctcccccgatgccaaaattatctttgctgttggatcagaccacaccctcaaggagattgcagattccttggtgagtctgcccctgccccgcctctgggctggggcacggatctgcagggacagcttcccgtgcttacagcacaaagtatgcacggaatgagggcctctgcatacagggccccttcttcccaagataacatcaggctcctcattccttttagattagctcagttatcgtcacttcctgaatttcctgcctagtttccttcctgactgggtgaaattgtaaattgcggggctctttttcatttcccttttacttgctgtctgtaacttctctcccaccttccaggcatggaggtcatgtcatctctaaactgtactcttacccttggtctgcacttacattcctggggtaaaaacctaactacggtatgcactgagtaacaccaatgatggaccacatggactgtaagattgtaatgccataagattataatgccaaatgttcactgtaccttttctgtttagatacacagatattttccattgcgtcacagttgcctacagtattcagcatagtcacatgctgttcaggtttgtagcctcggascagtaggctctaccacatagcctaggtgtatagtaggctgtcgcagctaggtttgtgtaaatacactccrtgatgtttgcgtgacaaaatagcctaaccatgtatcccatatcaagcgatgcatgactgtgcagtgagctgctctcacctaggcttgccactgtattcttttgaaatccccaaactctgaaaccgtacagttacattgggctccaaatagtgaagggaaaagagaggagctcagcaaggatgcatcatacaaacatgggctgtgcgctcctccagctggttcctcccacttttcctgtgactggtgcctgggaaagtgcgtagataccacggcagcaagctagcccaaggcagatctcccgtggctggaacacagctgacagtatggtgactctcctgtgtacccccgagtagcctggtcctaattcaatggcagctatcagtgctgtgccagaataaagcccctttagggcagggccatcttttgctyctcttggcagccctactagctggcacattgtgtggtgcacagcattcaataaatgtgtgtgtaggcatgaaaaaatgctcatcatcactggccatcagagaaatgcaaatcaaaaccacagtgaggtaccatctcacaccagttagaatggcaatcattaaaaagtcaggaaacaacaggtgctggagaggatgtggagaaataggaataattttacactgttggtgggactgtaaactagttcaaccattgtggaagacagtgtggtgattcctcaaggatctagaactagaaataccatttgacccagccatcccattactgagtatatacccaaaggattataaattatgctgctataaagacacatgcacacgtatgtttattgtggcactattcacaatagcaaagacttggaaccaacccaaatcaatgatagactggattaagaaaatgtggcgcatatacaccatggaatactatgcagccataaaaaaggatgagttcatgtcctttgtagggacgtggatgaagctggaaaccatcattctcagcaaactatcgcaaggacagaaaacgaaacaccgcatattctcactcataggtgggcattgaacaatgagagcacttggacacagggtggggaacaccacacaacggggcctgtcgtgggatggggggaacagggagggatagcattaggagatatatctaatgtaaatgacgagttaatgggtgcagcacaccaacatggcacatgtatacatatgtaacaaacctgcacgttgtgcacatgtaccctagaacttaaagtataataataataataaaagaaaaaaaaatatgtgtgtaggtgggtgggtgaatgagtgcatgaatgagtgagggaatgaaggggcgctctgatagtacagtagtcccaccttacccacagtttcagttacctgtggtcaaccaaggtccaaaaacaggtgagtaccatactgtgagtaagatattttgagagagagaaatcacattcacacagcttttatacagtattcttataaccgttctattttattattaggtattatttatctcttactggacctaatttataaattaaaccatatcatagttatgtacgtataggagaaaaccatagtatatatagggttcagtactatctgtggtttcaggcaccactggggatcttggaacatatccctcaaggataaggggagactaatgtatggttttgcttatgtaatgagcattaataaatgcttgctgaatgcatttatgagcaatagcccattctcattttgaaatgcacccatgcrtagcagtcaaagcagagactggagcccacccaggtacatgagatgaagcaaatgcctttcacacagatggtccgtcatccatagactagggataacagtaactgcctcagagggtttcgtgaggattgaatgagttgcaacatggagaaggcacagaacagtgcttggcacatagtaagtgctatatgaatatctctctctattagtattattcctaactcatgaacctggttatttaccagcaacacaacaaggaatatctagtttgcgcctttttttgtgctaggcactataccggatgccaaaaggggatagaaaaagcattttttaaagacaagcccctagggatctgttagagcagagggcgagagagtatggcactgggacgtgggggccacagctcgacccctcacactgagcagagctgcctgtgtctcagatccttcgagagatatcggcgtttgatgtcacctacaccgccattgtcatctcrcattctggacgcatgatgtttgtgggcacctcggtgggaaccattcgtgccatgaagtaccctctgcctctgcagaaggaattcaatgagtaccaggcccatgccggtcctatcaccaaggtgagcagggccctctccccaggaacccagtcccacacctgcctgctacgtgccttgttcatcccttcaacctcccaatgtcttttctctctccttcttctctcttatttattcatccatcattcattgaatcaccatctattgactatgaatatactctttgtttaaactacttccaggaatttagcctaggaaatcatcagagatacacctaaaaatgtatgtacaacgttttcaccataatattatgcataataaggggccgtttggtggatgccgtagctgccgtgagtgtgggctgcacttgaccacagctgcctcctcctccagagaatgccccagactgaaaggagccatagccctgaagattggcccctacctctccctgagggtacaaaaggccaccccaggggcaataccatgagtacacatttgtaaattgtccttccattcacccttctcataaagtagtatctatgttcaacagtcaaaatgtggaagcaaccaagcatccatcgacagacgaatgcataagcaaaagatggtatatctatacaatggaacaataccctgcctaaaaaggaagggaattctgcaatgtgctaccacatggatgaaccttgaggatgttatgctaaattaaataaggccaaccacaaaaagataagtacagtgtgattccacttttaggagatacttagagcagtcagaatcacaaagacagagtggtggttggcaggggctgcaggaagggggaatgaggaatgattgtttcataggtatagagttttggttttacaagacaaaaggattatgggggtagttggtggcaatggctgcacaacattacaaatgtatttaataacatgaactgtacacttgaaaatggttaagatagcaaattttacagaatatgtattttacgacaattttaaaaatgaaataaaaaagaattatcttgcacgcgaaatggttgccaagaaatcatagccaatagtaaattaaaagttattcatagtgcaaaaaaaaaaaaaagtaatgtctatacctacactggaccccccaaaaaacaggcactgggaaggtatgtgtctcttcttccttactctctctttctgcagattgaatgacacagcacctgaggttttgagttatatcccaaactccttagtggcttacctgcaacactagctgtattaagaaaaggtttctcattataaaacagaacatttctgtaccaagcctgggccttgggtccaaagtaaattactacaacatattccacctcttcccttcagatctgctaagttttgtggataacatatttatttttctgattatagaagcaatgcatatttattttaaaaataaaaatccttgccaggcgcagtggctcacgcctgtaatcctagcactttggaagcccaaggcgggcagatcatgaggtcaggagatagagaccatcctggctaacacggtgaaaccctgtctctactaaaaatacaaaaaattagccgggcgtggtggcacgtacctgtagtcccagctactcgggagactgaggcaggagaatcgcttgaacctgggaggcggaggtttcagtgagccgagatcgcaccactacactccagcctgggcaacagagcaagattctgtctccaaaaaaaaaaaaaaaaatcctcataatggtatcatcatttctttgatgcatttccttctacatttccatgtgtgtgtgttttaaataaaattaagatcatactgtgaggccagtctcgtggcctgctagtttttaacttcacactactgtaagcgtttgtccatacaattaaatattcctcagaagcatgattttagtagctacacaaatatcctatcctatgatggactgtaacttactattctcttgcaattaggcatttaaattatcttatgatctatagtgaacagcccagtttacaaatttatatgtgcatctctgattctctcctaagactaaattcctagagagagaattcctgaattcaagagtattgctattctcaagattcttgacacatactgctgattgtgagaagacatttttcacagttaatccttttgttttaactttttatcttgaaatacttataggtttagaggaaattttaaagatggcacagagttcccgtgtatccctcaatcagtttcccccagtaattacatcttctagaactgtagcaaaatatcaaaccagaaaattgacatggtccacagtgtatgtagttctgaattatttctcacatgtacagtctgtgtaaccaccactacaatcacactatagaaccgttccatccccacaaagatctccatctgcccttcagagtcctaccactcctcccgactatcatcccgaatccctgcctaccactaatttgttcttatttccataacttttgtcattttgagaactgtatatggaattatactgtatgtggccttctgaaaatggcttttttattgatacgtagtatttgtacatattatgaagtacctgtgatattttgttacagtcatagagcatgtaatgatcaggtcaggatatttagggtttccatccatctcgcgtatttatgatttctgtgtgttgggagcatttcaagtcctgtcttctagcaatttaaaaatatacaatatattgttgttaactatagtcaccttactctgctatcaaacattagaacttatttcttctttgacctggcacgtgggtcatgcctgtgatcccaacactttgggaggctgaggcagccagatcacttgaggtcaggagtttgagaccagcctggccaacatgatgaaacccccgtctctactaaaaatacaaaaattagccaggcatggtggtgcacgcctgtaatcccagctactcgagaggctgaggcaggagaattgcttgaacctgagaagcagagatttcagtgagctgggagatcgtgccactgcactcttagcctgggcaacatagcagactctatctcaaaaaaaaaaaaaaagaaagaaagaaagaaaagaaaactgatttcttctatctaatgtttgtatctgttagccaatctctctttagcaccccaccaacccatacactcttccctagtatctatcatgccactctctacttccatgaggtcaacttttttttcttttttttgagatagagtgtcactctgtcgcccaggcttgagtgcaatggcatgatctccgctcactgcaaccaccgcctcctgggttcaagcgattcttccacctcagcctcccaagtagctgggattacaggcacatgccatcatgcccgactagggtcaacattttttagctctcacatatgaatgagaacacacaatatttgtttttctgtacctgacatatttcacttaacttcacgacctccagttccatccatgttgctgcaaaaacatgatttcattcattttttacggccaaatagtattccagtgggtatatataccacattttctttattcattcatccactgatggacacttaggttgattccatatctttactattggtggtacaataaatatgggggggtggggtggagcgcaggtatcctttcaatctgctgatttcctttcctttagaaaagtatccagtaatgagattgcaggattgtatggtagttctgtttttagttttttttagaagtctacatactgttttccatagtggttgtactaatttaccttcccaccaacagtgtataagagttctctcttctccacattcttgccagaatctgttatttgttgtctttttgataatacctactctaattggggtaagatggtatctcatggtggttttgatttgcatttccctgatgattagtgatgttgagcattttttcatatacctgttggccatttgtatgtcttcttttgagaaatgtctattcatgtccttagcccactttttttttttttttgagatagagttttgctcttgtcacccaggatggagtgcaatggttcaatctcggctcactgcaacctccccctcctgggttcaagagattctcctgcctcagcctcccgagtagctgggattaccgtgcctgccaccacgcccagctaatttttgtatttttagtacggatgaggtttcaccatgttgtccaggccggtctcaaactcctgacctcaggtgatccaccctcctcagcctcccaatgtgctgggattacaggtgtaagccaccacgcccgccccttagcccactttttaatgagatttttagatttttttgtttgtttaatgttgaattgtttgagttctttggtattctggatattggtcttttgtcagagcaatagtttgcaaatattttctcccattcgacaggtcgtctcttcagtctgttgattgtttcctttgctgtgcagaagctttttagcttaatgtcctgattgtggctttttccactcagctaaatcttcaaatccatccaagttgtgttgtgtatcaatcatagtttattcccttttatttctgagtagtattccatgaaaaacaaatcacagtttgtatagccattcacctattgtaggatatttttaattttttccagttttcagctattataaataaagctgctgtgaccaatcatatacaggcttttgtgtggaaataagttttcatttctctgggataaatgcccaggagtataattgctgaatcatatggtaagtgtatattcaggtttgtttttttttaaactgccaagctattttccagagtggctgtaccattttacattcttaccaagaatgtatgagacccagtttctctgcatcattgccagcacttggtgttgtcactgttttttattttagctgttctaatgggtgtgtagtgatatctcatcatggtcctaattttgcattttcctaaatggctaataatgcggagtatctcttcatgtgcttacttgccatctgtgtattttccctggtgaaatgtctccttatcttttgtctactttctgattggattgtttggcttttttactgttgagttttgagagtttcttgttcgttctagataatagctgactcttcagattccaaatccacagagaatgtagacgtaaccttacttcttctattcattaacagatgcctgtgagggctcctctctcattcttacctgggatcaagtttacctccctgtgaggctgtgcccaggattgcatggggggaagccttgcacaacagctggctcagccctggtcatctgtggccttgaaagcttcctggccatgaccctttttctcttcagatgttgcttacctttgatgatcagttcctgctgactgctgctgaggatggctgcctgttcacctggaaggtctttgataaggatggccggggaatcaagcgagagagggaggtgggctttgccgaagaggtgcttgtgactaaaacaracatggaagaaaaggtaagaactggatctaatgaagagggatatggaattacttaccagactgcattcagatgcaggtccagcactggggccctctacagcctggctacaccctatgcccagtgcagacccccacggctccctgcacatctgctgtccccacaaccaagctctcctcctcattgccactgtccacccgactctgcctgtctttctgccatgtgatcatcttgacttacactgtgctttgcttttattctgtgatctggttttctcttcctactctttgaaaccaagaataatgaaacatacagttctcttatgaccaacagttcctagcacatgctgggcacatggaagacaatcaataaatatttacaaaagtaaagtatgttctcatttaaatctcacaacatctctatgaagaagatactgtcattctccccatgtttcaaaaaacaagttaggagagcttgagggatgtgttcaaagtcagtgtgctaataattaataggactagagttctaatccagatttaatccagagccccctcccttaatcactataccaaagggacatcccttccttcctgttgatgcagtaaacattccataaaggtgtgttttgcagagatatgagtgcatagctctgtgttacgcttcctaagggagaagctgaatggatgataaacacacaaggctcatggaggatcgcaaagctacacagtcattgctgtttgtccagaatcttaagtgtgtttattgaacacctaccatttgctaggcactggggatgcacacgtgaaaagacagttgtgggccctgtgacatgaccaggaagcttacagtcaagtgagggatagaaacaagtaaagccatcagagcagcaatacaacactgccacaaagcacggtgacaagcccctggcattcgctggagatccctcccagagctccctagaattttctgcaggaaaagcaaagagggagaagaggatgagggaggggcccgtgagagtgggggcctgacctgctgcagaagggacatttccttttctctgttatcttttctgttcttcccagagggtaggggaagaggccaaataggagacagcaggctgaaccaaaggcctgaaggtgcccaagctggcttctgaccacagcccccagatgggcctgacagtaccgctgccaggctggaaatgacttgtgcatataccgctccttcttgaaactcccttctgtcttaccatccttgtgaccacactctgttccctgtaaacctttctgactcctcctccccgcttctgtcctggctcttcctccgcctgtcccttaaaaagcatgttcccagaattcccaactctctttatattccattatagtctaagtaactctcaggccatgatttaccttctctgcctaggatttacagaggggtctgctgtgtacctgacactatactaaggtctggga

SEQ ID NO: 12288 - DNA, 244259 bp, Homo sapiens
  misc_feature (1)...(244259): n = A,T,C or G, or insertion/deletion polymorphism (see Tables 1-2)
attgagtgtttaacaggaagagcagaaagtccctaggaagtggacttcttgggagaatttgtgctggggctgcttgtttccctgggagatgactgtgctttgcatgggacatgaaaaagtgaaggactaagcttcaattatgggaactctggcctgggcatccttgactgagcttagtactgagggaaattgtcctccttcaaaaaaatctctgttgaatcagaaggacctttcttgaaagtaatgttatgtggtttgtgttagtctgcttgggctaccataacaaaagaacacagattaggtggcttaaacaacagaaatttatttttttcacagttctagaggctgaacatccaaaatcaaggttctagccaatttggattctggtgggggcactcttcctggcccatagacagctgtcttctcactatgttctcacatggccctcctcagtacatgtgcctcgagagagggtgagtgctctggtgtctccgcttataaggacattaatctcataggattagggccctacccttaaaacctcatttaagtttaattacttccttagaggcctcatctccaaatacagccacactaggtgttaggactttgacgtacaaatctgggggagacacaaacattcagtccataatatggtcccagggagcaaagatgccaatggactgatctaattatagctgaatttggctatggaagttggactgatcttcctgaagtagatttcaaagacagccacaagttcttcccctccctgaatctattcccccttgccatgtaactttagtccctggccacactgacttgctttggcaatgacacagttgctaatgtggcatcaacagagatttgaaaagtgctttcacattgcggctcgctgtctcttcctcctcacaggaccccctaccactgctgtcatgtgaagaagtccaagtaagcctgaaggatggtgagagctatatgggttagtcattcccactgccatggccaatggcctgccaattgccatatgtgtgacagaagccattttagatgacttagccaccagccagccagccctcagccgactgcagatgcataagcaagcctagcagtgattagataaactggaccagaccataagaactgcccagttggctcacaaaaatgtcagctaaataaatggttgttgttttaagccacaagttttgagacagtttgttatatgacaatagataactgctatacttacctttttttttttgagacagggtcgcattctgtcacccaagctggagtgcagttgtgtgatcttggctgactacaacctccatctcccacgctcaagtgatcctcccacttcagcctcctgagtagctgggactacaggcatgtgccaccatgcccagctagtttttgtattttttgtagagatggggttttgccatgtcacctaggctggtctcaaaaatcttgagctcaggggggagggggaagggatagcattaggagatatacctaatgctaaatgacgagttaatgggtgcagcacaccagcatggcacatgtatacatatgtaactaacctgcacattgtgcacatgtaccctaaaacttaaagtataataataataataattttaaaaaaaatcttgggctcaagtgatcatcccaccttggcctcctaaagttctggattacaggtgtgagccacggtgcccagcccatacttaacttttagaatataaaacaattttggagttcttagataattaaggaggagatactaggcttcctaataatatgacataaggggcctaactagaataaggaaaagtaatgtgatcacatttatattctaagagtatggtattgttcatatcggttaaacatctaactatgggtggccctcagttctgagctctacactggtgtaaccagtagcttactagacatcttcacttggatatctcactggcacttcagagcaaacacatctaaaatggaattgaccataatctgtttcacactttttttccctcttctgttccctacctcagttgtccaagccagaaacttggaaatcattcttagggctttttctttctctctgcacctttgatgcagttaacaggtcctgtggtttctactttctggatctctctaaagtccacctgtgttcgtccgtccccgttatcattgtctcagtactagtcactaacacctctccctcagctaattataatatcctactaatttgcacaggatttgccagtggagtggatatgaagtatgtgagaaagagagaactcagggatcactccgaggttttggcctgagcaactgaaaaaaaaaattgacttgtcacttattgagctggtgaagacaagtataaaagtggatgtggggccgggcgtggtggctcacgcctgtaatcccagcacgttaggaggccgaggtgggcagatcacctgaagtcaggagttcaagaccagcctggccaacatggagaaacccgtctctactaaaaatacaaaaattaggcgggtgcagtggcatgcgccagtaatcttagctacttggaggctgaagcaggagaatcacttgaacctgggaggcggaggttgtggtaagtggagattgagccattgcacttccagcctgggtgacagagtaagactccatcacaaaaaaaaaaaaaagaaaaaaaaagtggatgtgggccacattgtgtcacattgccatttctggctgatgggaggctgagaaagtatctggctgtattagttttgtattaacatgtaatacaaatatataattaccacaagcttagaagcttaacataacatgcatttattatctcacagtttctgtctagatttgtgttagctcggttctttgcttcagggtctcatcaggcttccaccaagttgtgtgggctgtgttcccatctgggtgctcaactggagaagggcctgtttccaagctcagtctcactgttaggagaactcatttcctcctgcttgtaggattggacctacagagttttttgttttgttttggtgctgttgggccggaggctgtcctagaggttgcctggagtttactgccacatggacctctccataggcagttcagagaatgacagcttgctttgtcaaggccattaggagtgcaagagtgagtcttctagcaagatagagtcttatataatgtaacataatcaaggaaatgatatcctgttactttttttgtattctattggttggaaacaagtcacagtcctcatctccattcatgggaagggattacataaacgtgtaaaatactgggaagcaggtagagcaggaggactagcttagagtctatctgcccaataactctcgcagtaccagtatggaaggtgagaaggtagaatgggttctggtccttaagttaccaaggctgagtcagtgggttctcctgccagagactgttgatctgtaatgatgatacaactatgaagagagggttagaattactttgcaggggtgcacagtagcagcgcagctcattgcctggtggttgtgacagcagtgtcctgagattgtccctaaggttcagtctgtgggggctccttgtttcctgccagctacgtaagcctttttctcctatctctgttcagctctgtgatccattctatgtagccttctaagaaattaccccttaggcttaagatagtcagagttgtttgttatttgtaactaaggatgtgacagaccctgtacatgtagctggaataattataattagttgtcaccacatggattaatgggagaaggagagggaggtagaggccagatttggatggccttgccagccatagtaagtttacacttcatcttgagattcatttaattgcttttttttttgagatggaatctcgctctgtcgcccaggctggagttcagtggtgcgatcttggctcactgccagctccgcctcccgggttcacgccattctcctgcctcagcctcccgagtagctgggactacaggcgcccgccatcacgcccagctaattttttgtatttttagcagagacagggtttcaccgtgttggccaggatggtcttgatctcctgacctcgttatccacctgccttggcctcccaaagtgctgggattacaggagtgagccaccgtgcccggcctcatttaactgttttttttttttttttttttttttgagacggagtcttgctctgtcacccaggctggagtgcggtggcacgatcttggctcactgcaagctctgtctcccaggttcatgcagttctcagcctcctgagtagctgggactacaggcacccaccaccacgcctggctaatttttttgtatttttagtagagacggggtttcactgtgttagccaggatggtctcgatctcctgaattcatgatctgcccgccttggcctcccaaagtgctgggattataggcgtgagccactgcacccggtccatttaattgttttaagcaagcaagtaacatataggaagagtcttgtgagggctttttgaaggatgagtttaaagacaatgagactggcataagtgaacccgttgaaggctttctcagtcaagtaggtgagggaagatgagacttgaggtggtgccaatgggacggaaagaggaggcagattggagaaatagtgaggttatagaggcaataagacttgttcatttattggatgtgaggaaaggacaaggaaggagtccaggatgatttccaggtttctggttgaggcaactggatgggtggtaaggaactgggacagggaatagaggagcaggctggtgacaggccgtagagcacattggttatgtgcatcctcccggcctcccagaaggaatccatcactttttccacttttataggtgtttccgcactgtctttctgtccggatctggcagacctgggtttgagtcctggctctggacttataagctgtgtgatgttgagcatattatgtaatttgagcctatttcctcaactgtaaaatggaaatacaacttacttcttgtttgtgtatgtctgaattgaatgcacagtgtgtggtatgcagtgggcactccatagtgttggctatttttattactcagaaaggggtcagggaagaggcccaggacaaatgggtgaaggctttaagcaaggcttctaggtcaaaagaggaaaaacacaacatgtggcagaccagctgaagccagagggaggccagagctgagctaccaccacatgttgctgagcagatgagtcactgcaggcagcaggtcaggctacccaggccacagcagactgggctgggctctacacgatgacttcattgtatgccttttttgtcctctcctcctcccagaaggaatccatcactttttccacttttataggcgtttccacactgtcttactgtccggaaagagcaaacacggtggaaagggacagaagagccagaattccgtctagtttgatcactgatttgctgggtgacctggtgcatttcacttcgcctcagtctctttatctgtaatatgagaatgcgcagatttgcctcctaagtgtgatgtgagaattaggtgagagttggcaggcactaaataaaaaagcatgcattagccttctattcattagttgtgttattctgtctccttcctgctcccggcccctctctccctagttctttgaggacaccgatcgactcgaactcatttttgggtccccagcactgagcttggcccagcagtttcatgaatggatgaatgaaagattcaatgggagtccgcagccgctgacggcgcgccgagagccccgcccgcttctggtcctccgactgcgcgccagggccacgggcgggtcctttgcgaccgttcgctggcgcgtgcgcgggaggcggcgcgcggccggaggtggcgggcgggctcccggtgcgcgcgcgtgaggggcggggccggccgaaggctggctgtaggcaggcggctgagccggcggcgggtggcctgcccaacgtgtgctgggtgggagaaggcgaggcggcagcgatgctgtctcttccgtgaggagcgcagaggaggtcgcggcgccggaggccccagaaggctcgaaggcgccgcgggctggggtcggtggcttagggagcccgtccggccatggtggccgcgggtggtggttggcgcggctgcgctgcggcccggggcagtgcggagccgggacagtcgcggcgctgacgcccgcgggccccagctgcagatatgaagcggagccgctgccgcgaccgaccgcagccgccgccgcccgaccgccgggaggatggagttcagcgggcagcggagctgtctcagtctttgccgccgcgccggcgagcgccgcccgggaggcagcggctggaggagcggacgggccccgcggggcccgagggcaaggagcaggtagggcgggttgggatccgggagggtgaacctgaatggaagccgtgggggaggggatcttcggcgggaggacccgggctggagctttggaggggtggggtctgagtagttcgcggggaggagtgggaggtctggggaggccgagaaatggggagtggagaaatggaagtggtggcctggggttgtattggaaatgggggtgtagaagaatgaaaaattggtgcaagagatagtcaggggttctggatggggcgaaaggacgctggaatgtgggctgagtgtgtgagctgcaacgagtaggcttactaaagaggcgttgaggagttatccataggagtaaatagagtaagatgtaagtcaatttgatgtagtgttatcctgtttyctagaggttgtccttaaaattgtaaaaacggatgacactcccaagcattctctgatttggccatcattatacttttgtaccagtgtgttcacaatcattgttaaggctctctttaccaaccatctatttcacaagaaagcacttgtgaaacacctgcatgtgagcagtgttaagcccaattttgtgaacagaattcgtagatatatggtttgcctgctagttttccactgaaaacacattactgggaaaacacagcagcatacaaatattcatggagtttctgaatgaacaggatatgtttatgtaatttattagtcaagagtaggtgtatttatgagtaggggataaaggtcagttttatcaggcaggagaagctgccactagtagcggtaataagtttagtgaaaggagaataagtaatccttggtcttgttggatttacagaaaaatgttctgtagtaatgaactctagtgacagctttccttttgttcagctctattcgggatcctactgacttcatccatgaatgttttaagacttcttataggtctcttacctcttttctctcagataaattagcattttccttagacattttttttttttttttgagacgaagtctcgctctgtcgcccaggggagagtgcagtggcattatttcggctcactgcaacctccacctcctgggttcagcgattctcctgcctcagcctcccggctagctgggattacaggtgcctaccaccatgtccagctaatttttttgtatttttagcagagacagggtttcaccatgttggccaggctggtctcgaactctgacctcaggtaatcgggattacaggcatgagccagtgtgcccggccctttagacagtttaaaaattatataccatgctaggtagcccttggacttttccccccttttgttcttccacctcttattccccactgagccctgaggagactgcaccattgaccatctctgcccctgcttctagctgctgagcattgtcctcttgctgcaatttactcccccatgtgcctaatacttatcttttacattctctgcagtatcatctagtcaaaacttgtacaatgaacttcaagtccaggtcctttcctgtctcagtttacctgtccagttgaccttactgcgtatttcatggtagagttcaagattacttgatttttccctcctctttattttatgatttttgtgttttctcatccttagcttcagtctcagagaaaagtactcatcctcctctccgaggctaatttctctacttatgtccttgatttcatcctcttttgtttgccttagacccttgttactctctttgttttatatcacaaataaaaacaaaacaacataatttccctgaattgtgtaacctacccaaactactttgttatctcttctttgcttccccaacaaccttcttgaaaaatgagtttgtattcagtgtcttagcttcctcaccttgtatacatttctaatatggtttggcttcttcacttatgctttcccaaaactgatgtctttaaggtcaccgaaagctttttttgtgtgggattacttttttattgaggtttgacaaatcaaaggttcattcagtccatgaaatattacagaatgagtacctgtatgatcacaactcacatcaggatggagaacattcccagtaccctagaatgctccctgtgctttctcctagcactactcttttacagatgtaacctccctcaccacctctgtcactatagatttgttttgaactaatacttcatataaatggaatcatagtgtgtactgttttgtgaccagattctttcattcggatcatgtcttgagactcatccatgttgttgcttgtagaaacagttctttttcattgctgtgtaattttccattgtatgaatgtattgtgatggttactaaaacttatttttgtttttgagacaggatctcactctgtcacccacgctggagtgtagtggtgccgtcatagctcacggcagccttgaactcccaggctcaagtgatcctcctgcctcagcctcccaagtagctgggaccataggcacataccaccatgcccagctaattttttaatttctttttctttttctttttgagacagagtcttgctctctcgcccaggctggagtgcagcggcacattctcagctcactgcaacctctgcctcccggattcaagcgattctcttgcctcagcctcccgagtagctgggattacaggcatgcaccaccatgcctggctaattctctatttttagtggagatggggtttcaccatgttggccaggctagtcacgagctcctaacctcagatgatctgcccgccttggcctcccaaagtgctgggattacaggcgtgaactaccacggcctaattttttattttttgtagaggtggtatcttaccatgttgctcaggctagcctcgaactcctgggctcaagtgattctcccaccttgacctcccaaagtgctgggattatgggcatgagtgcccagtttgtttttcaaattgaaatataattcatggctacttgtgaaaagttttcattgtgaaatagttacagagagaaatatgtaaaagtcctgggaacctttaaattactaaatctgatagtcttttcctcatcttgtctgacctctgtgaactatttgtcactgttgactgtgtgttccttgttgacatttttttcttttttaatattacaatatccattctgttactgcttctctaactgctctcttgtgtgtctttgtcttgtgttttctcttcctgttcctgaaatgttccttgaggacatgtcctctgtccttagcttgatcctttattgtgctctatttagcaggctcattctgtttgtagatgttgaggatgtagaacaagggtctgcagtcctctttatttatggcattgtgtcacagaacatccttgtaaagtgagctgagtctctttaggtgtgacctctttccttagctctacatttccatttttgtgcttaacatttccaccgtagactcatcatttgtgttcttaacatttgtgatttttttttttttttgagacagggtctcactttgttgcccaggctggagtgcagtggtgggacctcagctcactgcaaccttcgcctcccaggctcaagtgattctccagcttcagcctccccagtagctgggattgcaggcgtccgccaccacgcctggctaatttttgtatttttagtagakacggggtttcaccatgttggccaggctgatctcgaactcctgacctcaggtgatccacccacctcggcctcccaaagtgctgggattacaggtgtgagccactgtgcccggcctaacatttgtgagttttataatttgatagtgaccttgaaagttcataatttgtaataatttatgattttaaaaaggccaaaattttcattgtatgtgtcgagactggttgaattctatttatttgggtagtaagagcccagctgatcagcaarcatctacatctcacacgtaacttttttttccctttctcatgacatggaacagtgcttgttacagtttttattatactagtatttaagaatacgttctaatcaggatgtaggacttggatctccagaaggtcagtggtttactgtatcatgaaaatagaataatttctgtgttgaaatgtgcttctctctgtatctttcctttttgtcatccaacatgaaattatatccatggctttttttgtttgttttattttgagatggagtcttgctctgtcgcccaggctggagtgcagtggcgcgatctcggcttattgtaacctctgcctcccaggttcaagcgtttctcctgtctcagcctcctgagtagcgcatgcctggctaattttttgtatttagtagagatggggtttcactgtgttgcccaggctggtctcgaactcctgagctcaggcaatccacccgccttggcctcccaaagtattaggattacaggcgtgagccaccgtgcctggcccacatctgtagtcttttacttcttctcctttgactcccttagccagtctggcattaggttctctcgattctgccttcatgaaatctttcaaaccattattcccattgtcactaccttaatttcatatttataaactttagtcttggttgttgcagtatcttaactgtatttactcagtcttcagtctcttaacctctaatatatttcacgttctattaacaaaagattggaactcattgcctccctggctaatggtaagtgctttataaatactcgytaaatnttcatttcatttctccttattcatataccttcattagcttcttattacccatagaattaagcctgaagaccttggcattcaagatctacttgatacttagcactttttgttagaagagtcagttagttgccacttctcttggttccttaggaccgtctgcttttctcgatcatggcatacaatattaaaattatcttgtttctctcattagtaagttctttgagagtcagactgttccatttacttctgtatacctagggcttagtatagtacttgaaacatagttatttgtgtatttattagaaacatagatatttgctcaatgtcctaattgattgtaagtcagtcaaatgaattcctctgaggctgtcttaatcatcatggtatcttcagcctctagtattttaactggtatgtaatagacattcagtaagtaattgtttattgttaggcactttgatatactttaattagtcatcagtttgagaagctctttattctctgcttccgcatattaaaattctactcagttttccaggcctaactcaaatgccacagaaacttctgtgaggccaggtgtggtggctcatacttgtaatcccagcactttgggaggttgagcaggcgggttgcttgagctcaggagtttgagaccagactgagcaacatggtgaaaccccatctctacaaaaaatacaaaaattagtcggggttggtggtgcgcgcctgtgggcccagctacttgggaggctgaggtgggacccctggaagttgaggctgcagtgagccaaggttgtaccactgcactccagtctgggtgacagaatgagaccgtgtctcgtaaagaaagcaaaaaacaaacaaacaaaaaacaaaaacaaaaccacacacccaaaaagaaactcttctgcaaagttgtttttccacatgggatccttggaggatccttaattgggcttcaggaaatctgtgaatgtcctgaaattccagttctcaaaattctgtggtttaaaagtgaaagcttaggttccaagagatcaaatgcaaaaatgactggaaagcacataataagtaggtgcttaataagtagtcttatctcattttgtttctgtaacatattgtttgatccattcctggtcatataaagtagatgctgaataaatatttgctgaatgaaaggatgartcagtgttttagcactttcaactttctgtgttcatttgtatttcatttttgcttttaagttgcatgttattgaaggtaagaactatgtcatcattttgtctaacaatgcagagctaaaggctttgctcacaataggtgctcagtcattatttattgaatgaatgaatggagaatgattcaaatattttgaattttggtaatttgagtaataatggttatatgataggagtagacaaaggaaatagaatatttttgaggatggcagaagatgagttcaactttagttcctaaaataccctcagtgtgacagraattttaaaaaattattttaatggaaatcagaacctctttcctctgcattacagggttagtacattgggaaaagcatagggcagaaagcacacagaagggaagctgcgtaatatatatagggaactataatcggtttgttattgccagacccagagctttacgttgaaggtgtaaatgctaggttagagattaaagaagccttgattgttgagggtctttagtgtgatataaaaggataattggctgggtgtggtggctcacgcctgtaatcccagcactttgggagaccaaggtgggtggatcacctaaggttaggagtttgagaccagcctggccaacatgatgaaaccccatctctactaaaaatacaaaaatagccaggcgtcttggtgggcgcctgtaatcccagctacttgggaggctgaggcaggagaattgcttgaacccgggaggtggaggttgcggtgagccaagatcgcgccacggtactccatcctgggcgacagagcgagactccatctcaaaaaaaaaaaaaaaaaaaggataataagtaggggagcagtatattctttttttttttttttgaggcagtcttgctctgtggcccaggctggagtgcagtggcacgatctcagctcaccgcaacttccacctcccaggttcaagctattctcctgcctcagcctcccaagtagctgggattacaggcattggccaccatgcctggctaattttgtattttagtagagacggagtttttccatgttggtcaggctggtctcaaactcccgacctcaagtgatccacctggctcggcctctcaaagtgttgggattacaggcgtgggccaccgtgcctagccgagagcagtatatttctttttttttttttttttgagacgaagtctcgctcttgtctcccaggctggagtgcgatggcacgatctcggctcactgcagcctccccctgtggggttcaagcaattctcctgcctcagcctctcgagtacctgggatgccaccacgcccagctaatttttgtatttttgtattttttttttttttttttgagacggagtcacgctctgtcgcccagactcgagtgcagtggcgcgatctcggctcactgcaagctccgcctcccgggttcgcgccattctcttgcctcagcctctggagtagctgggactacaggcgcccaccaccacgctcggctaatttttttgtatttttagtagagacggggtttcactatgttagtcaggatggtctcgatctcctgacctcgtgatctgccctccttggcctcccaaagtgctgggattataggcgtgagccaccgcacccggcttttttttttttttgacacagagtctcactttgtcacccaggctggagtgcagtggcctgatcttggctcactgcaagctctgcctcccgggttcccgccgttctcctgcctcagcctcccgaatagctgggactacaggcgcccgccaccacgcccagctaatttttttgtatttttagtagagacggggtttcactgtgttagccaggatggtcttgatctcctgacctcgtgatccgcctgtctcggcctcccaaagtgctaggattacaggcgtgagccactgcgcctggcctaatttttgtatttttagtaaagatggggtttcaccatgttggccaggctggtctggacctcctgacctcaggtgatctgcccgcctcggcctcccaaaatgctggaattacaggtgtgagccaccgcgcgcggcacaggagcagtatattcttatttgtgttttagttggattactctggcaactgtgtggaggataggatgcaggacatgctgtttgagacatgagcatttgagaaatcttccgagttttcagtgcaaaagtttatttgacctcctttccctcttatccagggtatgggtaagggctagctcctaaaaaggtgttaactttgaaatatttagtttcatcaaaagtactgggagcagagagtctatggtggcttgaagcaggttggcaaatgttccctgatgagggtaggacacatgtgattacagagttttcccatcattgttctggatgtctcttggcctaaagatcaatctgtaagcctttttttttttttttttttttagacggagtctcgcactgttgcccgggctggagtacagtggtaccatcttggctcactgcaacctccgcctcccaggttcaagtgattctcctgcctcagcctcccagtagctgggattacaggcatgtgccaccacgcctgggtaattttgtatttttagtagagactaggtttctccatgttggtcaggctgtctcaaactctcgacctcaggtgatccgtccacctcggcctcccaaagtgctgggattacaagcatcggccactgtgcctggccctactcctatttttaatagtccgtgtaacattttcatttggatagctcagagacctctcaaacttaacatgtccaaaaatgaagtcttgattttcactttctagtctgcttcttccccagtctgcctcatgtcaatagatggcactactcatttaccagaacaaaactggaggttgtgtttgatttttttcttaaccttacctgtattccacattcagcccctcaggtctgtttgctgctacagttgtccctcaatatctctcggggattgagtacatgaccccctgcagataccaaactctggtatgctcaagttctatctataaaatggcatagtatttgcatgtaacctatgtatatcctcccatgtactttaaatcatctccagattatttataatatataatacaatgtaaatgctatgtaaataactgttacactctattacttagggaatagtgacaagaaaaaaatatctatacatgttcagtatagatggaactattcattttctttttctctgcatacagtcatgttccgcataattatgttttagtcaatgatggatgacatacaagatgggggtcccataagattattattattattatcattttttttttgagaccgagtcttgctctgttgctcaggctggagtgcagtggtgcgatctcagctcactggaacctctgcctcctgggttcaagcaattctcctgcctcagcctcccaagtaactaggattacaggcagccgccaccacgcctggccaatttttttttttttttttttgagacgaagttttgctcttgtcccccagtctggagtgcagtggcacgatcttggctcactgcaacctctgccttccggattcaaacaattcttctgcctcagcctcccgagtagctgggattacaggcttctgccaccacacctggctaatttttatatttttagtagagacagtgtttcaccatgttggccaggctggtctcraacttctgacgtcaggtgagccgcccacctcggcctcccaaagtactgggattataggcatgaaccactgcgcctggccagattataatttttttattaaaatttttttttaaatagagatgaagtcttgctatgttgcccaggctggtcttgagctcttggcctcaagcaatccttctgccttggccttccaaaatgttgggattataagcatgaactattatgcctggcttcccataagattataacagagttgaaaaatttctattgcctagtgacatctagctattacaacattgtagtgcaacacattacatgttcatggtaatgcctgtgtaaaacctactgcactgctgtggtataaaggtacagcacatagagttagtgcatgcacagcacataatacctaatgatgataatatacaactatgttacttgcttatgtatttaccatactatactttctactgttattttagagtgtacccctacttattaaaaaaaaaagttaactgtaaaacagcctcagacaagtccttcagtgtaattccagggaaggcattgttaccataggagatgacagctccatgtcacctccattattgctccattattgcccctgaataccttcccatggaacaagatgtggaggtggaagacagtgatattgatgatctcgaccctgtgtaggcctaggctagtgcgtatgtttgtatcttactttctaacaaaacagtttaaaaagtaaaaaaagaaaatttttttaatagaagaaagcttatataataaggataatgaaagaaaatattttgtataatgtaaacacatacaccaaggcgggtgtatcacctgaggtcaggagtttgagaccagcctggcaaacatggcaaaaccccgtcactactaaaaatacaaaaattagcccagcgtggtggcgcacgcctatagttccagctacttgggaggctgaggcaggagaattgcttgaacccgggagttggaggttgcagtgagccaagatcacgccattgcactccagcctgggcgacaagagcgaaactctatctcaaaaataaaaagaaaaagctatcttgacctttgatttgttggtgttattaaactgttcttttattttattcagcttgaaaggagactttaatttgtgcattttccccttcagggaaacttttatggatttttttattaagtaactggcttagaagatagaatagtctccctaggttttagaatgtaattaagaaaaattcagcccaagggaaccatgtgttaaaattaggtgataccatcttagttgtaccagcttgagtgtaggttccttaagagtgaacctgagtagtagatgcatatatcctttaaccattaatttgttggagattaataagctacatcgtttctttgccgttatttcagcaaagcagaagtaatatagttttgtcagatcttctttttttttttttttgaaactgtctcccagtctggagtgcaatggcgtgatctcggttcactgcaacctctgcctcccaggttcaagtgattctcctgtctcagcctcctgagtagctaggactacaggcacatgccatcacacccagctaatttttatgtttttagtagagatggggtttcaccatgttgggcaggctagtcttgaactcctgacctcaggtgatccaccctcctcagcctccctaagtgctgggattacaggtgtgagccaccgtgactggtcagactttctatctgttaggctttcaggaatgttttgaaaagcagaggatttagaaatagttgttaatagtttttttttaaagtccttaagttatttcataggggtgttaccaaggtgatttttgtttaaatgacccaggaacatttaagttctacctttaaccagtaagagaaagtgatactttgtgactagctcagtctttggtcttttatattaaagaacattacttgctgtaactgattcacaaggaccccttgattgaggtgcttccattttctacacatggcttccaagttcagctgaggaaagtggaggatgggccaatcctagaaatggattaatcacttccactcatattccattgccagaactcagtttcagggccatgcctaactactggagggctgggaaatgtcatgtggcctgtgcctaggaggaaggtgaatcatgcttgatcaacatctaactagtccctgccacaggactcaaaccccaatgtagtccttagcttagaaccatacagaaatccatttattttggttatagacagcctggaaccatagcctcctctttttccttgtagacacacagagttttgagttataacaattttgaatgcaagtaaaggcctttttcccaagcacagataggagatctggaaaagcttttctgcagcctgtggcagaggtagtctctggcaaccccaagaaaggcagcttggtattgggggtgggggggagagagagagagaaagagagagagagagagagagagacccaagtcccttcaaatacctggaaagtcttcccaagaataacagatgcaaacaagcccagatcgcaaaggctacaatgtatatttaactcttcaatgcccagacactgacaaatacccacaagcgttaagaccattcaggaaaacatgacatcaccaaacaaactaygtaaggcaccagggaccaatcctggagagatagagatacatgacctttcagacagagaattcaaaatacccattttgaggaaattcagagaaatacaggataacacagataaggaaatcagaatcccctaaggtaacttcagcaaagaaatggaaataattaaaaagaaccaagctgaaattttggagttgaaaaatgcagttgatatactaaggaatgcatcagagtcctttaatagcagaactgattaagcagaagaaagaatttatttatttatttattttttgagatggagtctcgctctgttgcccaggctgtagtgcagtggcgtaatggctccctgcaacctctgcctcccaggttcaagcgattctcctggctyagcctcccaagtagctgggattacaggtgtgtgccaccacacctggctaatttttttgttttttagtagagacggggtttcaccgtgtcaaccaggatggtctcgatctcctgacctcgtgatccacctgcctcggcttcccaaagtgttgggattacaggcgtgagccacagtgcctggccccagaagaaagaattagtgagctcraagacaggctatttgaaaatacacagccagaggagacaaaagaagaaaaagataaaaaggaataaaaagcatgcctacaagatctagaaaatagcctccaaaaggcaaatctaagcgttttggccttaaagaggaggtagagagataggggtagaaagtttatcgaaatgaataacaacagagaacttcccaaacttagagaaagatttctatattcaagtataaggttctagaatgccaagcagatttagcccaaagaagactatctcaaggcatttaataatcaaacttctaaaggtaaaagatgaaggatcctaaaagcagtaagagaaaaaacacaaataacatacaatggagcttcaatatgtctgggaccagacttttcagtggaaaccccttacaggccaagagagagaggcatgacatatttaaagtgctgaaggaaaaaacttctaccctagaatagtatatctggtgaaaatattcttcaaacatgaaggagaaataacgacttcataagacagagaagtcgagtaatttcatcaacaccagacctgtcccacacaaatgctaaagggagttcttcaatctgaaagaaaaggatgttaatgagcaataagaaatcatctgaaggtacaaaactgactggtaatagtaagtacacagaaaaacacagaatactatattaataacaataattatggtgtataaacgactcatatcatgaaaagatgaattgatcaagaataataactacaacaacttttccagacatagtatggtattaggttgttgcaaaagtaattgtggttttggactgtgaattttaaatcattataactaggctcaaacacatctttattaatcaaaataggaaccattacaatcaacacattttcgccaatgagaaatgtttgttcttgttgtgtaaaaatccatgctttgggatttgacraactcttggaaagaatgttctgcatcctgctggtcatggaaatgttttctctgcaaaacgttgtcgagatgcttgaagaagtggtagttggttggtgagaggttaggtgaatatggcgggagggaaaacttcatagcccaattcgttcacttgttgaagcttggttgtgtgatgtgcagttgggtgttgttgtggagaattgggtcctttttgttgaccaatgctggtgtcaggcgttgcagtttttggtgcatctcattaagattgctgagcatacttctcagatgttatgctttcactggggttcagaaagctgtagtggatcagactgacagcagaccaccaaacagtgaccgtgacctttatttgatgcaagtttggctttgggaagtgctttggagcttcttctcagtccagccactgagctggttgtcacaggttgtcatataaagtccacttttccttgcatgtcacagtgtgatcgagaagtggttcattgttctgtagaataagagaagatgacacttcaaaatgatgattatttgattttcactcagctcatgaggcacccacttaacgagctttttcaccttttcgatttgcttcaaatgctgaatractgtaggatggtcgatgttgagttcttcggcaacttcttgtgtagttctaagagatgattgctcacaattggtcgttgtgaacttccgatggtcggccactacactcctcaccttcaaggcttgcctcctttgcaaaactttttgaaccaccactgcactgtacagttgttagcagttcctctccaaatgcatygttgatgttgtgagttgtctcctttgctttacgacccattttgaacttattcaaaaattgctcatatttgctttttatctaacttcattcccatagtctaaaacataaacagcaagtaaataagtctctagccaaaaaacataaaaaatgaacattaaaatgatgtataatataatgacatttatttaagaatgtattccaagaccgggcatagtggctcatgcctgtaatcccagcactttgggaggctgaggtgggtggatcaccagagttcaggagttcgagaccagcctgaccaacatggtgaaaccttgtctctactaaaaatacaaacttagccaggcatggtggcacacacctgtaatcccagctacttgggaggctgaggcaggagaatcgcttgaacccaggaggcagaggttgcagtgagccgagatcatgccattgcactccagactgggcaacaagagcaaagtctgtctcaaaaaaaaaaaaaaaaagaatgtattccaatatcagatgacaaattctaatcatgcaaaccaccgcaattacgtttgtaccaacctagtagtactggaagtcttaactatggtaattagacaagaaaaagaaataaagggtatccaaattggaaaagaagtmaaattatccttgtttgcagatgatttgatcttatatttggcaaaagcttaaagacttcaccaaaaaactattagaactgataaatttagtaaagttgcaggatccaaagtcaacacacagagatcagtagtgtttctgtatgccaacagtgaacaatctgaaaaaatcaaaaaagtaaccccatttacagtagctgcaaataaaatacctagggattaaccaaagagatgaaagatctctctaatgaaaactattaaacactgatgcaagaaattgaagaggacattaaaaaaatgaaaagatatttcatgttcatggattggaaaaatcactattaaaatgtccatagtacccaaagcaatctacagattcaayacaatccatattcaaaataccaatgacattctccacaaaaatagaaaaaacaattctaaaatttacgtggaaccacagaggactcagaatagccaaagctatcttcaacataaagaagaaaactggagaaatgacattacctgacttgmaatgatactagaaagctatggtaaccaaaacaacatggtactgacataaaaacaaacagagaccaatagaacggaatagagaacccattaataaatccatacatttacagtgaactggtttttgacagaggtgccaagaacatactttggtaaaaggacagtctgtacaataaatggttctcggaaaactggaaatctatatgcagatatctacatgcagaagagtgaaactagatccctatctcttcccatatacaaaaatcaaaaatgtattaaagatttaaatcttaaactgcaaactctgaaactactaaaagaaaactttggggaaacttgctaggacattggtttgggcaaaaatttcttgagcaataaataccccacatgcagaggcaaccaaagcaaaactggatcaaggggatcttttctcacttccttttgtgtgtgttttttagaatttttttttggttgctatggggattacatgtaacatactaaatttataacagtctagtttgaaatggtaccagtttaacttctgtagtatacaaaaactttattcctgtatagctccatttccttgataagttgtttttgtggcagattacatctttattcattgtgtgctaaatatcatagatttataattttttaatgcttttgtcttttaagtcatatagggaaaaaaggtggagctgaaaaacaaaaatagaataatactggctgtgatatttgtccatatggttacctttgctggggatctttattttttattttttggatcttcattttttcagatggccttaagtttctgtttagtgtcctttcatttcaacttgaagatgccttttaggatttgatgtagaacatatgtagtggtgatggactctgtctgctttttttttttttttcttaatctgaaaatgcctcgatttcaatttctctttctttctcttttttttttttttttttttttttgagtcagagtcttgctctgtttcccgggctggagtgtagtggtgcaatcttggctcactgcagtgttgacctcctgggctcaagcaattttcttgcctcatcctcctgagtagctgggaccacaggtacatgtcaccatgcccagctaacttttatgtgttttgcagagacagagtttcgccatgttgcccaggctgatctcaaactcctgggctcaagcaatctccctaccttggcctcccagagtgttgggattacaggtgtgagccactgcacccagcctttattttttcctcatttttgaaggacagttatgctcaagatagaattccgtatgtcatcctactcacttctggactccacagttctgatgaratatgarctgttcgtctgattcaggatctcctgtatttgacaagttgcttttctcttgctgctttgaatattatttctttgccattggctttgacagtttggttatcatgtgtctccatatgaacctttttgaatttaacctgcttagaagtcacggagcttcttggatgtgtagatttgtatctgtcatcacatttgggaagttttggtatgttatttcttctttttttttttttttttttttgagacagagtctcgttctgttacccaggctgaagtgcagggcaggatcttggctcgctgcaacctctgcctcttgggttcaagtcataactgtgcctcagcctcccgagtagctggaactacaggcatgcaccaccacgccagctgatttttgtatttttattagagacggggtttcaccatgttggccaggctggtctcaaactcctaacctcatgatctgcccgccttggcctctcaaagtgctgggattacaggcgtgagccatggtgcccggcctcttcacatgttcttactgcccccttctcttctagaattcccatattcatatattgtttcaccttcaccttttttttttttttttttttggtgacagagtgttgctctgtcacccagcctggagtgcagtggtgtgatttctgctcactgcaacctccacctcccaggttcacgcgattcctgtgcctcagcctcccaagtagctgggattacaggcacgtgccatcacgcccagctaatttttgtatttttagtagagatggggttttgccatgttggccaggctggtcttgaactcctgacctcaaatgatccacccacctcagcctcccaaagttctgggattacaggcatgagccaccgtgcctggctattttcagygttttaatcttgatgctgcttagtgggtctgttcaatttgtgaaaattcattgagttctatgcttaggtatgtgtacttttctaaaatgagtaatgtacttcagtaaaagttaaaaatcctagcttaaaagttcaaatttcatatttaatttatatttcctttcctttgccaggttttgactcgaagagacttgcagtaagaaggggtgtgatcctctctttcttttctcctctcctctgttatctggtttctttactttggtgtcttgtgggaaggaatagggaaattgaaaagtgtatgtgtttctcttaattggtactgatcaaattctttcttgattgttctttctctggctaagacggattattcatccatacagtgtagcaggcatccaaatgctggttctcccatgcagctggttgtaagtttttttgagataggatctttccctctccacattgtcttcatagaggatatccacyttagcttgatgtcttccaaggcctcctcagttctctctacctagagcttcttgctgtgcttgtcacctttgtgagtggccaaccctctttaatggattaccagcattagtccaaagtctgcttccttccctggtttctccttgatccataggtactgtttcatccttgacatgccaaatagtgcaaatacaagctgttcccttgctaccttctgtttttgcattaagttctatttcctgttccccgtctcactgctcagtcctgctacagttaggtgcctggacacatcaattgtttgattcagtgccacaatatcctcctttatccttttattcacttaccaccatgttttgaaattgtctttttcttcttttcaggtatttttcttcaccaacttcactcttctttttatgtttgggcatttgtaaatcatgttttggatagtcaccaccaaccaatattagtacttacccatttttttgaactcactaatsacaatatataactgtatagaatttttttcttttttttttttttaatcttagagaactggaaatttcctccttttttgccccttgtggcttttagtattgctatggtgccagttacttgaagcttgtttttcaaatggcaggtgacatggggtcagttattctcttttttttttttttgagacggagtctcgctctgttgctcaggckggagtgcagtgacatgatcttggatcactgcaacctctgcctcctgggttcaagcaattctctgtctcagcctcccgagtaagccggggttacaggtgcctgccaccacgcctggctaayttttgtatttttagtagagacagggtttcatcatcttgaccaggctggtcttgaactcccgacctcatgatccacctgcctcagactcctaaagtgctgggattacaggtgtgagctactgtacccggcccagttattctctaatggttcttgtctctgtactgtctagatcagtttgatgtgttacttatctgtatttgttacagcttccttcattgacatataatagatatacctcatygggctgatttttttcgaaagtttcttatttattataatactcctgattaggtgggtgttggcttaaaaatgtctacatgttgatgatattattggacactgcttactgaatgaggagaaagaggtgttggagtggaatgggaaggttctgtcaatgttttgtattgcctgtattttctgatagtacttttatactttgaaaacctgtatttagctcctcttataggcatataaagaaagctctaatattaattttagcattaattgaatgttagagatatttctgactttatatgccaggtaaagtctaccatttaatgattttttttaaactaaaatatgcttttctttattggatataggaagggtatgaataaaaggataaacataaataaacttaactaagaagtgtactcattatgaatactatatcctgtcaaaatgtctgtcatcccatgacctttctcacctatttttcctttggcattttaataatcaatatcctgtgtcctttacagcatacctagcttttactaagaaatatgtttctggttttagctatggagggggaagtataatattttggcacttttaaattgtagtgaatgctgtagagatgtttaatataaagtttttatacttcagaggagatattaaagactcatgttttactctttttctctttgaaggatgtagtaactggagttagtcccctgctcttcaggaaactcagtaatcctgacatattttcatccactggaaaagttaaacttcagcgacaactgagtcaggatgattgtaagttatggagaggaaacctggccagctctctatcgggtaaatatctgattttgttgttttaagaaatgtgggaccatgtggtcaatatttaagtgtatattaattgaattggcatcttgacagtttcttctctggtagtagtcttgtatagaacatttatggtaaggctgtcttcctctccttacttcttcctcatggaatctctgattgctaacctgtaggacctgatagatatttcttggttgatcaccactagtggtmactctctcttactctgatttttgctctctgcctatttctgtaaactttatattctttgcttctgtagattttcttttttccttcattctcaaaacctaaaactcatagtgrcctctaccgccttcaaagaaaagacttaaaaaattcagggggawaaaattatacgaagaagtcacagtacaaaaggaagcaattacattgtacattgtggcataattcttttctttcctttttttttgagatggagtttcgctccgtagcccaggctggagtgcagtggtgtgatctcggctcactgcaagctccgcctcccggattcatgccattctcctgcctcagcctcccgagtagctgggactacaggcatccgccaccatgcctgtctaattttttgtatttttagtagagacggggtttcactgtgttagccaggatggtctcgatctcctgagcttgtgatccgcctgcctcagcctcccatagtgctgggattacaggcgtgagccaccgcgcccagcctcttatatttaaatttttatttttgctggtcatatatttagttacatagagccatttcttgtttgktttttcataacattctcctctttttttaaaaggatgcgattatcttctctttttttttttgagacagagtctcactttactgcccaggctggagtttagtggcatgatgtctgctcactgcaacctctacctcccaggttcaagtgattctcctgcttcagcctcctgagtagctgggatcacaggtgcgcaccaccatgcctggctaatttttttatttttggtagagacagggtttcaccatgttggccaggctgctcttgaactcctcacttcaggtgatccgcctgccttggcctcccaaagtgctgggattacatatgggaggtgagccaccacgcctgcctgggatgtgattatcttctgattgtcatgagtaaattagattttttatttaaaaatgtggctgggtgtggtggctcacgcccgtaatcacagcactttgggagaccaaggcaggcagatcacctgaggtcaggagttcaagaccagcctggccaacatggcaaaaccccgtctctactaaaaatacaaagattagccgggcatggtgatatgtgtctgtgatcccagccactccggaggctgaggcacaagaatcgcttgaacctgggaggtggaggctgagtgagcatcattacactccagctggggcgacagagcgaaactctgtctccaaaacaaagccaaacaaaaaaaaagtaaagttttcttacctggatcagctctttcttttgagcatctaacaaccagaatattcagtgttttgttctaaaatgctaaatcccttttatcctgtgaggtaattgcatggctgccgggtacattgttgaaatgtggttgtgtttgactgttctttctatggaattttccatttatctgattgcagctcgtgtcttactttatgacttttggggtgcttttcatttctgagtgcttagtctaagagtttgcagggcagatgatacctcacttttttttgagacagggtctcctctgtcgcccaggctggagtgcagtggtgtgatctcagctcactgcaacctctgccttctgggctcaagtgatcctcccacctcagtctcttaagtaggtaggactacaggtgtgcaccaccacacccagctaatttttgtatttttagtagagagggggtttcgccatgttgcccaggctagtcttgaactcctgagctcaagcagtccttccttggcctcccaaagagctgggattatagacctgagcaaccaggccaggccagatactccacttaattgcaatcccctccatgyttactatagcttatacctttctttgccyagttgcattggttacagtccatctatctgctttagatttccccacagttttttcaccccctcattatcagtgtctggctgtttctgtcattatggcctttgtttgcttactttttatttttatttatttatttatttttgacggagtcttactctgtcaccaggctggaatgcagtggcgcgatctcggctcactgaaacctccgccttcctggttcaagcgattctcctgcctcagcctcccaagtagctgggactacaggtgccatgccaccacacccagctaatttttgtatttttagtagagacggggtttcactatgttggccagaatggtctcaatctcttgacctcgtgatccgcctgcctcggcctcccaaagtgctggaattacaggcgggagccaccacgctctgcccaggttacttcttttgtctcatttttatggtgtttcctggaggacaaaagataaaagcatgtgcttggtctgccatctttaactgagaatgttttatgcattagcctcttgaattattataagaatagtaattagaatttttaagaggttttctttttttctgtgttatttatttactaaagagctgcttgttattctgtttgtttatgttgttccttccgttttatttattttcctcaagttcttggcagtctgcggtatgcttcagtctttactggtgtacagagtcaaataggtttcttctacagtgtgtaagcctctttcccaacaggcctttattttgaagagagagatgatagtaatctttgtgtaaataggataagttaagctgacttccctttagaattaataggtgagaagtaggcaggtcatctggagaaatgcacatttgcagaatgaaggaaagaaggcaggcaggctctactctgggcttatggaagttttgagcagaacaccatcatcatcatcattattttttttttatggagggctttatggaaagactttccagtaaaaggtacatttgagacttgaaaacttaactagattttaaaagtatattgtaattttctagtaaaacatgctagttataaaaaatgtcactacaaaaacatgcattatgtcaaagtgaagtctttcctttttttaaattttttgagacagcttctcattctgtttcccaggctaaagtgcagtgacatgaccatgcctcactgaagccttgaccacctgagctcaggtgatcctccccgcttctcctcagcctcctgagtagctgggaccacaggcacacaccaccatgcctggctaattttttttttttcttggagatgaggtcttgctatgtagcggaggctggtcttgaactcctgggctcaagtgatcctcctgcttcggcctcccaaaatgctgggattacatgtgtgagccacaacacctgtcctgaagtctttcttaatttttactttcttctatgtcttaattttcttctgtggttagctttgctaaattgttctccaaatgaattgtatcatattttgttggcagcaaaaacaaaaatatcccccaagccctttcttaacatctttactacattgggtattttcatgactaagattttaccaggcacagaaaggattttcaagtgagttgagtgatcatgataaagccaggggaaagtgcagggcataatattgaagttgagtgagtgaataagtgtggaaaagagtcgaaggagatgagaccagaaagataatctggatttatggagggtctttttcatatgccaaaatgtctggcataatatcttcaaatagtaaggagccatcagaggcttttaaggaaggaaatgacatgaacacatttttgttggttagatcacaagcaaaagtgtgaagaatggtgggaagaaggggagaaatgagaccttcacctcatttataaagtcattgcaggtcgggcgtggtggctcatgcctgtaatcccagcactatgggaggccaaggcgggcacatcacctgaggtcaggagttggagacccgcctggctaacatggcaaaaccccatgtctactaaaaatacaaaacatgagccaggtgtggtggcgcatgcctgtagtcccagctactcaggaggctgaggcaggagaatcgcttgagcctgggaggcagaggttgcaatgagctgagatcacaccactgcactccagcctgggcgacagtgagtgacactctgtctcaaaaaaaaaaaagccaaaaaacaaaaatcattggaattccctatacttggtctttataagtgactctctttcattgagattaaggcagacagtaaacctgaactgagcacatggagtctagtgagagcagaataggttcattgtttgcctgctggaaacttgcatctctaatgttacattgaggtgatgagaaactatgtaggctagaagggattggaaaactcctagactgctagtttgggtgttagagtgggaggctggcatgtggtgaatattatagagaacataaaatagttaatccatttcagtgttccacttgccattatcatcaccaccaagacagtcacaatttttaatggatagttggaaattttaatagattctaaaatggatgtgaacaattttactttgtatcagtatggttttatccacttgatatcactgtatttgtattttttcatttgtttatcaataaataattacatgtatattttccaaaccttgtatttgaaggtaagcagctgctccctttgtccagcagtgtacatagcagtgtgggacaggtgacttggcagtcgtcaggagaagcatcaaacctggttcgaatgagaaaccagtcccttggacagtctgcaccttctcttactgctggcctggtaagtgttcataaaggtggcattttgctctatgaaaaatccataattgtcatttgtcattgcaacatctattctttttcctttttaggatttggagaattcagtttcccaaaatgaagtatggaagagaatgaatttattattattttttttagagatagggtcttgctttgttgcccaggctgacttcgaactccttggctgtagtattcctattgcctcaaccttccaagtagcagggactacaggtacatgtcatggcatcaggctaagaatgaaatttttttttttctttttttttttgagttggatttttgctcttgtcacccaggctggagtgcaatgatgtgatctcacctgcctcctgggttcaagcaattctcctgcctcagccttctgagtagctgggattacaggtgtgcgccaccacccctggctaatttttttgtattactagtagagatggggtttcactgtgttggctaggctggtcttgaactcctgacctcaggtgatcctccctgctcggcctcccaaagtgctgggattacaggtgtgggccaccactcccggccttaagaatgaaattttaattgaatcttttttttttttttttttttgagatggagtctcactttgttgcccaggctgtagtgcaatctcggctcactgcaacctctgtctcccaggttcaagtgattctcctgcctcagcctcccaagtagctgggattacaggcacttgccaccataccccgctagtttttgtgtttttagtagagatggggtttcaccacgttggccaggctggtctcaaactcctgacctcatgatccacccacctcagcctcccaaagtgttgggattacaggcttgagccactgtgcctggcccaattaagtctattttgattgccctctcatgctgtcagtgtcactggtactaattgtatagtgagggtcaaggaaaagattctgtaaggttgtaacttcaatgagtaaattttcctgggaaagaacattctttttatagaaatgattctaaatctggtacagttgtgctgctttggtttacagctctgtggtatacatatttagtacatgaggacagggaacttgtttggcacatcatgggtacttaaagtatatgtataagaatgagggccgggtgcagtggcttacgtctctaattcctgcactctgagagtctgaggcaggaggatcgcttgagcccaggagttcaagactagcctgggcaacatagttgagaccttgtctatacaaataataataatcataaaaaaaaaattagccgaggatggtggggtgtgcctgtagtcccagctactcagaaggctgaggtgggataatcgcttgagcctgagcagttgaagctgtagtgagttgtgattgtgccaccacactctggcgacagagtgagaccttgtctggaaaaaaaaaaaaaaaaaaagccttttgtttgtctaggctttgtgtgataggcagggccttacaaaattaaagctgtgtagcctgggcaggttgctttgtttctgcctgttgttacaaattatacccttttatcctcaaacttgcttttgtaccaaaggcacccactggctttctgctcatctcacactgttccctctatccttaggtctaggcacctactaatttgtagggtacaataacagaaacttgttactattaaagtctcatctacacttgaagatataagccttttgggtcaacatatgtggagtagaaagttttgtccatttgttcaatatgggaagtgggagtagcggggaggatgtctttgtgtagcaggtgggaggctaatttttggatcaaaggatatcctgataayaccgaagtttgtgattctcaggccacagagagaatcaggatcatttgtgaaaattcctacctccttaattttttattttgaaattttgaaatctgcagaaaaatagacagaatggtacagtgaacacccatgtaagttttacctagactgactaatttgtacattttttccatatttgttttttctgtgtgtatatatgtatttttttcctgaagcatttcaaagcaagtcacagactaattacgatacctcatccttaagtatttctcctaaggtgaaggatactctcctaaataactacaatatatgaccagatctaagaagtttaatasttttttttttttttttgagcctgagtctcgctctgtcacccaggctggagtgtagtggtgtgatcttggctcactgcaacctctgtctcctgggttcaaatgattctcctgtgtcagcctcccaagtagctgggattacaggtgcgtaccactacacctggctaatttttgtatttttagtagagatggggtttcaccatgttggccaggctgatctcgaactcctgacctcaagtgatccacctgcctcggcctctcaaagtgctgggattacaggcgtgagccaccgcacctggccacatcattttaatagtaacatctaataatgtgaagaccatattgagattttcctacttggtcccaacatgtctattaaagcctcgcctgcttcccttttaacctctggaacctaaaacaaacaaacaaacaagcaaaaatggatgagtgtaccctcctagagattttgatccagatgtctggggttagtcacaagcatctgtgttttcttttcttttctttctttctttytttttttttgagacaggttctccctctgttgtccagtctggagtgcagtgtcatgatcttagctcactgcaccctctgcttcctgggttcaagtaattctcatgcctcccgagtagctgggattacagatgtgtgccacctcacctggctattttttgtcttttcagtagtgatggggttttgccatgttggccaggctggtcttgaactgctgcctcaagtgatccaccggccttggcctccctaagtgctggggttacaggtgtgagccactgtgcctggcctgtattttctttaaagtgttaccctgattctaacaacgtacttctttgagaactactgccaccatgatacagctgaatattccactttaaggtggtatgttgcagaagggattcccggactgaggttactggaacctaggccaagtgagctagaatattcctgaattaagttttttttaaattaacagtttattgagatataattcacatatgatataattcacccacttaaagtatacaggtcagtattttttggtgtatttcacagacatgtacagccatcactgtagtcaatttaagaatattttctttactttagaaactgtactcttcaggtatcacctcctcattgttccatccctaaccccgcccccacactaggcaaccactaatctactttccacctctataggtttgcctattctgtatttttcatataaatcaaatcaaatatgtggccttttgaatggcggctgctttcacttagtctaatgtcttcaagattcatccatgttgcagcatgtgttcctttttgttgccgaatagtattttgttgtatgtatatatcatgttttgtttagctgttcatcagttgattcatttccttcattcttcaccttcattttctaatgtttattgagaggatttatctgagggcttatttttcccatatatgtagaaatcatgatcctaattagtgattaccagggcatgttctaaaaaggatcatacaatcgtatcattatatgtgcctagggatggaggagaacttaggtggaatattgttcaagattagttcttcttcttcttcttaaaaaaaaattacatagagtgaaaatctgttgttaaaagtgggttgtttctgccttttggctattataagtaatattgctatgaacattcatgtacaaattttaatgtagatatatgttttcattcctcgtggatatatatctaggagagaagttgctgagtcatatgataactgtatttaatcatttgaagaactttgatttctctacatccttgctatcctggtgggtgggaagtgatatcttgtgtctttgatatgcatttctctagtgactcatgatgttgagcatctttcatgtgcttaccggacatttgtttgtcttctttgaagaagtgtctatttggattattggccatttttaaaattgaatgtttcttttattgtaagtttgtaaaataattgtttctttagacctgaatccaatttcttctctttcccagggaactgctttttgttttctcttgtgctttttttttttcctgagctacttatttacctactgtaacttcaagctagctcttctcttcccattctcccgcctaaagattttcagttgaatattttatgttaggtggcacatttgctagttggtattaaatacctatttctgctttgaccacccatactggaataaacctcagtgtctaccctgcttctggctgtgacatttctgaaaaatcttaactagaatgtattctctttggagtaacggccgtctatagtacatggacccagcctccaaagaacttttgggttagcagaacaggattcacatataataggacaactatttaaaaataataaaacatcacatttaaataaatattgtattgatttttatttaaatagtaacaaaagggggcaagaattatactagttataattattggaatgataactggtaggaggttagacttgaccagagtctggagaatagataagcaaaagccttaaagttgcaaatatttccattttgaggccatctagatgatgtttttatgaagagatttttggactcttcattttctgatgtctattgagaggatttctcagaggacttattttccccatatatgtaggaaccatgatcctaattagtggttcccagggcatggtctaaaacagatcgtagaatcatattatttattatatgttcttagggatggagtaaaacttagatagcgtcttgttcaagattagttattatttgtattcttaaaatatatatacagttaaaatctgttgttaaaagtggcataggagaaagacccctgcattagaaatcagaagaccaagctctgatgctgctatgtgaatctgaataaacatactggagcctatgttcttctcatctgtaaaatgaggtcagttcctgctttgctttctcctgagtatgttaactagtatctgcagttttgatctttgccttctgtatctctgatgtaaatccacttggctgtatcaccattctaagactcaccctacctgtctactgtctttccatccgcccaagccagttcttccttgttcattccctgtctttttttttttccataattgaaattttattggtagtgttgaggatcagtacacagacatttccatttgtacacagttcttaacatatctactggaaatctaaaaagccatgtattgtatttgttttttaaacagttattccagtgactttccagcttaaaatttggaggcaaattttccttaggaggccatcaagtatcctaaggaaaataccagtattgtcaagtgttacatacatcctaccaatctaccagttcacaagttagtagtatatatactacatactcaaattttcaatctttcgcatcacattaacaaagttatcaggaaagtaagactactttgactacagatgttacagagtgcacacagttctgacagggagagccatgatcaaggagtgattttcgttagaaaacaattctactaaaaaacagtgtgagaatagaagtaatctaaaatgttcaagtcatgattaccaataaccattctaacatgatactgtgattatagcaaactgctataatcttaaactgaattgggaatatttctaaccagaacaaaagatrtgatattctgttgaacattttatcatcagttctcatgttgaatatgatgtcattttgggtgccatattattattgaattttgttgagatgagattttcagataacataaaattaaccattttaaagtgtacattttagtggcatttcatgcattcacaatgtgtgcagccatcacctttatcaagttttaagacatkttcaccaccatcccctgcaaaaaaaatcctctacccattaaacagtcattattcattccaccctcattctagctagggcaaccactaatctgctttttgtctctgtggatttacctattctaatatttcatataaatggaatcataaaatatgtgcccttttgtgcctggcttttttcacttagcccaatgctttcaagatttttctgcattatagcatgtatcaatactttattccttttttatggctgaataagattctgttgtatgggtaaaccacacttttatccgtttgtctgctgatagacatttgagttgtttccaccttttagccattgtgaatagtactgctgtatttgtgtacatgaatttgttttgaatacttgttttctgtattttgggtatgtacctaagagtagatttgttggatgatacagtaattctttgtttaactttttgaagaactaccacacttttggtttgctacaccattttatattcttcccagaaatatatgagggttccagtttcactgcatccttgccagtacttttctgtgtttttgattatagccatcatagtgggtgtcaagtggtgtcttattgtggctttgattagtattatattttaataatattttagaactgtctgttgaggtcacatggagtatgctgttaaaggaaataacaaaactccaagacttttcttagaacctagaaccttttctcatcattaaaaagattcttattttaatttatattattttagttgaaaagtaatcccatcattcttaatttatttttccttaattttcacgagttcaaagaggaaaaacccatagacgtttgttttacctacttcagtattataaagagattccaaattcagcacttcccctttcagtattacctttctgctgctgtagttttgcattttctactgtgaaaggtggagatatctatatctatatgtcagttggctttattgaggtataatttacatagaataaaattcacccgttttaagtgttcagtttgatgacttttggcagatgtatacagttgtgtcaccaccaccacaattatgatatagttatataagaattatggtatagaacagaacagcattccccaacctttttggcaccagggacgggtttcatggaagacagtttttccacagatgggtggaggggggatgggaggtggtttcaggatgaaactgttccacctcagatcatcaggcattagctagattctcatgaggagcgtgcaacctagatccctcgtatgcgcagttcacaatagggttcatgcccctacgagaatctaatgctgtgctgctgatctgacaggagacggagttcaggcggtaatgctcaccctcatacagctcatctcctgccatgtggcctggtccctaacaggccatggacctggtatagaatatataatgctcaccctcatacagctcatctcctgccatgtggcctggtccctaacaggccatggacctggtatagaatatatctgccaccccaagttcgcttgtgtccctttgctgtctgttctctctccccaggcccagcctttggcaactactgatgtgctttttgtcactgtggttttgccttttccagaatttcataggaatggaatcatacagtatatagtcttttgtgtcttttttcacttagcataatcctcctgagattcatccatgttgttttgagtatcaatagtttgttcctctttattgctgaaaagtgttccattggcatgggtatatagacttttccattccctagttaatgaccatatgggttgtttccagtttttgcctgttagagagagagctgctgtgaaagttcatataagtttttttgtttttgttttggtgtggaatatgctttatttctctcgggtaaatacctaggaatgaaactggtggaatgtatatttaccagtgtaaatttatctttataagaaactgccaacctgttttctaaagtggctataccatttttgcatttccaccagcagttgctccacatcttatcagtactaggtattatcatatatttttttttgagatggagtttcactcttgttgcccaggctaaagtgccgtggcacaatctcggctcattgcaacttccacctcccgggttcaagccattctcctccctcagcctctcaagtagctgaaattacaggcgcacgccaccacgcccagctgattttcgtatttttagtagaggtggggtttcgccgtgttggtcaagcttgtctcgaactcctgacctcaggggatccacccgcctcagcctcccaaagtgctgggattacaggtgtgagccaccgcacccggctatcattttttaaattttagccatactagtggatgtgtgggagtttctcattgtggttttaattttaatttgcatttctctaatgactaatgagattgaacatatttttatgtgcttatttgccaattatatatattcttttttttttttttttgagatggagtctcggtctgttgcccacgctggagcgcagtggcatgatcttggctcactgcaacctccgcctcctgggttcaagcacttcttttgccttaccctcctgagtagctgggattacaggcatgcaccaccacgcctggctaattttctctgtatttttaatagagacggggttttgccatgttggccaggctcttcttgaactcctgacctcaggtgatccacccgcctaggctttccaaagtgctgggattacaggtgtsagccaatgcgcccagtcagctatttttatatatatacattctatgatcaaatgtctgttcaaaacttttgtctatttaaaaaaaaattttttttgtcttattgagtttcaggaatcttcgtatattctgaatacaagttatatatcaaatatatgccttctaaacatattctccctgtctgtgacttacattttcattttcttatcagttttacacaaatatttatatacgaaaaatgtggaaatcagttgtatccctctatactaacaatgagtaattagaaatcaaaacttaaaaatcaggactgtttgcaatagtttaaaatatgaactacttgaagataaattccagaaaccattttggaagaccagtacattgaaaactacaaaacattactgagacaaattaaagaagacctaaatgaatggagagatacaacatttttgtgtattggaagactcatatcttttcttttttttttcctttgagacagggtctcactctgtcatccaggctggagtataggggtgtgatcttggctcactgcgacctccgcctcctgggctccagtgatcctcccatgtcagcctcccaagtggctgggactacaggcaccatcacaaatttttttttttttttgagacggagtctcgctctgtttgccaggctagagtgcaatggcatggtctcagctcactgcgacctccgcctcccgggttcaagtgattctgctgcctcagcctccccagtagctgggattacaggtgcctgccaccatgcctggctagtttttggtatttttagtagggatggggtttcaccatgttggccaggctggtctcgaactcctgacctcgtgatctgcccgcctcagcctcccaaagtgctgagatcacaggcgtgagccaccacgcccagcaacatctggctgatttttgtattttttgtagagatggggtttcgccatgttgcccaggctggtcttggactcctgtactcaagcaatcctcctgccctggcctcccgaaatgctggcttacaggcatgaaccacctggtgcccagtctaggaagactcatatcatgaagatgtaaattttctccattaagctatagatttaatgcagtcccgatcaaaacccaggtagtatttttcagaaaatatcaarctgatttcaaatgtatattgaaatgtaaaggacctagaataaccaaaacaatattaaaaagaagaccaaagttagaggaatcaaacttattttatgactttgtataaaggaacagtaatcgggtcagtgtgattattggtataaggatagatatatagatcactggaaccaaatagacaaatttgccaaggcaatttaatgggggaaaaggtagtcttcataacaaatggtgttgaaacaattcacacaaaaatatcaacctctatacttacctcatgctgtacaaaaattaacttgaagtgggtaattgaacaaatgtaagagcttaaatcataaaatgtgtagaggaaaacgagaaaatttttgtgattttaggtggggcaaaggtttcttggagtaaaaaaagcttaacctataaaaggaaaaaaattggcttttatcagaaagaaaaatttttgctcttcagtatttatttttaatggaatgaagacaaattgaagtgtatctacaagggggtggaatgatgagtaaaacttgtgttaaagagttattaacagattttgttgtctgtttggattttaatacatatcactaccttctacctttggaggtagaaatctagaagtcataatgaatgttctttgcatgcaactcctgtgggtttacccgttaatttatacttttttcatttctactcaagaaaatatatttgaatgaaatcattgtgaatgccttctactttacaaaagtaaatacaaactcaggctgtacacctgtgttccacatcctactcctgccacttagtaatcatatgaccctctacaagtcactgaacctctttaagcctctgttttctcatctttaaaatcaaaataatattaagacttcgctcatgcagtttttaggatgaaatgagacaatccatttaaaatagcatagtgccagatttatagttaaatttagaggcagccaaaagctacctccctacatagtgaactataacctaatttaatatataaactacctgcaacctaacctaagagtatactcttgtaacaagtagctgagcctcagtcaagcatagcagccaagttttcagccagtcatataggctgaatattgccaaagcatgttcaaataaggcaaacacctgaactgcagcccatcaggctacttctgtatgtcatttctgtttctctggctataaatatagcctacatgcattgggggatggagcattctgaactgcatttggtactggatgctaactggttcattaatctctatttttttgagacagggacttgcttagtcacccagggtggagtgcagtgacatggctcactgcagtctggacctcttgggcttgagtgatgcttctgcctcaggctgctcccttccccacctttcccggaagctgggaccacagttttcatttccttattatttgtaatgggggttgggggtgggggctccctgtgctgcccaggctggtctcaaacttctgggctcaaccaatcctccagtctccacctctgcctcccagagtgctggaattacaggggtgagccaccgcacctggcaaatctgttttttgttcaattaagtcattaaatttaacttgtctcaggtttgtcatttaacaatatgaacaaaatgtatatatttttttctttttatgcctcggtacttcaaatagttattagtagctgtgatacagtaagaaatattgtgtatatttcttaccgtataaagaaatatatacatatatatatttcttctgtatatatatataattactgtgatacagtaagaaatacatgtattccttatatatgtagctgggaccacaggtggatgccaccatgcctggctaattttttgacttttttgtagagacaggatttcgccatgttgtgcrggctagtctctgctgggcaaggtgtcagaacccggcagtggagagtggttggctcactggtggtaaaagaatttactgacagcagtataggtttagaaaggaaagttttattagatagaatgctgcagcagagtgcagtacagtgcttcattcagcaaaaaggactgagtgtgttgcggtggattttccttaggggtatttatggactttaaagcaggaccttagggtaatttggaccatattagttatgtaggtcatggtaaattattacatttgtagactttgggtgccttgatgttagcaagggttgcaaaataagttttgacattcatgcattctggagatgtatagaaattctagttacttataaatttttgggaaagaagcctggtaccagatgctggctttagataatagagaagtctaattacttttcaatttttcagataaggagttttgtcttcggatggtctgcttgattgccactaggtgatcgttgtattcttctgtgtcgaactcccaggctcaagtgatccacccrctttggcctccctaagtactgggattataggaatgagccactgtacctggctgttacttttatctgaaattgagaatacaggaaaaggaacaggtttgggggagaaaattaatgagtttgattctcagatgatgacaggtaatctggtgtacatatccttttaaaaatattgatatgaaatttacataacaaaatcaaccattttaaagtgaacaattcagtggcatttagtactggcagatttgtttttcacaatacaactgccacctctatctagctgcaaaacctgcctgttactttagatttaaacctcttatccattaagccctttctccccactccccttccatgcaatctgcattttgtctctatggatttctctattctggatattttatataaataatattatacatatgtgaccttctgtatctggtttatttcatttagcataatgtttggatgttcatccacattctagcatatattggtactttattccttcttttggttgaataatatctcgttgtatgtgtccaacacaactttttatccattgatggacactgggctgtttccaccttttggatactgtgaatagtgctgctatgaactatatgtatacatgtacttgagtacctgtcttcagttcttttggggatatacctggggtggaatcacaaagaaatacggtaattcaactttttgaggaataaccaaactgttttctgtaatagcttaccattttacagttccactagcaatgtactgaaggtttcagtttctctatatctttgtcaacttgttatattccatttaaaaaattattgtttagttatactatcctggtgagtatgaagtggtacctcattgtggttttgatttgtagttctgtaatgactaatgatgttgagcatcttttcatgtgttttttgaccatttatatatcttctttggaaaaatgtctatacaagtcctttgcccattttttttaattgaatttttttgttgttttaagtttgttatatattctgggtattagacccttagttatatgatttccaaatttttttcctgttctgtgtgttgtctttttagtttgttggtaatgtcctttgaagtttaaaaatgcccttgatgaagtctaacttatctgtgtttttctgttattgcttatgcttttggtttcatatctaagaatccattgccagctccaaggtcatgatttacttctgtgttttcttctatgaattttatggttttacttcttatatttacttcatcgacccattttgagtcagtttttatattcagtgtgaggcaagagtttatttttttgcatgtggatatcactttttaggtatcctttcaagagttagatgtccagagtaaagtacagcagtttagggctatagatgtggacttggaagctgtggattaaatcaccatgggagagagtaaagagaaataaaaggaatgtaggggaacatgaaaaaattacatgtgaaaggatagataatgttagacagtgaagtattcaacttagataagaactgtaggagtttagataaagtgcattcacttgagaattgctgtccttttcactcttastttttctttttgtaagaggaacttgtttctaatgccatctagtgtcttttgaagggtatatgagtaatgttaagaggttttaaaataaaagttttgaaatttcatgagacttgagcagtatattggcagtcttagcttactctcaagagcatccttaagagagaagtaaaagaacacattaaatactttgcctgaacaaattcggagctgaatttcatcttgaatagttaagcatttttatcatctcttttgtgttaatttgtaaagaatttaagataccttaaaaatagtgacgtcaaatttttttcttatcttgaatttgtcttacaaaaattatagacagccttacttttttttgtttttgtttttgagacaggatcttgctctgtcacccaggctggagtgcagtggtgcaaccttggctcaccgcagtgtcaacctgctagggtcaagtgattctcctgcctcagcctcctgagtagttgggactacaggcatgggccacgatgcctggctaatttttatttttatttatttttaaacttttatttatttattttttgagacagagtttcactcttgctscccaggctggagtgcagtgactcactgcaacctccgactcccaggttcaagtgattctcctgcttcagtttcctgagtagctgggattacaggcgcctgccaccatgcccagctaattttttgtatttttagtagagatggtgtttcaccatgttggccaggctggtcccaaactcctggcctcaagtgatccacctgcctcggcttcccaaagtrctgagattataggtgtgagccaccgcggccagcttaatttttatttttaaactttttgtagaggtgggattttacagtgtttcccagtttggtctcgaacccctgggctcaagcaatcctgcctcagacttcaaactatcgggattacagttgtgagccactgcacctgccaagcatctaaatttttaaaaggcatttaaaataaaaaatttttttagataaatttgttggttgattggtttgttcgtccgttttgtgctgctatgacagaatactcgaaactgggtaatttataaggaatcaaggtttatttcttagagttcttggggctcagaagcccaagatcaaggtaccagcatctgatgagggctttcttggtgtttcctcacgtggcagaaggtggaagggcaatagagaagaaatccattcctgtaagccctttttatagtgacattaatccattcatgagaacagagctttcatgacttaaacacctctcaaaaggccaaatctcccaccactgttgcattggaaattaaatttccagcacatggattttggggaacacattcataccatagcagttgaggttacagaaagagatcttactgaatttgttgatggttagaatacatgggagaacgtttatgcaagtttttggtaaggtgtcatatatgtcaaggagaacggcattattaaaccactagtaaaaagttataagagcaggttttgtttttactcttatacaaaaaatatcagtgctagtctttttgtttttttcctttttcttttttgaaattgcagaaataaattttatttttaattttcagaggttaaaaaaagttatgatactttaaactgttaacaagacttagttgatatccagttaacctaatacagcattaatgtttttattattttcttgaagagactcaaatacacctgcattgtgctcttttaaaaacatattaaggatacttgtatttaacaagttttttaggaaaaacattgtacaacatttatgtttttcatgatgctgaaaatgctgaattayatgtcaatttaatttatctcttagaagaaaaagtaacataattaaaatcactgggtctctaatctttagttctctctccacaaataaaacctgtcacttttcacaataaaaaagcaaaaaataatatacaattaaaaggagctaaactgaaattctttatcctctttttccttttttgagacggagtgtctctgtcgcccaggctggagtgcagcggtgcgatctcggctcactgcaagctctgcctcctgggttcacgccattttcccacctcagcctcctgagtagctgggactacaggtgcccaccaccatgcccggctagttttttgcatttttagtagagacrgggtttcactgtgttagccagggtggtctcgaactcctgaccttgtgatctgcccgcctcggcctcccaaagtgctgggattacaggcatgagccactgtgcctggcctctttatcccgtttcaaaagataaattaattgtgggagatcaacataacaatcatcactgatttttttttaaccatttaactctggttcaaaagataaataataatctataatccaccagtgtatacaaattttttatcacattttcccttatgttgtaaaaaaaaagaaaataggtttaatgtttaaagaaggattaatttgatattattactgaaagacaattttgctgttatcacagctcaaaaagtagtgacaggaatcttttaggaaacaggttactgtccgtttcacaaaatgtgaaattagatgatcataaatatacaagaaaatcaaaacattttctgtccttagttatattgctccccccggcctgaaatttagatgaaaaagattaaacaacttttgcagatcacgtctatctattttagcaacttaatataaatgaaaagcaatcttcattttaaaataaatatcataggccaggtgcggtggctcatacctgtaatcccagcactttgggagtccgaggcaggtgaatcacgaggtcagaagttcaagaccagcctggccaacatggtgaaacccagtctctactaaaaaaacacaaaacaaattagctgggcgtggtggcgggtacctgtaatcctagctacctgggaggctgaggcaggagaattgcttgaacctgggaggcagaggttgcagtgagccgagatgatgccactgcactccagcccaggtgacagtgcaagactccgtcttaaaaaaaaaaaaaaattaataacaccatttttgaaactgcaaatgaaactctcatcatataagagaatgtcaacatcaaattcttgtatcttgatgattatgtaccataatcaatgaatataatttgaagctctcaaattatttattttgaattcaagtgaagatgattaggctaatccagtcatttcctcttctgagtcatttgattcatcgtttagttccaattccactaaatcttggtctgtagttataatagttttcctcttgcacttcttgggaattgcatcattagcacagatttttctcattttaatatttggcaatttcttcagatcaaagtcccattccctaaatgttttcagattacttgcatttagaatgtctggaatctcaaagccacatcctttatactgctgtccctcccgctccatcgtctgcttgatgatggtgtcctgggaacagtgctgcctgtcctgcttgtccctgatactgttatgtaactcaatctgctccaactcactgctaaatcaatttaatttaagtacctttcagttagttcacaagcatctttgtttgaatatctttttttgggggggatcaagatgattttgaaaccattgcagtttttcaccaataagattgaaacacaaggccttttcattcttcaatttttcctttttttcttatttgtgggcctctctcataatttgagctgcttttctactatatggatgaatgactttttttcccatcctgcactttttccctttggtgctttaggtatagtgacgtcctcgcggccacagaggagctctgcactctagacccaggcagtctcaccaaccacaagagcagcagctcacaggagtacccgtgccaaatccccctggggcctccctttttctttttttttaagatgagattttgccatattgcccagtctggtctcgaactcctgggttcaagccatctccccgcctcagcttcccaaagggtgtgagccactatgcccggccagtactagtcttttaattaggctgttattgtcatgtgttgcttcgcactggtatatttacagtgctgagcaaagattgaaaagcagtgctactggtgcattctatcatatagacaatataattactagtgatagtttagttgcaatagagaactaatatttactagaccctattcctagtttaacgtatgttctcctttattttctccagaacattgagttgtcattcttcatttttgcaatatgtcttatctatagaatgtatagggaacaaggctggtttcagcatgtgtagactggtggccttaagagatagcaatgttaagaaatagtagtagtgtacaataaaccattaatatagcagtcctgagactactatccttagaaaggcttgtgcggaaggccgacccttggctggtatctggaaacttgaatggtaaacagtttcctacactgataaaaatttccttgaatgataagagtgacttactgtgcaaacaatgtgatttatgctgaacatttacttaccttctgggagtctgaaattttggtatgtagtaggcaagagggtgcctgtgtgagcagctccattaaaaactttggacactgagtctttggtgagctttcctggtagacaacatttcatggatatagttacyaggtgttgctggaagaaataagtgtgtcttatgtgacttcactgggagcgaactctgggaagcttgtgcttggtttcctccagactttgcctcatgcaccttttccatatgctgattatatgcagggtcctgtgagtactcctggaggatcatggaacctggggatggttttggtgacccctgacacaggtagtctttgaaggatttatgaaaatagttaagggtatagccggagtaatcaggcaagagaaagaaataaacggcattcaagtaggaagagagaagtcagattatccctgtttgtagatgacatgattgtatgtgtagaaaaccccatcatcttggcccaaaagctccttcaactgataaacaaattcagcaaagtttcaggacaccaaattaacatacaaaaaaccactagcattcctatccaccaacaacagccmagctgggagccaaatcaggaaggcaatcccattcacaattaccacaaaaagaatacaatacctaggaatactgctaaccagggaggtgcaagatttctacaatgagaattagaagacactgctcaaggaaatcagagaagacaaaaacaaatgaaaaaacacaccatgctcatggataggaagactcaatatcattaaaatgaccatactgcctaaagcagtttacagattcaatgctattcctatcaaactaccaagaacattcttcacagaactagaaaaaacgattttaaaattcgtatggaaccaaaaaagagcttgaatagccaaggcagtcctaagcaaagagaacaaaactgggggcctcacgttacccaacttcaaactgtastatagggatacagtaaccaaaacagcatgttactggtacaaaaggcacatagatcaatggaactttatttccggcagaaataaagctgcacacctatgaccatgtgatctgtgacaaaactgacaaaaacaagtaatgatactgggataactggctagccatatgcagaagattaaagctggaccccctcttttctttttttttttttgagatggagtctytctctgtcacccaggctggagtgcagtggcgcgatctaggctcactgcaagctccacctcccaggttcacaccattctcctgcctcagcctctggagtagctgggactacaggcgcccgccaccacacccagctaattttttgtatttttagtagagatggggtttcaccatattagccaggatggtctggatctcctgacgtcgtgatctgcctgcctcagcctcccaaagtgctgggattacaggcgtgagccactgtgccccgcccatattttctttatctagtccactgttgatgggcacctaggttgatcccatgtctttactattgtgaatagtgctgtgattaacatgtgagtacrtgtgtctttttggtagaatgatttgttttcttttgtatatttacccagtaataggattgctgggttgaatggtagttcagttttaggctctttgagaagtctcccaactactttccagagtgctaaactaatttacattcctaccaacagtgtatacgtgttcccttttatctgcagtcttgccggcatctgttgtttttttgctttttgataatagctattctgactggcataagatggtatctcattgtggttttgatgtgcatttctcaaatggttagtatgtggagcatgttttcatgtttgttggctgcctgtatatcttcttttgagaagtgtctgttcatgtcttttgcccattttgtgatggggttgttttttgcttgtttaattgtttaagttctttatagagtctagatattagacctttgtcagatgcatagtttgcaaatattttctcccattctgtaggctgttaactctactgattgtttcttttgctgtgcagaaactctttagtctaattaggtcccacttgacaatttttgtttttgttgcaattgcttttgaggactcagtcataaattgtttcccaaggtcagtgtctggaatggtgtttcctagtttgtttgtttgtttttccctaggattcttacagtttgaggtcttacatttaaatctttaatccatcttgagttaatttttgtatgtggtgaaaggtagggttccagtttcattcttctgcatgtgcctagccagctatcccagcactatttattgaatagagtcctctccccattgcttatttttgttgactttgctaaagatcagaagattgtaggtgtgtggctttatttctgggttctctattctgttctataggtctatgtgtctgcttttgtaccagtactatgcttttttttttttttttttttaaacactgtagccttatagtatagtctgaagctgggtaatgtaatccctgcagctttgttctttttgcttaggattgttttggctatttgagctcttttttggtttcatgtaaattttagaatagttctttctagttctgtgaaaaatgacattggtagtttgataagaattatgctgaatctgtagattgatttggacagtatggctgtttcaacagtattgattcttctaatccatgagcatgaaatttttttccttttgtttgtgtcacctgtgatttcttttagcagtgtttgtagttctccttgttgagatcttttacctccttggttagatgtattcttaggtactttttctttttcttttttttgtagctattgtaaatgggactgcattctttacttggctctcagcttgaacgttactggtatatagaattgctactgatttttgtacattgcttttgtatcttaaaactgggaagccatttatcagttccaggagcctttggcggagtctttagggttttccaggtataaaatcatattgtctgcaaagaaagatagctggacttctttgctgtttggatgccttttctttctttcctttgtgtgattgctgtggctagaacttccagtgctctgttgaccagcagtcaggagagtagacatccttgtcttgttccagttctcaagaggaatgtttccagtttttctcattcagcatgatgttggctgtggatttgtcataggtggcttttatttattttgagatatgttccttggatgcctagtttgttgagggtttttatcatgaagrgatggtggattttattgaaagctttttctacatctattcatctgacttccttttttctgcttgacctaatagaaaaaattttcagccctacttgaaatgaattacctgagctgagggactgagattgctgctggcaaatagaattaatggactattttttaaagagggcaaaaagctccaaacagaaacgtttctgagatgtgttggggcattttgggaataaagtaacatgcatttatagggagatactaaaatgaaaatataggaatttccttttttttcagttatttagcctttaaaaaaatacttatggttgcataggaagttgcaaaaatagtgcagagtactatgaacccttcacccagctttcaccaatagtgtcatcttatatagctataatacaatattaaaaccatgaaaatgacatttgtacaatatcattaactagattatagcccttatttggtctttatatacacttgtatatgtttgtgtgtgtatgtacaagtcatgcartctcatcccatgaatagatttgtgtaatggccaccaccacaatcaacatacagaaccgtgctgtcattacaaaggaattcgcttgggctgcccttttatatttgcactcccaccccgtctttatcttcttgcaaccactaatgtgttcttctctatgtgaattatatttatatttatatttccttttgagacagggtctcactctgtcccccaggctggagtgtggttttgcagtcatggctcactgcagcctccatctcccagtctcaggtgatcctcctgcctcagccttccgagtagctgggatcacaggcacaagcyaccatgcctggctaattttttttttttttttttaatttgtagagatggagtcttgctatgttgcccagactggtctcgaactcctgggctcaagtgaycctcctccctcagccttccaaagtgttggaattaaaagggtgagccactatgcctggcctttatgtgaatattatataaatggaaccatatagtatataaccttttgagatttttttcagtaagtataatgtttttgagatccgtctaaattgttgcatgtatccactcagttctttccctctttgtgtgtagtattccattgtatggtbacacatcacttggttatttactcacatgttgatagattttatgtgtttgttttttgaatctgcaccactggcaatggatttttttaaagctattaactttttttttaaattaaaaacaattattttttgttgagatggtatctctgtcacccaggctggagtgcagtggcatgatcttgggtcactgcaacctctgtctcccaggttaaagtgattctcatacctcatcctcccgagtagctgggattacagtcgcctaccaccatgctcactaatttttgtatttttagtagagacagggtttcaccatgttggtcaggctggtctcgaactcctgagctcaggtgatccacctgccttggcctcccaaagtgctgggattacagatatgagccccatgccctaaaactataaacttttaaaagttttgtatgtattctaaatataaattccttgttggatatgtggtttgcaaataacttttttattctttttaacagagtgttttgcataacacatttattaatttttwaaaaattattattgtttttttttgagtcagagtctctgtcacctaggccatagtgcagtggctcgatctcrgctcacggcaacctctacctcctgggttcaagtgattctcctgcccagcctcctgagtagttgggattacaggtgtgtaccatcacgcctgtgtaatttttgtatttttagtagagacaggtttttaccatgttgaccaggctggtgttgaactcctgacctcaagtgatccacccaccccggcctcccaaagtggtgggattacaggcgtgagccactgtgcccatcctaaaattgtttttctgtttcttaaaagaaaaattttttatactacctttatgtgtacaatctcttttttttttcaatcagctttcttaggttgaaaaatgtctttaattttgatgaagttctgattgtgttcttggtgtcatgtctaagaacttttcacctattcctaggttctgaagattttctcctctgtgttcttttaaaaatttacagttttattttttacatttaactcatgatcaattttgaagtaatttttgtgtatagtgtgagttgtaggttaagcttatttttttattcagctcatggatgtccagttgttctagtataagttattgaaaagtgtgtcctttctgcattgaattgcttttccacttttgccaaaaatcagttggacatattcaggccgggcacagtggctcatgcctgtaatctcagcactttgggaggctaaggtgggcagatcacctgaggtcaggagttcgagaccagcctggccaacatggcaaaaccctatctactaaaaatataacaattagccaggagtgatggttcatgcctgtaatctcatctactcgggaggctgaggcaggagaatcacttgaacccgggaggcagaggttgcagtgagctgagatcgtaccactgtactgcagcctgggtgacagagtgaccctctgtctcaaaaaaaaaaaaaaaaattggacatatttgtgtggtttatttctgggttctcttttctgttcagttcacttatgggactctccttctgccattaccacaatgttttgattactgctgctatatagtaagtcttaacattgggtagagtgattccttacacttactgttctatttcaaaatggttttagtgattttttttctttctacataaattttagaataagcttttttatatctacaaaaagtcttgctgggattttgataggaattacattaaacctataaagaaatatgagataaaggaaaaactaaacttttacctactctcaaactcaccacaacacaggacccttctgacaccacatttatgggttttttttccctgtacaccaaacagcagacagaagctgggtgccttataatttaactcaactcctatactgcatgcctggaataagcatcagatcccataggctaaggccctgtcccataagattgcccctactttagatccagtttcagtcctagctggttttacctgttcttttgactgaccagctataaattggatacagatgaaccaccaggtggagaagcacataggatgaggcaggtgggaaggagtgtggagcttcacccgctctgggctcactatcctccaggtacctgcatgtggtcaggatcctggaagctctctgaaccctgtacttcactgattttcatggcagctttatcacataggcatgatccccttcccagaggattggagggtgaggtggaaagttccaattttctaatcatggcttggtctttctggtgcacagcctccatacaggagcccagttaacattccctttgttagaacagaaggcatgtctatcacccaataaattctaatggattgggagctctgtgtcaagaactaggatgaagaccaaaaaatatatatttttattataaatcacgatatcacaataagttttgaggagaaatggcttttttttttctatttgattcttctgacccatgaaaatagtgtgtctctgcatttatgtagatttttaattcttttcatcagcatgttgtaatttttagcatacatatcttgtatgtgttttgctgcatttctgtctctaagtattttatctttttgtattttcatgctgcttgccaggaacagtctcagtccctcagcgctggtaatttatttcaagtggggttgaaatttaagaggtcagatagaaaaaagaaatgagatgaaacttttttttttgcaactttaaatgatgttgtattttaaattttagtttttacatgtttgttgctactagtatatagaaatatggttggttttcgtgtgccgatcttgtatccggtgagtttgctgaactcatttaggagtttttcttgtagattgagcatttctacataggcaatcatgtcattttcaaataggacagttttattttttccaatctatatattccttttctatcattttctttctttattgctctggctaggatttaattaaacactgaatttttattctggtagtgctgacttcaggagcctaatttgggactagcaaatgctagttttactcaccttatcattacagtttcagatcttcggcttctcttgggcttcagaagtttaacttggattgatcttgaatattgatcttgaatatgctgaaggcaggaaaagctctgtcctgagtgtatacacagtgcaatataatttttatttatttgcctcccttgagtgtgagcttcttgaagaagacagttctgaagatacagggcttggtacacagcaaacttgtaattaaygtttgaggtcaggcatgggtggctcacatcygtaatccaatgctttgggaggctgaggtggggggattgcttgaggccaggagttcaagaccagcctgggcaacctagcaatatcccgtatctaaaaataataacagttacaattgtttgttgagcaaatatttaaatgaataaatggaactaatatgtggcttcttctcatataagaagtctagggaaaaccttttcagacaaggtatagtgtaactcaggttgaaatgacaaatgtgagactatttgcagtcacacacgcagttgcacatgtgattttgacatcaaacatttttgtttatttttgtttacttgcatgccttgtaagtttcatgttttactaacaagacactttattctttgagtgttacatgtcgtttggtttggcttgcttctgtatgttaaaaaaacgttctgtcttttgaaaagataccattatctaattggttttaagttaggagaattctaaattacagggcacagtaaaataaatgagcaattataccgaggaagagcaaaacaaacaaaaaagaatcatggaaccatgttttgtatatacgtggggagaagttatcctttagatctgttttttttttttatgtgagtatgcttgaatgtatatgtcatgagggtagtgggctgggctgagctggggaggagatgtgcatcatatgtagggagtagacttaagctagttatttttaaataatactttagcaagggaattagtacttgtttaagtgttcatattgccttaatattagcatagctttttcatcaatatgttcagtatctcaaacgtcaaatttgcatgaaaatattctcccaaacccctaatccttccctgttttatttttcttcattgcatttattatcttctaacatactgtatattttatgtattcattttttgtttaatgcctgtctacatccacttgaatgtaagctttaagaggtcagggatttttatctatttctattaacagttgtatagctaggcccatgatatcatctggtacatagagaatacttaatttgtaaatcaatgaaaggaagactactttgaaaagagtgatttctaggatattggaatgaggaatcttaatcataagcctatgtaaatgataaaatattatccctatggaatagcaggaaagtcattgtccttttaccctgaggagcatatttgtcctctataaaaaggcctttctatttggaaggaattttacttgattgattgactctctgtttaagcaacaaatgaaaaagaatcctttgttgagaagctaccacagactgtaaagtttccaggttctgtgctttgtgctggatggggcaccactgtgatgggcctgatgagtctctgagactgctgcaggacttggattttgtaactaaagttagttcttatttttatactttaagttytagggtacatgtgcacaatgtgcaggtttgttacatatgtatacatgtgccatgttggtgtgctgcacccattaacttgtcatttacattaggtatatctcctaatgctatccctctcccctcccccgactccatgacaggccccagtgtgtgatgttccccttcctgtgtccaagtgttctcattgttcatttcctacctatgagtgagaacatgcggtgtttttttttttttttttttttttgtccttgcgatagtttgctaaggatgatggtttccagcttcatccatgtccctacaaaggacatgaacatatccttttttatggctgcatagtattccatggtgtatatgtgccacgttttcttaattcagtctatcattgatggacatttgggttggttccaagtctttgctattgtgaatagtgccgcaataaacatacgtgtgtatgtgtctttatagcagcatgatttataatcctttgggtatatacccagtaatgggattactgggtcaaatggtatttctagttctgcatccttgaggaattgccacactgtcttccacaatggttgaactagtttacagtcccaccaacagtgtaaaagtgttcctatttctccatatcctctccagcacctgttgtttcctgactttttaatgattgccattctaactgaaatgagatggtatctcattgtggttttgatttgcatttctctgatggccagtgatgatgagcattttttcatgtgtctgttggctgcataaatgtcttcttttgagaagtgtctgttcatatcctttgcccactttgtgatggggttgtttgtttttttcttgtaaatttgtttgagttctttgtagattctggatattagccctttgtcagatgagtagattgcaaaaattttcccccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgtttttgtcatgtttgtcaaagatcagatggttgtagatgtgtggtattatttatgagggctctgttctgttccattggtctatatctctgttttggtaccagtaccatgctgttttggttactgtagccttgtagtatagtttgaagtcaggtagcataatgcctccagctttgttcttttggcttaggattgtcttggcaatgcgggcccttttttggttccatatgaactttaaggtagttttttccaattctgtgaagaaagtcattggtatctcggctcactgcaacctccgcctcctgggttcaagtgattcagctgtctcagcctgatgagtagctgggactacaggcacaaaaagtgccatcacacccagctaattgttgtatttttaatagagatgtggtttcaccatgttggccaggctagtctcaaactcctggsctcaagtgatccgccagcctttgcttcccaaagtgctgggattacaggcatgagccaccacgcctggcccttgagctgggttttgaagaatgaataggagtttactaggtaagagctgaagtagggaacctctccagtaggtgggaacatgtgccaaggcatgaagcagtgaaacaaagtggtgcgtgcaagagaagtactcataatttgttgtggccagacacaacatgagagggagaaaatcaagatgagctgatcagggaggcctaaagttaattttttcattgtgcttatcttggcttgcttaccatgtaaagaaccttatagctttccacatggggttagttatattttattcacttactgataaataaaaggataatttatgttgaggaaatgtttagatgcagcctattctgagaatttatgtatttacttttatttctgcaaggtgtttgactttttatctagtcattggctgatagtcctctcaatactaataacatagtagagaagatgatgaaaatgttttattcatctgttcttggacaagaaaccctgctctttctgttctttttagttgaagctgaataaagctgaatgttctagtcggaagcatgggttcaagtttctactacactgtttctgagcaggttacgtctccttcctgggtcttaatttctccagttgtaaaataggggatttgaggtaaattagcatatccactttgataaaaatttatctgggctgggcggggtggctcatgcctgcaatcctgaggtggcgggatgctgagatgggcagattacttgaggccaggagtttgtgacaagcgtggccaacatggtaaacccctgtctctactaaaaatacacacacacacacacacacacacacacacaaattagccaggagtggtggcgggcacctgtaatcccagctactcgggaggctgaggcaggagaatcacttgaacctgggagacagaggttggagtgagccaagatcatgccactgcactccagcctgggtgacagagtgagaatctgtctcaaaaaaaaaaaaaaaatttatgtgaagcaagaatcaatacatatatgacccattagggtaatttttcttggcagtccttcccttcctggctgctgtttaccaacttaattattcttcctgtttcatgttagattctataatccagtatacatcttactactcttggccrggcgcagtggctgatgcctgtaatcccagcactttgggaggccaaggcaggcggatcacctgaggtcagaagtttgagaccagcctggccaacatggtgaaaccccatctctactaaaaatacaaaaattagccaagcgtagtggcgggtgcctgtaatcccagctactcaggaggctgaggcaggagaatcacttgaacctgggaggcagaggttgtagtgagccgagatcatgccattgcactgcagcctgggcgacaagagcgaaactccgtctccaaaaaaaaaaatcttactactcctctcaactcctgctattatctttgttattttcagcaaccatgtagatkaatccatccaataatatcctggcatagttgttgacctcattatcatttctagtccacttagctctctgccttgtcatacctctgaaatgttccttcactaaaatcgtaactctaggtaacctcctcactacaacctgataatttttttagcttccccatttaattattcttaaagtataccagttctcagacttaccagcacctctattaaatcttttcttcctgtcttttcgtctttactttcctcctcttttagcttagattccattgttactctctctattccatgtcataaattgtttgccccatttttggtcaatttatctggtaaagctgtttagtaaaactttgcctttgcattactgtagtctactgaagaaagccacacaacggagcagattggtgggactgtaaaatgatgatgaatgatgtaggtcagtccttaacgctgcttaccaattctactttttgttcagcgtattttcttgttctctgtattatctctcaatttttttttttttttactcatctcaaatttggaatttccttgctctgctgatttcctttttatttcatggagaaaatagctataatgtggaagcttctttagcttctttaccactaaagttacaaatattttgttacctgtacctgctttttccttttcatctgttgtggtggaagaaatattccttctatcactgtttatgctctcaatcccctcccttccttttcatcttttgtggtggaagaaatattccttctatcactgtttatgctctcaatcccctcccttccttttcaagaataactttttttttgagaactttggctgcagartatggagagttaaatgcaagctggaagagttgtctagattcactgtctttatttcctcatctcctacccactggagttgggcttttgctcctaccactcctccactcctgaaactgttcctacaaagggtaccagttgacttcaagtcagttaaattggatgacattctttaatgatgggcctccaggcagcatttgttcagcagtccctgactatcttttcttggcttctttaatagcatttgcagtcttgatttccttccacctctctggttactcttcttctgtttcctacagtttaatcagttactacaaatattactgtaacataaacaaataaaggtttattatcttacagagaagaatgcaaaatttgcataaattttgagaaccaaacaggctttaaggaaaccagsttgtggcaggaaattttgagcaggttacacactactctgtgagagatactgaaaaaagttgtgaatcattcatacatgtttcataaatgattcctttcaacaaccttataaggtagatggttgtattcttgtttatccacaaaggatttgaggtggggaaagatggggtatgttcaggaaactgtgccttgttctttccaattggaaggttaagttacaataaggtactactgaagataaaatctgttgtttccatgatatggcgtgtcttgaatgccaaggggagacgttttttacttaattttttagatagtgaggactgaagattttttttttttttttttaaccttgagtggctggagtgcagtggcacgatstcagctctgcaacctctgcctcttgggtttgaatgatttttctgcctcagcctcccaagtagttgggattacagctgcctgccatcatgcctggctaatttttgtatttttagtagaaacacggttttgccttgttggccaggctggtctcgaactcctgacctcagatgatccacttgcctcggcctcccaaagtgctgggtgagccactgcacctggccaggttgaagatttttaagctgtgtacaacgttttgggaaaggaaacctgtcttggtgaaaggttgataatcccataacgttagttttagtgaccaaatggcacttccacttgaagcctttttgtaggctttccactataatgaattgagccttctttgacactcccatagcactttgtcataccttttagcacacttctcatgtgtcataattacttgtttgtatttggcttccccattggattttagctcttctagaataggattattagtttatggttaatgttgattttggtaatctttcctcatccctatctcagtggttggcaaaataaatggttcttgaattagtaaatgaataaagagtttgaattttgaatcttttgtctgaatagcttctcagaatgcatcttttttatatttttactgattaccgggttgaataaattagaagccactcctacttcctctctgctgatacatatgttttagctagttaaacctattttgatagaggagttctatgactttaaaggcctatgactttgcagacactcatacagtgtacagcataccctatgcaaatcagctgtctgttcaggtcttgtgtttgttttccccatagacataatccagccgttagttattcaaagcagcagatgggagaaggaatccgtggaaatgtggatttattagctctcacaatgaaagaccacactggttatgctaaggattagaagatttctgctgaatgaaagggacatggatcctgttttttgtgctattttcagcagtgtggcaatttcttatgactataatcagttgtaaaaagaccagaaaatgatcttgtaaatagactttccttcaagccctagactgttggttgcagctgtcataattataggagggactgcttttcttcctttttgggtgcagactgaatctggcctttagctattgctatatttacaccttaggtagtataactggctgattgtgtgctttatacatacctttatctgtcaaattagggaatttggattcrtgtctcctgaattttgtaggagagtaattattgtagcatgtcttatagtttggaaaaaatgattgaatttaatgtgttaaactcacttcctaaaaatataatgctgccttcactaacaattttgtgtgtgtgacttgttagaaagatcagcaactttcctttgtgtttactaagattctgacaattaccataaagttggaaagtttaaacgttgcttatggagtgtgtaaggaacagaatcatatcatgagaacaatctttcaytcttaaaatctaaaagattatgtattttgagccatgaattaagaaacagaagcatctttaaacttggctgaagttctactttaaaaatggcagccagtaaccaaagaaacaattcttgagatcattaaagcttggataaaatgasactttttcatgctgtgcccttttagaagtctgggggaatggggagcgtttcctgtgacagcactgtaagtgataaacagctgaatgaatttgtccatgctcagaactcacaacacgtggactagccccctcctgcacataaaagagcagggaaaccgaccttagcaatgatctagctcctgaagaaagaggctttcgttactgtccaagaagtgaagaccagtgagtctagcgataaagaaacaaaagagcccctgacagtatcgaaagaatctgacatttgctttgtctgtacaaaggatgaaaggaattttgccgacttagtcaaaacaataactggttttatatcattttgagtctaaaatacaggcatcagaatcgtatgtttttctttgtatttctgaagaattgtcatctttttaaaaacgtatgtggagtggttttgtttctggaaaggaaaacgtgacatggattttataagcttagtagctgtaggtggagactcttgttttgtttgctaaacctttttaataagcagcraagtcaggatatcaaagattggaatttttcccccggaaccttttgttcttttcttagtacttcaaataatttcaaccaaaggggtatgcatggaaaatgaaaacaaatatgaagtctttccgctatttggcagtgcttcagatgagatgtatctatacttctgtgaagaaagacgtgattctgatatgaggcagtgattgtatacttacgctggacagagggataactggtttagtggaacagtgggttagtggtgtgctgaaaggattgtttgcctctttatccagcagtaagtaggcactagtagttgactgtctggggagtggcttttttttgtctgatatctattatggatgattccagtattctgagaaggagagggttacaggtgagtaaaagaaaacctttttcactgatctccttccttttaatgtctcttgtaaatgtactgaacagattgttataatgtatttaattcatttgaggtaggaggcagagtggagtgcagctaagttcctctttattctttgatgtatagttataattagagaacttatctaaaatcttgctattttgatagaaaaatgctgcttgggcttatttacactgtatttagtgagtagagcaactaaatcagacctgtatgggatacaagcctaatttagaacattagacattactgctgacagattgtttacggtgaacatattctgttcctgaccaccatgcctgatctgcccaccattaagtcacatgtatggtagtatatgcttgattctatgcatagttttaagaacttttctaaattatcacttggcatatacacattccatccacttatctattgtctgtctgtgttgtctgtccatccatccgtctgtctgtctacctacctacctacctaccatcttttccttcttaaatcataggtagtttgttagatgaagaggtatgtaagatataacagtgaatgaaaatagactgataggcaaccttcaactgagttttaatgaatatccttagcactaaaagaatacatgccaaatttgatgattatttttttcatgctttgtagattatctcatcttagtcttgttagcaaagagcaagccagcttctagtctatcactaaatgtttttgagaattgacataatgaagattctagtgtaaatcactgagctaatcaatcaacctgtgatggtttagtcatgaaatgtagctatttctgttgttttcattttgtttatttgacattatttataaagcactttttttgtacaaaatacctaaggattttaaaattatcatgaattaacattattttagtttctttaaagttctcaggtagaaaatgtataggattagtaaacttaaaatataaatttaaacaaattgtattgtttctagttattatatgtacttcttattgatggtgctgtaaacattcagagcccgtagggagaacccactgaatctttagcagttgaccagtatgacctgggctttaaaagtcaataacataaactccagcgccttatactaatttctcctgttagcacagttgattcgatgagatttgtcccttgatttcttggggttattttgagtagtatttatttagtactgtactcagatgacctctcataagtagtgatgtatgttcaagcagctgctaattaaaaatggctggctctgtaagcccatttagttgcactgcttatttatatctttatttctctttagttgctaggattcagaaagggaatcctatttgttgaatgggaaatattttctgttttgtgttaaatcattcattttctccctgatgcctgagtcagtctctagtatttgctaccttgtttactgatgcccttcctctcgagtctttgtttctatctagcaggagttctaaactgccagattacatagcactggaagatcttttcctacagccttatacttataaaaaatttttcccctatttattttgtctactttttttttttgagatggagtctcactctgtcacccaggctggaggtgcagtggcgtgatcttggctcattgcaacctctgcctcccaggttcaagtgattctcctgcctctgcctccggagtcgagtagctggggcattacaggcatgtgccaccacacctggctaattttttgtatttttagtagagacggtgtttcaccatgttggccagccgggtctcaaactcctgacctcaggtgatccacccgcctcggcctcccaattgctgggattgcagatgtgagccaccgcacccagcctattttgcctatttttaaaaaataaactttaaggttcattctccagaagattgctttggaacattccaaaacagagctaacgcttgaaaagcagcagtttagattatttgttttaaatagttacattataatataaagatttaaaggtaagttttattaatagatttatataaataaacacacaaaggtaaagtgtgcctggtggtacaggtaatctactgggtaacctcagatttgaaggtgaaaatccaaataaatatttggcttcgctaattgctttctggtgaaatagatttcctaaaacttttccagaagatcagctaagacacagcctactttgatacctscaggtttttccgcagagtttcttggggaggtagcagaatagtaaatagggcatttagaagttccgtgacagcaaagaccttgtctattttgttcaaattacagttctgccatgttctagtcatataaccacagccaaatttcatttcatttctgtactccactggtatattgagagtagacagtggaggcaagggctgcagcaaaaagaccaattatgagactgttgtggtcaaaaaaagcaagaaataataacagattggaggggtgatagcagtggacgatgtggagractttcttattggccatttttacagatacgtgaagctcagtagcttcctcaaggacagacaagtaggtgtatggccaggctagatgtataggttagggtactctgaactacaagtaacagaaattttgactctgagtggtttaaatgttaggtaaatgtattgactcacaacaatgaagtccagaggttggatgggtttcagagttgggtagtctggtgtatttgctcagcttcattgctcttttgccttcctctgtgttttggcctcattctcaagcttgcttcctatgtgttagaaaaagaactgtagcagtttcagtctgcacagtcacacactacaacatccctacatcttaatggtaaaaggacatctgggagattatgtgtgagcatcttttctttacactggaggagcctctgtcggtgtaggaattgacactgttttgcttgaaaagctgttcaagttgggtcttttttgtggtaaaaattggctttcatcttacatctacttttgaagcatctacacatggagagacatttgagattgaagttccttgtgaattgaaggaggtgcttttatacttgccctgtttcccaatcaactttatgggggatgattttaactttgaaaggtcagggactagccaccataagcaaatttttgttatcaactctcttagtgccataatttccacattatttgcccataaggcacatatagtaatctgtcttcattgtatagacagtgcaatttcccaggttctgaattgaaaatatttgttgtgctgataaaattattgccttcaggcaaaaactaaattgtatagtatttttatgcaccccccccaaccccctgcttgctttttgcctttgctgttcaaaaacgagagtacttagagtgtcattgtttacgggtacttaattattttggaggatatatgacaacataatgcatactgggaagcattattattgagaaagccttgggactttttttattttgcaaattatgactgtcataaattatggtcatcttacaaaatgtgattcagctaatttttagtctttaaaaacaaaatcttcaagaaccaggtagatttcaaacattcaatttcttcttgaaatttcattttaaaaaggctgatgacatggataaaaatgtaacctaattatttgcttctgttgttctacatttccttgttcttttctgtgggaagcttgataaaagaaacatttcagtttgtactcttcagtttttagtaccactaagatattttcatcaagtcagtaaattagatggctttgaaggttaaggaatttatctcactcttgtccctcttctttgccctgactcatgtattcctattctatgttgcagctacaccagtcttgtacctttgtttgtttttttcatagtcatttttttctgacattccccccattcctgagtggttttatcctccttttctacctatcaaccttctgataatccccatgcagttaaaacctgagtacctaattttcaaatattatagtcattatgggtaactccagtatctttgtagacaaggataatcagtccagcctcagatctttagagttccttggctatctggagtctgtgttaacaatacattcctgtagatgccatgtattctgtagagggaactgtttgattcagaaatcttacagtgatttacagttacatcccttgatcacctctgaattaaattctggtgttctctgtgtaaatctagatcacaaattggtggtctggtgactgtttcctgtagatatattttatttagccacctttggagatttaaagaaaaatcaaccaacatagtctctatcagtccccttttgttttatcctctgctgctttatgtatttactgaatttcatctattctaaggctcacatctttttactttataacagctttgaaatagcggtgttactcttgatggtgtgttatacgttaattggccaggcttatttttgttttgcattttaaaaaatgtttcttactgttacaaaaaataacagtgtcttttgcaattgatagtttttcagatttgataaagtacagtatattaccttactggcttattaaagcatttgagtttgcaccatttgtttctcaatgtaaagacctccacctttttttagctctctccctttcctttttctaaagtcttgaagatctctgttcctgtgattcttttgtttgtttgtttgtttgtttgtttgtttgtttttgagacagagttttgctcttgtcacccaggctggagtgcartggtgcaatcttggctcactgcaacctccgcctcctgggttcaagcgattctccagcctcagcctcctgagtagttgggatcacaggttcctgccaccatgcctggctaatttttgtatttttagtagagacaggcttttgccatgttggccaggctagtctcgaattcctgacctgaggtgatctgcccaccttggcctcccaaagtgctgggattacaggcatgagctactgcgcccagcttttgattctttgtatacctgtttgacatgcctttctgtatcatctgatattgttttattttttctcaatttatttgaggtatataacatttgtgaattttttattgtataaccacattcacattttgttggtaaacccaactcaggaataatgtatgattcagttttttaaaatgctcatgtatataatgtaagtttcctacttttcatcttgaggtagttttggtaaggtatatgtttttaagagtttgtccattttgtttattttgttatttattgagatcaatttgtttatatatatatatatawaaatttttgttcttttaaacctttgctgatttgttcttctgtttctctttgtatttctaatattgggtattaagactcttttttttcattatcaagtatcagtggaatgccgagtacagtggctcatgcctataatcccagcactttgagagtgccaggtgggtgaatcacttgagcccaggagctggagaccagcttgggcaacatggtgagatgtctgtacaaattaaaaaaaaaaaaaatttaagtagccaggcgtggcggtgcacacctgtagttccagctatttgggaagctaaagtgggaggatcgtttgagcctaggaggtcgatgctgccgtgagccatgattgtgcccctgtactccagcctgggtgacagcaagaccgtgtctcaaaaaaaattaaaataacaacaacaaaaattcatggaagattttttttgttgttgttagtttttccagaaaccaactatccctttatttcagccttttcatatcagtttgcttttggtatatctcttgcaaatggcatacagtaggttttctttaaaaaaaaaaaaaaaagtcctgtttgtaatgaaaagtttgtctgtgtacatttattatgattaatgatatatttggacttgtttgtgccatattattttttgtattccatatcctacatctctatgccttactgtccccttttttttttaccctttaaaaatattggtagagttttttttcttattttctttttctatttctactggtgtgttagaacaaattcaaactttaaccccctcctgaacactacaagcactccatgtctcttattacctcccccaaacttatttggccatgtaatcaaactgaactgaaacaggccagtttaaaaaacaacaacaaaaccatgaaattcactgtaaccagaggtgacccagtttacctgagctagcatgataagaaagttctgttttaactctataaggagagtcactttgtaatgaataatctgctttttgttccctgtttgtgctttcttaacccattttctgcttagaaagccagccccctctgcttagctcagcagaacacgcattctatttttaagaatgagatgttacagaattgcaaacaaaagtcagtttgatctttaaactgaaagtcagtttgatctttaaactaaatctgttgtaattttgtcctttgacaatggtattgtcatcagcagtggattctgagtaggccctagaatgttcaccactcctaccctaagcccaagcagtgttatttatgttagttacattatgtgggtttaattatgagttatatcaagagacatataatattttagtggcagagaatacctttttttcatcattgatttgtttgtttttcttgagttctcactatgttacctaggctggtctcaaactctgggctcaagtgatcctcccaccgtggcctcccaaagtgttgggattacaggcgtgagccacagcaccttgcctcgttgattttaaatgttagttgaaaagttattgtctccaaaacccaattctctatccacttccaatggagtggattattgggttatgtttcttagagtctgttaatttccttctctggaaagagtgctgctactgcagtagggatcaatatacgtatagtgtgagaattcaatagcaaatgagccaggctgagtcccagggagggagttgcctcaggcatagacagctttgacccatagtcatctccacgctggtgactgttgacataaaggacaaggaccagccttgtgactcctggcttgcatatttacttgtgggggtagcggttactgcctttggacacttggcctttgtcttttctttggaaatattttatggctttagtcattgtgaataatgagtagtgcatataggcagtgaatcctcatctgtgggaatagcaccatttcgtggtttttttttttttttgagacggagttttgctcttgcttcccaggctggagtgcaatggggcattctcggctcaccgcaacctccacttgctgggttcaagagattctcctgcctcagcctcctgagtagctgtgattacaggcatgcgctaccacgccctgctaattttcttatttttagaagagacggggtttctccatgttggtcaggctggtctcaaactcccgacctcaggtggtccaccagcctcggcctcccaaagtgcttggattacaggcgtgagccaccacgcctggccatgaatagcaccatttcatgttttatttaatacctttagaagtttgctttgtggacaatgaaagagagtgactggttatttctctaggatttagtatgtataactttctttgtaacttcagaatatagtttartatcttttattttgttcaatatagtcaaacattacttaaagttctttgggaaatatcatcattggcagaaagtatcaaagtgtatcaatttgagggtccaaatggtaataaaattttggagactgttaaaacaatataccttgaatatttggggtggagtgatagggatggagtattgggggtggggttagtttttagagaatagcatcttatcacttagctttagagcttcgctactggtgggttagattagaaaaatgcagtttcttcttcctatttttttttttttctcttttttgagacagggtcttgctctgtcacccaggctggagtccagtagcatgatcttggctcactgcaaccttcacctctggtctcaagcgatcctcccacctcggtcccctgaatagttgggactacaggcgtgcaccaccactcctggctaattttttttgagctttattattagagacgaggtctcactgtgttgctcaggctggtcttgaactcctgagctcaagggatcctcctgcctcagcctcccaaagtgctgggattacaggtgtgagccaccacacctggtcaatttcttattattaatccaaagtgtcttactttaaacttttaagtttattttaaaaattcaagcctaggaataacttttgtgagaaaggcagagtaggtatttttatctcaggtgaacaggtaagaataatgaggtttagaaaggtttaatgactgaccaagattttataaggaagtaagtagcagaattgcattcacatatttttctgagtcctagtttctttataccatgtagaaatatcctgttaatatcatcaagctgttcatcaaactcaaatgagaataacacattatttatagaataaaggtttttgtttgtttgtttttgttttttcttcttgagacagaatctctctctgttgcccaggctggagtgcagtggtgtgatcttggcttactgcagcctctgcctcccaagctcaagtgatcttcccacctcagccccctgagtagctgggactgctggcacatgccaatatgcccagctattttttgtagtttttgtagagatggggtttcaccatgttgcccagtctggtctcgaactcctgagctcaagcaatcctctcgcctcggcatcccaaagtgctgggattacaggtgtgagccactgtgactggtctaaagtattttcatgtacattactttatttgacttttacaactgctgtatctaagcctttgaggtagatggaatcccaggtcacacagttacatgtttttgagccacgacagaagcctagttttccaaactttaaattttgtgttcttgaccaggcatggtggctcacgcctataatcccagcgctttgggaggcggaggcaagtggatcacgaggtcaggagataatgttccttttaagactagatagtaaatgatattaacatagattttcttcctcggtaatatttttctcttcttaaagcattccgactctccatggagtaactaccagccaggagactgtcagtaaataatatgtgataatagagcatattcttcccctagtaaagcttcttgctgaaattattgcaattgatagttttcatcaatgcaactccaaactggtaggcaggaccctattgtcttataattgccttataatgatgataacaataatagtatgaaccatttacttacttgatggattcatagatttattcatccagtattcatttgttgcctactaggctaggtattctgctgggtgccaggaatgtccttgagagcaagactaattcctactctcctggagctaacagtcaaagaaaacagataatttagcaaataattatagtaaccagtgaagtaggtatgattgaggaattaaaggaatatttggataatatatggaaggaggctggggaaactgtagaaaaactttccagaggaaacgaagtttaagctgaagtccaggaatgtataaaaagagataaagaaaagtaatccagaccaggagaacagtaagtgtgaagacctgaaggtgaaagaaagcatggcaagtctgagtccaaaactccaataagactggagaattatgcaaatgatactgaggagggaggcagtcagagccaagtagtgccctgtagactacagaaaggattttagactttatccattgcagaattataagagagaaaggacacatttaaaaaagttatttttggccgggcacggtggctcacgcctgtaatcccagcactttgggcgaccgaggtaggtggatcacctggggtcaggagttcgagaccagccttaccaacatggggaaaccctgtctctactaaaaatacaaaaattagccggacgtggtggcgcatgcctgtaatcccagctacttgggaggctgaggcaggagaatcgcttgaacctgggagacggaggttgcagtgagccaagatcgcgccactgcactccagcctgggtgacagaacgagacttcatctcaaaaaaataaaaagttatttttgacttcagtatttatttcattatacccacagttatcactcagaaaacaggtactatatatgatatttacattgatataacattaatcaagggggacaaaactgaatgaaagggagaccaattaggaggatgttataggatgatggtggcttgtgcccggggaagtagaagtgaattgacagattaaagatagatattttggaagtagaattggccgagcttgatgaataatggatgtagagagtgagagaaagtgaaaaatgaagaatgaccctgggtttggtggtaccatcatcaaaatagagaacagagaaggagcgagactgagtagaaagatcagctgagttttagacatattaaggacaaggtagttgtatgtacaactatagaggtcagcaaaaagatctgggatagagatacaaatttgagattgtaaaatatatagagaaaggagagtgtacaagcagaactaaaaggacagtccycatttaagggtctaaggtgatgaaggatgagcctgcaaagatgtttaaatggtgtgtttgcggggataagaggaaaaacaagagaatgtggcttcatggcaagaaaagtcttccaggacagaagagtgaatgatactatcaggtgctgttgagcagtggagccaaaaaagataggtggactaaaaatgcagtgaagcttcattaccctggcgttatacattacattggcagtgtgccaagaatggtttaaatgggctggtaaggtctagggatatttatagagtgttgaagaatgagtaggaagtgagaaattagagacattggatgtagataactcattcaagaagtgtggttgtgaagggaaataaaattgataaggcagtatttgaagagggatgtgtagttattaagggaatttatttccttatctgaagctggaatagacttgaatgtgttcagaatgctaatcaggaagatcattaagaacatgaagagtcaagagataatgagtagatcagagaaggctgaatggaatgggcttcacctgatattgtaatgtattaccaggtattaccagcctagttgctggaaggttatgagtaaaataatttatggttatctgtctaaatgggagtactcttgcctcagccaagtttcctgattgtgtagcttttctccccaacttgctgtgaatattccctgggaaaaggaggattgagaaatcattgctccttggactacctttatgtggttgggcccttcttgttccactgtgccttagttgtcacagaatgtactgatctggagtcctgggcatcaaatgcaggcttttgtataggtgtaaggaagtcggaagggatggatttccacggatgcgcttccgtgcctctaaargaatgcagagaggggcatatatgcattttaggaaattttattattgttagccaaaactgtagtctaccatattacccatttaaactattcaagaagtcagaactgtcatgtagattcaaagaacaaatatttccagttttatatagattgtttcagaaagtagaaaaagaggatatattaccttagcacattttatgagtgtcttcgtctgttcgtgctgctataaaaaaataccacagattggatcatttataaagaacagacatttattttctcacagtcctggagtctgagaagtccaagatcaaggtgttggcatttgtgtggtgagtgccttcttgctgtttcttcacatggtggaggatggaaaggcaaaaagggctgaaagctgtatgaagcctcttttttttcttttaattttgatttttttgagatggggtcttgctctgttggccaagctgacctcagactcctgggcttaagggattctcctgcctcaatctcctgagtagctgggactacaggtgcacatcaccatgcctggcttaaagccttatgaaggccttaatcccgtttacaagagagaaggcctcatgacctaatcacctcctacaggccccacctcgtaatactatcacattggattttaaagtccaatgtgaattttggacgagacacaaacattgaaaccttagcagtgaggatagtataagtatgatgtcaaaattggacaagaacaatttgagacgagaaagtatataggccagtcttacttattaacatacaggcaaatatcctaaataaaagtttctaggcctagatacttttattagtgaaagctgttaatatttaaggaagaaataacaccagtcttacataatttctttcagaaaatagaggagtaaggaacagttcccagtcagttttaggagaccggcataattgtgatataaaaatctgacaaagaaattataagaaaattagagattattatcccttatgaaaataggtgcaaaaatcattaaaaagatattagctaatagaatctagcaatgtatttgataaaattgaagttaggttgggcacggtggctcacgcctgtaatcccagcactttgagagaccaaggcgggtggatcacctgaggtcaggagtttgagaccagcctggctaacatggtgaaaccccgtcgctactaaaaatacaaaaattagccaggcatggtggcacatgcttgtaaacccagttacttgggaggctgaggcaggaaaatcacttgaacctgggaggcagagggtgcagtgagcagagatcacgccactgcattccagtctgggtgatggagcaaggctctatctcaaaaaaaaaaaaaaaaaaaagttgactttaactcagaaatgcaaaattagtttaatcttagaaaatcaatcactgtaatttgccacattaacagaagagaaaaactatgtaagcatttcagtagatgcagagaaagtatttgacataatccatgcccatttgtgagaaagactatgaacaaattaggaatagaagagaacttgataaaaagttatccatgaaaaacctataactaacataatattaaatattcaaaatgttaaatgcttttcttgtaagatcagatgagaagcaagacgaggatgtctaccacttcatttaacatcttatagaaaattctagaaaatggaaagaagtaaagctccctattatagaagatatgattgtttatatagaaaaaatctaaggaatgtacaaaacatttatgattaataataattttaccaaagtataggatacatggtcaatataaaaattaattgaatttctataaacatgcaagcaattggaaaatgaaataaaagtttttatttataatagctttaaaaaatctacttagggatgagcttaataaaaggagtgcaaggtgtttttgttaaaaacgataaaacattgcttagagtaattaaagaactcggtaaatggagaagtactatgttcatgtattataagacttgatattttgagatatcacttctttccaaattgatgtataatcccagcaggcttttttttttttggtaaaaattaataattggattcaaaaattcaaatcgaaatgcaagaatctagaatatctaaagcaatcttggaaaataataaagttaaaggactgtacaatctgactttaggactaaatataaaaccacagaatcatgatagtgtggtgcttgcatagggcagaaaaatagatcagtaggatgcaatagagagcccagaaaggttaaaaaaaaaattgttagggaaaggacagtgttttcaataaatggtattgaaataagtggatatccatatgaaaaaaaatgaaccttaatttcatctcacatactacctcaaaattaattttcactcatcaaaaggctctactggcctggcatggtggctcacgcctgtaatcccaacactttgggaggttgaggcaggtggatcacctgaggtcaggagttctagaccaacttgaccaatatggtgaaaacccatctctactaagaatataaaaattagctgggcatggtgatgggtgcctgtaatcccagctactcgagaggctggggcaggaaaatcacttgaacccaggaggtggaggttgccgcacgccgagattgcaccactgcgctccagcctgggtgacagagcgagactccatctcaaaaaaaaaaaaaaaaaaaggcaccaccaataactttagtaggcaagccacagattagaacatatttataaaacacatatgacaaaggacttgtatttagaagattatgaagagctcttataattcaatagtaaaaagataactcaatttttaaaaaggtaaaaaaattttaagatacttcacaaaggaatatatattgatggttaataagcacatgaaaagatactcaacatcgttagtcatcaggaaaatgattaaagccacaatgagatacccgtacacacctaaatggctaaaatgtaaaatgactaaaatataaaaagctgataccatgtattggcatgaatgtagagtagttcgaactttcttatattattaatgtgaacataacatgtattagctaggatgtgaagcagttgaaactctcatacattgttaatgggaatgtagcatggtataatcactttagaaaaaggtctggtagcttcttataaatctaaatatatatctaccctttaactgagtaattctacacttttagggatttacccaagagaagtgaaatatagcttgtcaaaaaacatgttataggaatgttaatagctgaaaaatggaattggagaaacgataaattaactggggtatattattcatattgccattgttacctgcaacaacatggataaatctcacaaatactatgctgagttgaagaagcctatgtaaaaaggtttatatttgtatggttccattcatatgaagttttgaggaagtaaaagtaatctgtggtgacataatgagaataatatttgcttggggtaggaagatagtggtttgtttggggatttacgaagaaaggacatggtggaactttctggattgatggacatgttctatattttgatagagatttaggttatctgagtatatgtacttaacagacttatcaattggcatacrtaagattaagtaatttaagatttgtacagwtgaatgtttgtaaatttacctagaaaaacacacaaaagaattgcaatcaaatactgaattttagcaaaaataattttataaaataagcgaattttacaaaaataaggcatattaaacttattgtgaaaagtaaaccggctgggcgtgatggctgacacctgtaatctcagcactgtgggagaccaaggtgggaggatcacttgaggtcaggagtttgagaccagcctggccaacatggtgaacccctgtctctactaaaaatacaaaaaaattagctgggcatggtggtgcatgcctgtaatcccagctggaggctgaggcagtagaatcgcttgaacccaggaagtggaggttgcagtgaaccgagatcggccagcctgggtgacagcgtgagactccatctcaaaaaaaaaaaaaaaagaaaagaaaaaagcaaatctataaaatgtttagaagaaaatataagcacatatattcatgactgtgwatsagggatatatttcttacatggacagttgttttggagagcaatttggaatatccagtactttatgactcagtagttcaacatccaagaaactttttctacatgcgcactaggaaacaactacaagaatgtttacaagagtattgttttaatggagaagaaaaagatggaaagaaaattaaatttccatttactagagaatagataaataaatattggtatattcatagactggaccactgtctgaagatcagtgaactaaagtgaaatatatccacatgggtgaatctcccagttttcataatgttggctgatgtcaacagaggaatacatataatataataccatgtatatataattttaaaacatgtaaaacaatactactaattttttacaaatccaaaaacacgtattgaaaatatttaaaaaattaagaatagttgttaatttaggactggtgggaggtgggacttgatacacttggaaagcaagtcacaggggccccagctgttatcgtaaaggttatttcttatgccagtggtgtgtgaagtcatctctttgttatattattaactatactactttatttgtctaaaatattttctaattatcacccactgcccctaatcctatttcattccttctgtatgcttgccactaatgccctttacaattcagcagcagttaatggctggcctagagtgcctgtaatctacactggggagatggttccatctagtgggaaaaatgttgcatgtattctatgagacattccttttaggaaggaaggataaagaagtaatagtttgcctgagtgcttttatttcacaaaaatttaagagacaggctgggcatggtggctcacacctgtaatcccagtactttgggaggccgaggcgggcggatcacgaggtcaggagatcgagaccatcctggctaacacggtgaaaccccgtctctactaaaaaaaaaaaaaaaaaaaaaaaaaaaaaattagccaggcgtggtggcgggtgcctgtagtcccagctactcaggaggctgagacaggagaaaggcgtgaacctgggaggtggagcttgcagtgagccragattgcgccactgcactccagcctgggagacaaaatgagactccgtctcaaaaaaaaaaawaaaaaataaaatttaagaggcaaagaaaaagttrttatttagaaatatgtggccttttccattattaagataatgctgtgaatttcctaggacatttaggtagaccaacaggactcagatgggttcttatttctaacttgcatatgttttgtttttcagaaggagttgagccttccaagaagaggcagcttgtaagtagatgattattaccattatgattatgatctcctacttaggaacccctcttgggaacatttcccactatcatgtggaggaatcccgctcagtacacaatttctttctgtgtactcctatctgagctagggaagccagcaggccaactgacttctccsactaggtcagatcttcccctcctccccattcctcccgacctccaaacctcttccctctcagtttctacatagcattctgggaaagttacaacttaaatattcatcacagtcttatacttgtgctttgggatttactgagttttcgtagactcaagctaaggaagtaggaatattaaaatggaaaccctttgcatttacatctatccggtaacatggtatgaggagaagaccaacttttctgataagttgaggcaaggccagctaagtttggagactatgttgaatggaataggttcccaacctgtttggtttttttctggcttcagggttaggggagattaataaatagtctttgcccctggattttaatttcttaaattctcttggactgcttttcctctaggaattctgttggggcagtattagaaatttggccaatcagaatctcctggaatgtttgttaaagtgcagagtgtgaacttaatgcattaaaatctctgtgttggggcccaaaaacctgtactgtatatacctaaaacatactcatatttaccatgatttactagtaaagtcacatctggggaaccctaaggaaatagagctgtgataaaacaatggcttttaaacttttccttaacaaaaaaagagatgtaattaaggaggagatcacaacagcattcatatttattaagtatactttatatacacatcatatgcaatttttaaatgtttaaatgaaacatgtagtaattctttctgttactgtccattttaggattttgttttgtgaaaaatgctctagtgattaaattttcctctgaggtttttgtgaagccttttgggctgtttacgaaaacttattttggtttgatatgaagaggcttgagtcagaaaactcataaggttcagtcttgaccatgccatttaactagctttgtaaacctagacaaatcactttatcttcttaaacctcagttgccttatctataaaatgaagataatgttacctgtgttttcttcttactaagcctgttagaaggatcacttaatatatgtatagtgctttattacttatagtttaattttaatatatattagttttagaattcttaatgggttaaatttggatgaattctattatttaagaggcacattttaaattttaaattcagtttctagcagtggatattcagtctagcttcacaagtgtcctgagtcttctgtaaatggcaagggctctaccaggactcttagaggaatgagacaccaaataggtatgcataactgaaaaggagtagcttttcagcatcatagtcaggaaatatttgtacttggtcatttttctactatttctgccccccccgcttttttttggttgcttctatttgaaaactgcctgagatttgccttttcttagtattaagtgaaataaattaaggcctgagacaggtagcttcttgcagaaatgtgtgtcctcaatgaatggagttgctgggaagaaggaggagtattcttatttttattttataccagaataattttttggtcattttagtgatatctaaagttaggcctactctaactgccttaaaaacgtttaattaataaggatcagaaatagattttccctcctcttttttgataaagtaactcacatttaaacaattgatcactcagtaaatacacagtaatatctactctgggtcaggtgcggtggctcacacctatagtcccagcactttgggaggctgaggtaggtggatcacctgaggtcagtagttcgagaccagcctgaccaatatggtaaaaccctgtctctactaaaaataaaaataaaaattagccgggcgtcatggcgtgcgcctgtagtcccagttactcagggggctgagacaggagaattgcttgaatccaggagacggaggttgcagtgagctgagatcatgccactgcactccagcctgggcgacagagtgatgcgccgtcaaaaaataaataaataaataaataaaaaagcctactctgtgctgggtagagtgatctaagttctgaggctgttaagattcaattagataaattcttctcttttgaagagcttacacttaagtaagccagaagttcttcagttctttaatataaacaatatcctttcttatctttaacattagaggagtcgaaaaagttttgttctggaaggaagcaaggaaacatgggtactaatataggctttgccactaacaaattatgtgtggctttaaaacaggagctccyacttctggacctgaattgccatacttgtaaaatgaagggattggctacctgatctctatgcttagtcatctccccaaacagttaaagttccatggtacctcttgtacacagagctgggcaagtctttgtagggagtgtgcagtaggaggcaaagtactgcttagcatttgtagtaaagaaaacaggtaagaaccacaaaacaaatatttgaataagtttaattactacaaaatttgttgtgtggaaaaactgatgttaataaaatgagtgacttaccatttgctccactgtttctcgtcctcatagcctgatctggaaaatttttaaagtttctataattgtcatttaagtcttggtcagaaggagggggcatcatatttgtgtccctgtttgcctttcttagaatggttctcccaagagcgaatcctatggtgtgctcattccaggttataaaggcccgtttcctctgatatatccttcatggacatagagaaatttagaatttgcctctagtttggtgttcttgtcctttgagagagcgtttttgttaattaatttttgaggctttcaattgctgtgcttttcacgtaatatgttagttgcattaaaatggacaggaactcaaatatgagtttctagacttatgtgacaacttggcattatacaaaatacacattcttccactcaacaagtaattcctccaaagtctccaaattggtaagtggaagtatagcataaaaattaacagcttgggtttgcaagtcaggcagatgtgggtttcagtcacggcactattacttactagatgttttttggtaaaatcagttactatatttttgtctttttgcctccattcactttgtcatttgctcaaatctttccatccatgcatccatcatactatattattttagttccagttaggtgtaggcactattctagatactggagatacagtagtgaataaagcagacaaggtccctgtgctcatggagtttccattctacttaagagagacaaaaacatgtatgatatgccatatggtacttactgctatgaagaaaaataaagccagatatcagagaggaggatgtgtgtttctgtgggggtgagggtttaaattttaaattttaaattgaattgtctaggctgggtgtggtggttcacacctgtaatccgagcactttgagagactaaggcaggaggatcgctwgagttcaggagtttgagaacagcctgggcaacatagtgagaccctgtctctacagaaaaattttaaaaatcaaaaaattttgtattgtccaggaattttctcattaaggcaacatttgagcagagaacaggagtctggaatgagtgatactgagatagagatagatcgataaatatatatgtatatattatatatatttatatacttatataagtatacatatatatttatatattgtatacatatttatatatgtatctataagtacacacacacacacacacacacacacacacacacatttatagtgacattggtcagattagggaagagagctgttacattctaatacgcaaaatgcaaacatcatctatgcctgccacgataagggctttattggggcaaggtggttatgaaagttcttttggcctggctcataccatttattttagatgtagcttcctgaaactaaatcattttcatttttagaaagctatttcatatttaaacccatctgggtatttttttaatgcattaaaaatgtagtttagaatatcagacctaagggagttgataactttgttcaaagtacaatatctgtgaaaagaagattttgaagttctaaagttacttgtatctgtttacccaggctagaagggttttatattttactttttcataattgaagcagctctgaatggcttttcttgcccaatgctatagtgggggcctctttttgatgattcctttcaaataggattgtttcttttgctgttgttgytattttgtttgtttttgtgacagggtctcattctttagcctaggctggagtgcagtggcgcagtctcagctcactgcagcctggtcctccctggcctcaggagatcttcccatcacagcctccygagtagctggcaccacaggcacctgccaccacatctggctaatttttgtattttttgtagagatggggtttcactatgttactcaggctggtctggaactcctgagctcaagctatctgcctaccttggcttcccaaagtgcttagattacaggcatgaaccacaatgcctggcgactgtttattttgtttgtgaatttcagcaccagtacctagaccctgcatttgggagcttaatgtaaataatgcttatgtctccagttaccctgaaagtaaagcttttctaatacccattaggcttaagataattttcctcatatttcatgaaatgtcttgctttatttcttagaggctatgagcagtcaattgagataacagactgtaggagtggagaggtagctgttggttgcattcatcatggggtatgtgtatatgtgtgtgttgatattattggcattgctggcttgtagtctttagagcccttggggatagttaaccttttattttgtcagcttattcatttgggcagtggacttagataccagatattggatgaaagttaatgtctggtgtctgcagtgataggcactgcatagtgggcagggaggagttcctgggccccagggatgtgatgtgtcaaactttgttcctatgaaactgacagtgtcatgtactttcccattctgatgcaacttgatgcctggatcartgcttctggaaaatgtgctaaaaagagataccacctgctgcatacacataataaaccctttgttgaggtatcagtggcgtctgatatagggctttaggttttctgtggggctttgaaaatcaggaaattttgcaatctttcaagactctaaagcccagagtgatagctttgtgttacatttaagaccctgtcttttaaaagttggtgggaagtaatttcatatagattctctaagtgtccaatgggaaggcaggacrtagcagaggttgggagggaagtagccatagtcatcactcatatccctacagggaaccagtttgttgttaaaaaatggatgtagttgttggcgagctttacctgtgtaggtgggatctgaaaatccttgagaacctgtttttgttactgtatgttgagaatagttgtcatgctcattatccccacatttatatcgctagatctcataactgtccattcaccataatgtgactgaatatttcagagacatctgaactgcagcatttatgaatctgagtcattgtctttctcaaaaatcaggtcctctcttatactctagcttattaaatggtactgcttcctcaagatagaaaatttagttatttttgttgccatgctcttccttacactcacaagtcttttctgttatacctctcaaatatctcttggtgttctgtctttatttttattttattttatttttttgagactgagtctcgctctgtggtccaagctggagtacagtggcgccatctgggctcactgcaagctccgcctcccgggttcacaccattctcccacctcagcctcctgagtagctgggactacaggcccccaccaccacgcccggctaattttttgtgtttttagtagagaccgggtatcactctgttagccagtatggtctcgatctgctgaacttgtgatccacccacctcggcctcccaaagtgctgggattacaggcgtgagccaccgcgcgcggcctcttttttttttttttttttttttttttttttttttttgagatggagtcttgctctctcgcccaggctggagtgcaatggcacaatctcgcctcactgcaacctccgcctcccaggttcaagtgattcttccgcctcagcctccccagtagctggtactacagatgtgtgcaccacgcctggctaattttttgtatttttagtagagacggggtttcaccacgttagccaggatggtctcaatctgacctcatcatccatccgcctcggcctcccaagtgctgggattacaggcctgagccactgtgcccggctggtgttctctctttctttatactaccactggtttgtccagatagtcacagccattgtaatctcttgcctctgctactgccataacctcctaactggcctttctttatctggcattgctcaccctcagtctacctaactatcatacaatagccaggaaaagctttttaaaatgcggatttcattattagatattaatttaaacttttttggtgaaawttttttttttttgaaacagaatctcactttgtcacccaggttggagtacagtggtgcgatcacggctcagtgcagccccagccttcctgggctcaggtggtactcgcacctcagtctcccaagtagctgggaccacaggtgcacgccgccacacccagctaatttttgtacttcttgtagaggtggggttttgccatgttgccctggctggtctcraactcctgggctaaaactacctgccttcctcggccttccgaggtgctgagattacaggtgtgagcctctgcacctggcctttggtgaattttttcttactcttaggatcacacctgactatctatacagtgtggttgctatatttttctccatgttttacacaatgtgttctctgtgcctggaatttttgttttgtttcgttttgttttgtttttttgaggcagaatctcactctgttgccaggctggagtacagtgacgcaatcttggctcactgcaacctccacctcctgggttcaagcaattctcttgtctcagcctcctgagtagctgggactacaggtgcacgccatgacacccagctaattttttttttttatttttagtagagccagggtttcaccacattggtcaggctggtctcgaactcccaacctcaggtgattaagcaattctcctgcctcagcctcccaagtagctgggactacaggtgcgctccaccacgctgagctaatttttatatttttagggtttcaccatgttggccatgatggtctcaatcttttgacctcgtgatccgcctgcctcggcctcccaaaagtgctgggattacaggcatgagcccccgtgcccagctggaatgttctttttccatctataccaatctagttcctacacacctttcaagtcccagcttacacctcacttccttatgaaaggcgttcctgacctcacccaaaccttgctgtctgtagactaagttgggtttcccagaacatactttcaataaagcctctactttttcttcatagctcttacatcagttgtaaataaagaactatttgtctgccttttcccgttgtgtagtatgtaagtattagctcaggctgctgtaacaaaataccacatgcttaaataacaaaaatttattttcttacagttatgcaaactagtagtccaagaaggtgacaacatgctaagtttctggtaaacctctcttcctggcttgcagagagtggccttcttgctgtgtgctcacatggcctttatgtggtacaccagcctgaggrtaggggcatagatctgtctcttcttctttttcttcttccttctccctccttccttattttttccttcattttcaagcccaacagtcctataggattagagccacccctatgacctcatttaaccttaattacttcctaaagaacctatatggaaatatagtcagattgggggtaaaagctttaacatgaattttggggagacacagtttagtccatagcagatggtaagctccgtgaggtcaggaccatgttgtgcggtacaatatgctgatcccagagcctactatagagtttaacacaaattggcaatcatttgaacttgttccaaacattggtatggtctggcacaagaatacaaatagaggtatacacgtttaatcatttaaaatagagctaccaaattgtaaaataaaataaatgctttgtcctcctacctctagaaatatagttgcataataacaaattttgaaatatgtgtaaagctattgatttttaaaaaataagcacatgttaaatatttaactcattgttagtaaggaaatctggcmgatatattagccagttcaaagaagtaaaagaaccacaaagtgatatgtggtatgtgtatgtgtagtgttgaaataaatgtattatttattataaaattgagtttttccatggagagaagggaagtcagttgcaccttcactgtacagaattgatcagcatgtctatagacaaacattattttgtgcactggatgtactagctcacacctgtaatcccagcactttgggaggctgaggcaggaagatcacttgagcccaggagtttgagcccagcctgggcaatgtagtgagaccctgtctctgcaaaagtttttttaaaaaaattagccaggtgtggtggtgactgcctgtagtcctagctacttagggggctgaagtgggaaggttgagcctgcagtgagccgtgattgtgccactgtactccaccctgggtgacagagagagaccgtttcaaaacaaaacaaaaaaaagaaattatttcacataacgtcagttacctacctataacttacagagttgtaaagtagctcaaagacaataaaagacaaactagaagagtattctctaaacaatatgcatagttttttattggaaatatctagtaacctttttttcttttttaactttttccaatttttttttttataatctcctaccttttcatctaaaataatttgaaacgtttttgttcacaaaacaagggtggtctcattgggtttggcctgattatttgcatagtgtggccagaatattaatttatcataaagccttcttaaatttactttgctgtaaatttttataaagaatctcagattggacttttaaaggcctctattatttgtatttygaggctaggaaggcaagcctaagaaataccacatttcacttgtaataactataaatttgggtgaattcctaagggtcctgggccttccaggaagtggccttccttaccatctgtaagtctggaccctgtaaagccagataccaggccagttttcccaggaaggttttgtaagtattggctccataaagtcaaccatagttccttaaaagtggtttgttatacctgatcaaataagcatgattctcaaatgtgacctttcaggcaagctctttgttggacaaccattttttacaattatattctggtcaaaaggagaacagattcttgtttagccctattcaaataaccatattgccttgaactgtaaggagactcagtaagacgttcttagttctgggttaggggagggtcagtgagaatcagatgtgatttaggaatgtttcattttacaagagcaaagtctactyaattgttaagagttatagatagcctaacaaggaatacaactggctcccttgcatattagaaaatggacattaaaataatatttcaaacaaattactataatcatttcttatagttcataccgttctgtgtacctaattctcatttcactggatcttacgttagtagtcggcttcttaactaaaaaaagttctggaaattctgactcattccactggaatgatctggaagttgtccagttgtccaagcaatgctattggaagcctgtctattctttgatgtgtcagtagttttaaaatacctgccgcagtccttttccgtggagctctgagacaacccttctttgttgaagacacagactctggcttctagctgattgtagagccttcagacaggcctcagcacaaaacagaatctctctgcatgtgacagagtctcatatcataagaataatgcaactaacaaggaaattaagttgtttttgtcacatgtaaaatgagartaataaggccagtccaaaaacttatagcaaactgtaagagattattgcaaataagacagtgaaggttacatctgatttagaaaacatagataaacataatttttagagagggaaaaatctttatgtataacttataatattcttgtggtattatacagacaccaaaaacataccaagaatatactaaggacatcaagtaaagagattcagtgggtctggaataagtcctatacatctatatttttataaaactccagtcctatacatctatatttttataaaactccactgacctagaaggtgctggattgaaatgttaaragtaaggttgttaccaagtaaacattttcartttttattatttatttattyattyattttagacaaggtcttgctctgttgcccaggctggagtgcagtggctctgtcatagctcacggcagcctcaacctcctgggctcaagcgatcctcctgtttcagcttctcaggtagctgggactgtaagcatgcatcaccatgcccagcttatttatttcatttaatttattttttattttattttaattttttgcagggggcggggtagagatagggtcttgtaatgttccctaggctggtctctaactcctgggctcaagtgatccttctgcctcagcctcccaaaacgttgggattgcagatgtgagccaccgcacctggccagtattttagataataactgaaattaagactgaaaacacttcttcctgtaggatattttaaaaaaaaaaaaaaagactgaaaacactaaacttttgtttcctaaaatctggcagagttctgtcaggactcagaaacgttatggataatgaggacattgacaaatctctaggagttttctattaatcatacaataactagaatatttatagtaatagcattttacccatacaactttaacctagggaacactgaacatgtcttctggtagataacttttctcatgaaattcattaataacaaaatattaaacctaattatttctaacatttctctaaaaaggagaaaacacgtctttgtgattttgccaaggatgttttgggatatctcagagatagtttttggtattaaaaatacactgaccccagcactttgtgaggccaaggtgggaggattgcttgagctcaggagtttgagaccagcctaggcaacatgttgaaaccctatttctacaaaaatatgtaaaagttagctggacgtggtagcgcacacctgtggtcccagctacttgggaggctgaggtggaaggattgcttgagcctgggaggtggaggttgcagtgaactgagatcatgccactgcactctagcctgggtgacagtgagaccctgtctcaaattaaaaaaaaaaaaaaattacactgaaagttttattttattattttctacacgtaggatctgatttgggaaagacaaatcttcaaataatcgttagtggaaacacttaagataggattgttggtgcttgagaaataatacctggttacttatttaaccgaagtgayggtaaaacatttataaacaaacatagaaagtaacacaattttaaataactgtagttttttttatgaggagccctatgcttgcttgattaaggacctgataagtcagcataaagcacagaaaatttttctagcaagacacaaaatatttgctaactaggcgtattacatagcaaaagaatatactttaatattgtaggtaatggatggcagtaaacagtaaaccaaggacatggactcaccaaaactgaataaattatttgctaaaattttaaccagttttagcttttcagactcaggtattataaaccatgacagccaaaattcacattccgagttgtgcccttcattagtcttcatactctggaacagacttatgctttacttgagtacaagttttaggggttctcaaggtcacaattaatttgataatgagtactaagatgttattaagatgcagtgcatttttagtgttatcatcaaatgaatcagtaagtgttttttaatgtctcagtttccattttcaatactgtaattattgatggttatatcccacagaaacaatttggggtccttcattttatgaattttggcaaatatatatacccatgtaactacaaccacaattaatagatagaacatttttcttacccccaaatattccttctgtagttttgcagtcaatcccatcttccacatcttggcctcaggcaaccactgatctattgtttggcactacagattagctttgcctgtggtagaatttcatataaatgaaaatgacaaatgacctgcttttttgtaattggcttcctttatgtttcagtgtttccttttgtgactataccactatttgatggatatttgggttgtttctagtttttggatattatgaataaagctgctataatcattcatgtataagttttttttttatgggcatatgttttcatttctcttgggtacatacccgrgattggtcagcccataaaatcagtgtcccactctgctgccacaaatgggaataacttagctataaataaatacaaaacaaaacccagttatgtaaagaaaaattgaaattagaaatgtggagattccgtaaacttctttgttcatctgggarccaacttcagattaccacttcagatttacctgtgggaaccaagcactgatgtacatggatggtccacgtgaggtgtacttctctgatgtgactcacaggttaattctttggacatttggtggaagacttccaaaactgtttaacagacagtttttttaaaaaaagtaaaaacaaaaaatcatggctttcatccagatataaaatgaaaacattcaaagatgaaagaaaaacagcatatcatcaaagagagaaacaggcaaatattacaaccaattccattatcaatttttatacaattgaaaatggcaaaatgtcaaaaatgacagttgaattaacactgcacatgtctatgtgttcatctatttaaatgagcaataaagtaaaggcaaattcataaattattaaaatatttacacttttctttggctttatttttaccaaaattgttatttgtaatcaataatttcttgtaaattgtattcttttaataacaatgccaaatgaaacagactttcttgaatgactatatttcttagatttttttttttttttgagaccgagtcttgctctgttgcccaggttggagtgcagtggcactgcaacctctgcctccctggttcaaggaattctcatgcctcagcctcccgagtagctgggactacagacatgggtgccaccacacctggctaatttttgtgtttttagtagagatgggggtttcaccatattggccaggctagtctcgaactcctgacctcaagtgatccgccctccttggtctcccaaagtgctgggattacaggtgtgagccactgtacttagcctcttagatttttattttaatatttaccggtttataggatattgcaaaggatagagatgaagagattcatagggtgagttactagggaaggggcagggagcttctgtgccctccccagccgtgtcacttcaataacttccatgtgtgcagccatcctgaagctcactgaaccctgtcctcttgggtttttatggaagcttcatgaagtcaatatttcttgccccaggtgtagggtggaactctctcatgggagagccttaagacccacagtcagaaaggttggggaacattaaagtgaaaggagagctggagaaggtcagaggcctgcccctgaggcctaacgcagccaacattctaacaaaagactgtaactagggctatgggagttgtaagccagaaaccgtagattaaaaccagtatgtatatcataacaccacaggtcaccccctagtttgtgaccacagatcttttatatcaaacaatatttgtatatgcagtcattaatcattagtccagtacatcatattgtatgaatgtctcccaggatgaggccattccggtttgcaagtttcctaaatcttgtcaagttccaaaagcaggattggccttggtaaacacacagcttcatactttcatgcatctggaataattgagcttgagatagtatcatcttttgttcttagactcttttgggctgttaacataacattgaattttcctcagttagtaaccctaactcatttattcacttctttactttcagctatggtttctccttctttccgtttatacccaaattttttcacctctgaaagggacattagaatcttcttgtgctgttccagattgcaggcagcaatacaagtctaggagtaggtcttcctcagtccactcccattcagatagggtaaagttatataggagcagaactagtgagctatttttaccatcaggcaatatagttgcattcactgttagtcccacttttgctaaatggggtgaaagcactactcaccccagtaatgttcttaggaattttgccattaggtttaaaaacatagttacagttttttcttagaaatcatctctgatgtttcagcacttgtagttgcaaccctggtcctaggaccactgcatcaggtaggagagaaaaaataaattttttaaaggtgatttggggaggaaagaaaaaactataggctaggcgaagtggtcatgcctgtaatcccagcactttgggaggccaaggcaggaggattgcttgagctcaggagtttgagaccagcctgggcaacatggcaaaacctgtctctaccaaaaatacaaaaaattagctgggtgtggtggcacttgcctgtggtcccagctactcgagaggctgaggtgggaggatctcttgagccctggaagcggaggttgcggtgagccataatcacgccgctgcactccagcctgggcaacagagcaagaccctgtcttaaaaaaacaaatagagccaggcacagtggctcatacttgtaatcccagcactttgggaggccaaggcaggcagatcacctgaggtcaggagttcgagaccagcctggccaacatatagtgaaactccgtctctactaaaaatacagaaaaattagctgggcatggtggtgcatgcctgtagtcccagctacttggcaagctgaggtgggagaatcgcttgaacctgggaggtggaggttgcagggagccgagatggctccgctgtactccagcctgggcgacagagtgagactctgtctctcaaaaacaaacaaacgaaaccaaaaaaagaaaagaaaaagaaaaaattatagtagttatacaagtgcgctcctcccctggtaagaattgtgtagtcatrctagcatcctccccatcccctcttcctcagatcaaccagaaaaacagagaaaaagtcccacgttaagtatgagcacatacgtccttatgatcgcctgtaagccagcccttcatgctttttatctccccctgttttagacaaccaatgtttcaattgcccattctacttctctatcaaactattactctaaggaggatatctcactctgtccattgttggacattatgggctgtatagtgtgttccttggtctgaagaatgatggtgggccatccaaatccatgcaatatcttccgttctgttttttttgttgttgttgtttttgtttttactctgagaatttttatcttccatgggataagcaaagcccactccagagtcagtgtctattcctgtcaagacccctttgtagctcccagggctaccggcatcagtctcatttgccagccatgttcagggccttcctaccagagaatctgcgccatagccatcagcaatctctgtctctgttgctgagaaacagaacagttctttctggcattttgtacctgaaagggtgcaaaaggatcatgtctagattcagctcacctctgcactgctgcattgcccccatactcactttttttcagggactgagttggccacctcaagggagcacatgggatgtctacttatccatccctgtcaccttaatgcatccctcaaatctccttagggccatgctccatatgggcattcttttaacaggccagatttccattgtcctctcacctgagtatatagccaagccattggttacattgcatgaggtcagtaaagactcaaacacaggggcttctaccattgttcaattcttccatcagtcactgttagaaaaatataatgcaattcagcccaccaagcagatctgtttttaccttctttgatcagaggagtagtcttccaaagcaggatgatggttttcatttaccttggaattgccatccatgaaccaaacagctcttgatcaattttttttaattaaattttatttggaggagatttgctctgctgaagcaatagaaattagaattggccaaaaatatttttcctttcttttcttttttttttttttttttttttttagattcaggggtacatgtgcaggattgttacatggatatattgtgtaatgctggggtttcggcttctagtgaacccatcagccaaatagtgaacataatactcaataggtagtttttctatgcttgccatacctcctctccccttttggagtccccagtgtctattgtttccatctttatgaccacacgtacccattgtttagctctcacttataagtgagtacacatggtatttgattttctgtttctgagttatttcatatagaataatggcctccagctacatccacattgctgcaaaggacaggatttcattctatttatggctgcatagtattccatggtatatatgtaccacattttctttatccaatctactgatggtgggcacctaggttgatttcatgaatttgtattgtgaatagtgctgcgataaatgtaccagtgtaggtgtctttttgataaaataattttcttatgctatgtcataaggcccaagggaaaaaaaagagctttacaattaaaaaaaaatwtttttttttaagatttcttttcccggcccagcgcgatggcttacacctgtaatcccagcactttactttgggaggctgaggcaagtggatcacaaggtcaggagttcaagaacagcctggccaacatggtaaaaccctgtctctactaaaaataaaaaaattagccaggcatggtggtgtgcacttttagtcccagatgcttgggaggctgaggcagaagaattgcttgtacctgggagccagtggttgcagtgagccgagatggtgccactgcactccagcctgggcgacagagcgagactctctctctctcaaaaaaaaaaaaaaaaaaaaaagatttacccttgggtagatagccagtagtgggattgctagatcaaatggtagttctatttttagttctgtggaaatcactatactattttctgtaggggttgaactaatttacattcccaccaacagtatataagcattcccttttctctgcatcctcaccaacatctgtcattttccattctgactggtataagatggtatcttattgtggtttaattttcatttctctgatgattagtgatgttggatatttttttcatgagtttgttggtcacttgtcttcttttgtgtctgttcgtttctattgcctactttttagcagatttatttgtttttttcttacgatttaagttccttatagattctggatattagtcctttgttggatgcgtagttggcagatattttctcccattctatgggttgtctttttattctgttgattgtttcttgtgctgtacagaagctctttagtttaattaagtctcatttgtccattttcgttttggtcatatttgtttttgaggtcttagtcataaattatttgcctaggccaatgtccrtaagagtttttcctaggtattcttttagggtttttatagtttcaggtcttaaatttaaatttttaatccatcatgtgttaatttttatatatggtgagagataggggtccagtttcattcttctgcatatggctagccaattttcccagcaccattcattgaatggagtgtcctttccccattgattattgtggtcaactttgttgaagatcactttactgtaggtgtatggattgacttctgggttctctgttttatttcattgagctgtgtgtctgtttttgtaccagtaccatgatgttttggtgactatagccttgtagtataatttgaagtcgagtagtgtgatgcttccagctttgttatttttgcttacgattgcttttactatgtgggctcttctttggttccatatgaattttggaatggttttttctgattctgtgaaaaacgacattggtaatttgattaaaattgctttgggcagtgtagtcattttcacgatattgattcttcctatccatgatcataggatgtttttccatttgtttgtgttgtctgtgatttctttcatcagtgttctttagctctccttgtagaggtctttcatcttcttggttaaatgtattcctargtattttattttggttgtggcaattgtaaatgggattgagttcttgatttgattctgagcttgaatgttggtatatagaaatgcaactgatttgtgcattaattttatatcctgaaactttactaaaattgtttattgggtctaggaatcatttggagtaatgtttagggttttctaggtataggattatgttgttagtgaactgatataatttgactaactctgttcctatttggatgctttttatttttttctcttgcctaattgctctggctaccacttccagtactatgtggaataggagtagtgggagtggacatcctcgtgttgttccatttcttagagggaatgttttcagttttygcccattcagtatgaygctattggctgtgagtttatcatatatggttgttactattttgaggtgtcttccttcaatgcctaattcgttgaaggtttttaatcatgaagtgatgttggattttatcagatgctttttctgtgtctgttgacatgatcatatggtttttgttttttattctgtttatgtggtgaatcacatttattgatttgtgtacgctgaaccatccttgtgtcccaggcataaaaccatttgatcatgatccagttatcatcttgatgtgctgctggattcagtttactagtattttgttgaggatttttacattcatgttcatcagggatattggcctgtagtttttttgttgtgtccttctcagattttggtatcaggatgatactgatttagtagaacgagctagggaagaatccctcatactcaatttttttttttaatagtttcagtaagaggtacagttcttctttgtacatctggtagaacttggctgtgaatccttctggtcctgggcttttttttttggttcgtagatttttaaattactgattcagttttatagctcattattggtctgttcaggatttccatttcttcctggttcattcttaagagtttgtgtgttttgaggaatttattcatgtcttctaggtttctctggtttatgctcatagagatgttatagtagtctctgaggagcttttgtgtttctgtgatatcagttgtaatgccacttttgtcatttctgattgtgcttatttaaatcttctcttttcttggttaatctacctagcagtttaacagttttgtttatcctttgaaataacccactttttgttttgttgctcctttatgtcatatttttggtctcaatatcatttagttctgccctgatctttatttcttttcttcagctagatttgggtttggcttgtttttgcttttctagtttctttagctatgatgttaggttgttaattgagatctttctttttgatgttragcatttagcactataaatttttgtcttttttttttttttttttttttttggagacagagtctcactctgtcgcccaggctggatgcagtggcgtgatctcggcttactgcaacctctgcctcccaggctcaagcaattcttctgcctcagcctcttgagtagctgggattacagacacttaccaccatgcctggctaatttttgtatttttagtagagacagggtttcaccatgttgcccaggctggtctcaaactcctgagctcaggcaatcctcccgccttggcctcccaaagtgctgggattacaggcatgagccactgtgcctggcctaaacttaacttagcagtctaaacactgcttttgttgtattctagaggttttggtatgttgtgtctctattttcatttatttcaaaacattttttgatttctgccttaatctcattgtttactgtaaagtcattcgggagcaaattgtttagtttccatgtacttgtgtggttttgagagttcctcttgatgttgatttctaattttattccatgaggtctgagaagatggttgatatgatttttatttttgaaaaatttattgagactagctttatgaccgaacatgtggtcaattttagagaatgttctgtgtgcacatgagaatgagtttagaagtggattcttcctgaatcgggtctccatatgaaaacatagcccaggtgacaccttgcttgcagctttaagagaccctaagcaaggacccagctaagctgtgcttgaattcctgaatcagaaactgtgagatagtaaatgtgtattgttttaggtggctaagtttttgctaatttgttatgcaatagaaaactaatacatcatgaaagtccacttttcctatgttcttgcttgcttatttgcttatttatttgtttagacacagggtctcagttggctaagctggaatgcagtagcagtatcatagctcattgcaatcttaaactcctggtctcaagtgatcctcccacctcagcctccctagtagctgggactataggtgtgtgccactgcacccagctaatttttaatttttttttttttttgagacgaaggcttactcttgtcccccaggctggagtgtgatggcgtgatctcakctcactgccaacctctgcctcccagattcaagcgattctcctgcctcagccccctgagtagctgggattacaggcgcctgccaccatgcccggttaatttttatatttttagtagaggtgtggttttaccatgttggccaggctgatctagaactcctgacttcaggcgatccacctgccttggcctcccaatgtgctgagattacaggcatgagccaccgtgtccggccttaaattttttttaggcagggtctggctatgttgcctaggctggggtgcattcgcgcaatcacagctcactgcagccttgaactgggctcaagcagtactcctaccttagcccccccragtagctgggactatagacacatgccaccatacccagctaatttttgtattttttgtaaagatgggattttgccatattgcccaagctggtctcaaactcctgagttcaagtgatccaccctgcttggcctcccagagtgctaggattacaggcacgagccaccgcacccaacccagactgtcattttcttgcttttagtttttgtgtattttattgcaatgccactttttttgagagagaggccttgctctgttgcccaggctggagtgtagtggtgtgatcatggctcactgcaacctcagcctcccgggttcaagtgagtcccccacctcagactctcaagtagctgggaccacagggacatgccatcatgcctggctaattttttttaactttattataaataggtgatctccctatgttgctcatcttggtctcatactcctgagctcaagtgatcctcctgccttggcctcccaaagttctgggattgtaggcatgagccagcgcacctggtcacaaagttacttttgttgtagtatctggtacatgaaaacccttttgactaaaatatgtttaatcttttttttttttttttttttgaggcagagtcttgctgtgtcactcaggctggaatgcagtggcaccatctcagctcactgcaacctccacctcccaggttcaagtgttcaagtgattcctctgcctcagtatcccaagtagctgggagtacaggcatgcgccaccgcatctggctaatttttttgtatttttagtagagactggatttcaccatgtttgtcaggctggtctcgaactcctgacttcaagtgatctgccygtcttggcctcccaaagtgctgggattataggcatgtttaatcttttaaaaaatgaaagagccggctgtgcgcggtggctcacgcctataatctcagcacttttggaggccaaggcgcggatcacgagctcaggagtttgagaccatcctggctaacacagtgaaaccccgtctctactaaaaacacaaaaaattagctgggcatggtggcgggcacctgcagtcccagctacttgggaggctgaggcaggagaatggcgtgaacccaggaggcggagcttgcagtgagctgagatcgcgccactgcactgcagcctgggagacagagcaagactctgtctcaaaaaaaaaaaaatgccaaacttagatttaggatactayccctaacccccatcaaatggtaactggtaagtgtatgtttaagtttctaaaaaattgccacataattttccaaaatgtttatactgttgtactttcctactagggatgtcgagggttccagttggcccacgtccacatcaaaacttgttatgatcagatttgagccattttattgagtgtatactggtatatcattgtggttttgacttacatttcccagatgaataatgatggtgaatatgtttttcctgtccttatttgccatttgtgaatcttttgtgaaatgtgttcagatattttgcttattttgaaaaaaagaataaaaaattactgagttgtacaagttatttatatatttcagatgcagatattttgtcagatatatatagtcatgcaataccatgcaatgttttggtcaacaacagactgcatagacactggtgatcccataagattataaaggagctgaaagtgacatcttgatgatcctgaccctgtgtacacttaggctaaagtgtatgtttgtgtcttcatttttggcaaaaacatttaaaaagaaataataaatttaaaatttaaaaataaaaaacagcctatagcctgcagatgtagagaacaaaaatatttttgtggagcagtacaatatgtgttttaagggtaaagttaaaacttaaagaatttaaggtgaaaatgttacagtaagctaagattaatttattgttaaaaaaataatgtagcctaagtgtacaatgtttatatgttattattatataatgttgtatatattattgttattatataattatattatatgttattttatatgatacaattatataatatataattatataagtttgtaacatataataattatattatatgtttatataatgttattatgcaatattaaatagtgtagcccaagcatacaatgtttctataaagtctacagtagtagacagtaatgtgctagatctttacatttactcaccactcactcagtcacccagagcaagttctagtcatgcaaaccccactcatggtaagtgccctatacaagtgtaccatttctatcttttacatgtatttttactgtaccttttttatgtttaaatgcacaaatacttaccattgtgttacagttgcttacagtattcaatgcagtaacatgctatacaggtttgcggcctggaagcagyctataggctatacaataccatatagcctatgtgtgtggtaggctataccatctaggtttatgcaggtatactccatgatgttcacataatgatgaaatcgcctaacaatgcatttctcagaaggtatctctgttgttaagtgatgcatcactatatatattgtgacttatttttctccagcttgtcttttcctttttggaaggatgtctttcagagagcagaaggtcttaattttgatgttctttgtgagtttttatagttagtactcactcattctgtccaagaaatctgtgcccatcccaagatcatgaagattttctccaatgttttcttctagaagtttgtaattttagcttttatgtttgaatcttaactccttttgaattaatttctttaaagtcttaaaaattatggcaaggtatatataacaaaatttgccattttaactttttttttttttttttttgagagagtctcgctcttatcacccaggctgtgcagtggcgtgatctcagctcactgcagcctctgcctcccaaattcaagcaattcttgtgcctcaacttctggcattttaaccatttttaagtatacaatgtaatgacattaactatattcacaatgtcatgcaactgttgtcaccatctatttctaaaacttttccatggtcccaggtagaaactctgtgcccattaagcagtaacacccttcttcccttaccccaggccttggcagtctctgttctactttctttttctatgcatttgcctcttctaaatacttcatatcagtggaatcatatagtattgttcatttgtgtctggcttatgtcacttagcataatgcacatctatattaaagtcagttttggtaagttattttttgaactttttgtctattttaaataagttatagaatgtattggcataaattgttcctgctattctcttattattcttttgctgtctttagatttgttgtgataactcatcttttatttctgatattgatgatttatgttttctctccttttcttcttgatgtctattactgtggttttattaattttattaatattgtcaaagaaccaatttttggttttgttaatttttttattttctgttcctaatttctgctttcttttctttattatattttgaatttaatttacttttaagtttttttaaattgttttttattatactttaagttctgggatacatgtgcagaacgtacaggtttgttacataggtatacacatgccatggtggtttgctgcacccatcaacccataatctacattaggtatttctcccaatgctatccctccctggactttttaaagtttttaatgcagaggtatggattagtgatttcaggtcttccttttttgatataagcatttaaagctatatatgtgcctctaagcactcctttaactgtattccataatttggtgtgtgtgtctttattrtagtgtaattcaaaatattttctaattttctttgtcatttcatctttgaccaatagattatttagaaatatgtggtttcgtttccaaatattggaagattttatattttattgtagttgatttctaatttaattctgttgtggttagacagcataatttatggaatttcaatattttgaaatttcttgagactttttttatggcctagcatgtggtctttcttggtgaacatgcaatgtctgcttgattagcttacctgaactctagcccatgcctcctcagcttagtggaactactgtgctctgcttgaactctagctgtctgcccttgtaagaaaattgctcccaggcagctgaggagggagcagcctgacttttgagtttcccttctttctgggttttctttcttgcattacatgtgtcccagtgcctgaaaactattacattgtatattttgtctattcttatggtaatttgtagtagaatggctagttctctttcggtaatgtcatagttacaggtggaagtttgccaatctttaggtccctgcctaaaatcgaaactttttttctttagttctcactgaagacaaagcgtgtactttttacatcaaatgtaaagctataaaattctcatttatttctactttcttgttttcttctttaggtaactcgacagtatgtaaagtttgttgtttaacatgacttttgtccctgttataatctatagaactgaataatatttacttaaaaaagttaggtatctttttctcactttattatcagttaaataaataatttcatttaaggctttatcataggcagtgactgttttatcattttaaaaatcattcttatatgtgcagccattttaacgttacttttcaatatcatttacgttaaacctataaattttccattgttttctgtgactatttttaaaccatcggaggagaggggaatctggctaaatattgtatatataatattatgcttttaagaacaatcacaccatcattctatatcgtctttttttttttttccttctttttggagacagagtctggctctgtcgccaggctggagtgcagtggtatggtcaattcactgcaacctccccctcctgggttcaagtgattcttctacctcagcctgccaagtggctaggactacaggcatgcgcccccacgcccagctaatttttgtatttttagtagagacgggggttcaccatgttgaccaggatggtcttgatctcttgacctcgtgatccacccacttttgcctcccaaagtgctgggattacaggcgtgagccaccccacctggccctttcttttcttttttgaagacagtctcgctctgtcgaccaggctggagtgcagtggtgccgtctcggctccctgcaacctccgcctcccgggttcaagtgattctcctgcctcagccaggctggtctcgagttcctgggctcaagagatctgcctgcctcggcctcccaaagtgctgggattacaggcatgagccactgtgcccagctacttgtcttttttgaatactctggtttattttctgtgtttccaatcttcagtgatagtaattgtgtaagtactttttgtgtgcagttgttttttttttttttycccaaatttaagcagactagcttatttgtagattttctctttttcctcttctaagctccactgtcttatttttctgtctatgttgggatcacaacgtactcattttcagtgatctgtaggatttaaaaataagacgtagttatatccacagagtacaaagtttgaatatattctcatcaaaaatataaagcgtaaaaaatggaagttttttattcttttaaaagttatttttcttttaaatattcaaaattaatttaaataagctgaattaaaaatttttgtaagtacatatttttataaaaataaattgtaattctagcattaactgttcaaccatttatcagtgtaataaattggttccttgccttacatgtgccatttctagacctgcatataaatacatttactagtaatgtgaattccttaattctgcaaaatgttcctcaattgctgtgtgctactgttaggaatagtgagctaaattatgagtaccttcagaactgtgaattggaacaggaagaaatcaaataaatggatgtttgactctgttaggagacaatactttcttaggaaaggtatctatgatattgatgttatttgacaggaaggatataacagttaatttgtcttgtcttttattctgacaccctgtgctcctcaaatatttcataatctcaggcagagttctctgaagtttgcagtttcacagcccataaatggcgttctgatatagttgcctctcttttaaaggacatgggaagaaatatgtggacaaaggttttcctgtggtctgaactgtacaatttgcaagaatggatttttagggttctgctttgccagtgcagaatcttgtgacagaggaaaccccatttctttaattaatttgttttttgtgtgtgtgttattttgcaggatctctaaagtgagaagcccatagcagaggcctttcttctggctctacagtcaataaataaatgtgtgaatgaataagagaaggcaggtgtttctttcaccatactgcaaattattgagccctgtcaccagtcccagggaaatgttaggccttcctagtcctggcaaagtcacaggaatattggcacaaatggattctaatgccactaaagaaagtactctgtgtggggatgtgttacctggaggtaaaagtaatatcttctttggtcagataaaggatgtaaaatatggctttcattctctaaaaatcaaacaaatattttctcactttggcattatttaaggagctccgtgttctctctcctccacccaaggagtactgctctgcaatagtactgctcttcaatatatgcagagcaggctagaaagaatccatttgctgctgttgtcagaaatttctactgaaaggtaaagcgcagtgatttatagcattggaaacttgagttagactgctccagtttaccaacttggctgaagacacttctggctagtataattcatatataggtaaccaggtgccaacatattgaggaaatgctacttttctacttaccattggcatgatcttaacttctctgtgtctttaaaaaataataataattttaaaaataataataatggaataatagtacatatatcatatggctatgatgagtactacatgaatattaatgtgtaaaatgcttagaatagaacctaatagttaagcacttaataaatgttggttgctgttatgtcattattattattgttatattattattattattattattattattattattattattattatgtagcctggtctcgggtattagagaattggagaatattgagtagaaacttaggattcagccataactgcaagccttagctggggatgggaggatagacccaaggttggggcttttggcaactgaccctgatatcatcacaaggctttccaaagtaggagccagtacttgttgagaactgttagatttctaaggtgttctagttatctttaggacctgctactgaactggggattctgaaaaaaagagggtgctgagagggctgaataattggactaatacatggagaggaaaagtgagggcttgtggctactaggtgggtgagtttgcttgggtaattagaacagtggctttcaaactttttagactttgacttcaataacaaataaagtttacattatgacccatcacacacgttcgcatttgtatatttgtatgtatttcagtaatggatgtcataaacacacatttcacaaaacagtgcttacccttgctgtgtgcgaaggactaatattttcttttctattctatttcatttgtatatgtactttttgtgtgcaggtagtttccctttttagaaaatgttgatcctgacttcctaaattgatataatgtcttactaaagaggtgtgacccacatttgaaaaagcactggtttgcctatgagttagtcctttgaacattaccctagaaaaarcagtttgatacgctttgtcatctaggtgaatgagagaagcccctcagagttggcagagccgctgaagcaggggacaagacttgcttctctttggctctcttagctgccagggtttagctccacagtttacttgatcacttggttttcttgagtctaggttctttttctcagatgtcttcctatttgttgggactaatctcttcctttagactgggagattgctccaagagggcaagacttacagtaatagctaacacttttatagtgctttctctgtgctaggcactttgctgtttacatgtattagtcctcaccacaacctatatattaggtaccttaatgatcttcattttacaggtggggaaaccaaagcatacagaagtatgcttagcttacccttcaatagaggtcttctgcaacttaccttaaacattaatggatgaaattaagctagtttctgggcttattttcttaactttccttatggcttttcttaccacaagaatgattagagagtaatagaaattgaacaaaaaatggcactgaactttgtctgaaggagtacagtttagttaagttggtcagattcggcatttgaataatgactgtgctttgagccctaacattaaagccctgtagtcttccttcaggcttgggtttgagaatgaataatgctgcagaaacgcccacatagtcttcgctcattattttaccagtttcttccagtcccttgcccactgcaacagctgtttagcctggcccatgccttctgggttaatagtatttctgacacagtgtgagttttcaagttgctatgtataatttctgccagagtttttactgccgccaggcctcagggttggaggttgcaactgatttgtgggggagggagtttggtgcttgtcactgacgcaggaacaaggtgctttctgtagctctgatttgttgctggctgagtgtgaatgatgtcaggcagatcagaggacagctgattcatttgggatctggaacttgtcactgtcccactgctgcctcgtgggctcttaggtcttttgtggggggatgggaggggtgttctgaagatcatgtttttgaagaaaagtactttaatttttgccgtaagtttgggaagcttttataatttcctttggctgacagaactgcataccccttgtgtgagagaacttcctaccaagactccagtgtgagggcaaaacttgagtagccaggagaatgatgaaacggaggcragagagactgggagcaccatgtctgcggattcagtaaggaggttggggtctctatggaaactggcagatgtcaggaaaaaaaactaatgccaactaacacagcttcgttcatttggatgaagactgttttggagatgcctgtcaggaagagggctgagctggcttgattaattcaaggtcaaaacagtggtccttggcaggggcatatgaggtttccaattccagaaactgaattagatgtcattttaggggttcctgaatacttggagaactgggtaaaaaaatgaagacaattattttcttcccttgaaagcaaatgtttatttaaagttagtgtcaaggctgcaaatacaaaccccgtgaatgtgagaaaccaatggaaacaaaaagtacctcctcctttgactagagagggtattgtatttctgcccatggcctgtcagctcaggacctcagatctgcccttgcagattcaagcatgggtcctttagggtgtgacctctattttatttctatattggccaatatagaaataaactttattaggtgagaatatcaaagctgggagtggaagaaggcttcctcttcagggtgacttttccaagagcagctcaggcttatttaatgaagaagtgccaagtgaattcatcagtaaattagagaaccagtgaaagaagagacctagaattcatttcacctcaattatctgtcttgaactacctttgtttaacccacagggctaagggagtgtacttcagattttcttcytgagtcaaactgcttgccctgagacagacaggcttcttcagtgggcttcctttgtgatgttgcccttcagtgtctgtggatgcttattgattgaattaatgattctattagaccttaagaaacaggatttgtttgaagtatatagttgtagtattgacacactttaaaaaaaaccttttattaccatactgacacagaagtaaaagaccatttaaaaacagacttcatcaactaatgtgttatttaaagtaaaggtcacttgttaacaaaattaaaaatttttaaatggagtttgtagcttaagaaaacttaaatggtyaaaaatcatggttctgtttttgtttttgagagtgtcttactttatggcccaggcgggagggcagtggtgctatcacagctcactaaaccttgacctcctgggcccaagggatccttccacctcagcagctgggaccacaggcatgcaccaccaagcctggctaattttttaatttttttgtagaaataaggtctctctatgttgctcaggctggtctggaactcctgagctcaagtgatcctctwgcctcagcctcttagagtgctgagattaccatacctggcaaatcatgctcttcaaatgtgggtacactgctgttggtaatcattttctctgttttactgactttgagttagaaaaataccccctgaggagctaataagtagtttgtatatcaccttttcctgtttcaaacaatcctttttagactctagacccattgtataaccagtttgcagagtagtaattaggggcaaaaagaaaatgaaatttgccggccaggcgcggtggcttacgccagtaatyccagcactttgggaggccgaggcgggcggatcacgaggtcaggagatcgagaccatcctggctaacacggtgaaactctgtctctactgaaaatacaaaaarttagccggacgtggtggcgggcgcctgtaatcccagctactcgggaggctgaggcaggagaatggcgtgaacctgggaggcggaacttgyagtgagccgagatggcgccactgtactccagcctgggtgacagagtgagactctgtctcaaaaaaaaaaaaaaaggaaagaaaatgaagtttggctttcatagatttttataatttcaattatatattgaacaaaatgtctaaacctcattttatgtgataagacttaaggcttcaaaattttgtacaagcatattattcaggttaacaagtaagtgctgtctaatgttctaattagttctaacatatatatgaaggagcttaactttgaaatagttctttggaagagtgaaaattctttttgaaaatgagaaattaacttaaaattaacatttttacttcttttaactttaaaaaaatgttgagtttgtggaaatgtgggcataactgtaattttaaatagttgtgtgccctcctattttctatcctgttactaccccatattgtgtacccacctgagaagtaaactgaagaccactagagtgataatgactaggaaagtgaagatttcctttgaatatatgtaagcaagcacaagtagaatgtcactgtatccatattataaacagtcagaaataacaatacgagaaactaacaatgttatcattttgaattagatcaggtacttatgtgatacttaagtaatttttttaccttggaaattaaataatggtgtgtgtatagaaagccatgccaataaggtagcaaattaaatattatgaatattatttttatcatgtgtcgtttctactaatggtagcaaattagaaatctatttattacctgttttcaatctaatgatcttatttatttaataatcttcgataggacttaacatatcaaaatggctagattgtttttatgggaaaaaataacctgggaatctaaaatttaagtagaagcaaaatacatagttaactgacattatatgatacattcattagagaaatgttagctaaacaaattggtattattgttgatataatcaataatttataaactattcagaatgttttactcttagggacatatacatttctttaggaagttttagtcattgaatattaaatattaactgttgcctgctaattgatgtagtaaatttgcagtgtttggtttgcccagaaaccaattctaaatacttcaggctgggcacggtggcttacatctgtaatcccagcacttttaggaggccgaggcgggtggatcactcgaggtcaggagttcgagaccagactgaccaacatgatgaaaccctgtttgtactaaaaatacaaaattagctgggtgtggtggtgcatgcctgtaatcccagctacttgggaggctgaggcaggagaatcgcttgaacccaggaggcagaggttgcagtgagccaagatcgtgccattgcactctagcctgggcaacaagagcaaaactctgtctcaaaaaataaaaataaaaataaataacaaatatgttgaatagccaaatcttaaatgttgtattttaattttatggattaagtttttgtctctgttgtcatccygtaccaacattggtactgaagtatgatattggagaatgatttttgaccacttacttttcttgagctttttgcctaaaccaagccactttgaatatgtttctttttggttgaaaagttatcactgaccttgtttttttcctattgtggtaccttgtcagaatctctaccctttgccgaggagctgaagtaaaccagcacatgttttcacccacatctgctccagccctcttcctcactaaagtcccatttagtgctgattgtgctttggctacttctcctcttgccattttcctgaacccacgagcccacagcagtcctggcactccttgttccagccgcccactgccgtggaggtaaggaaacttgctgtgaatctgggccttgacaattgcttctggccaaatggtaaaacgcataccttactccttaataatggggagaaatggagtaagagtcttggttctgtcacagagaagagtaaaataaatatcacagatttctgttgtattcaaaatgtcaggagaaaggagggtaggttatcagtacttggatttttgaggctattataagttgtgtgcccatcctgaccattggacagccttgtgaactatgacctgtgaccaccccatagcatggcagagtgctagaactcttaggaggtaaaaaagttcaaacctcacattttacacgatgggaaaatttgagtccaaaacaagttaaatggtttgttsaggttgaggaaaatagcccttctcccatttctttctgtcttccttttcttatattcaacattatttgattacgtactatctgctaggacactgttttgggcatgggaaacaaagcagtgaacataaagcaataaaatccctgtcctcagggagcttagattctagtggagaaagagagacaagttaatgagtaaatatgtaacataacggatagacagtgcttctgagaaaaataaagtaggataagagaatgtagaggccagggcttgacattttatataaggtggtcaggtaggtcctcagtggtaagttgacataaaagacctgaaggaagtcatagagcctgaatggagatatctggaagaagagtgttccaggtggaggcaacatgaagtgccaggggcctgatctaggagcttgctccatgtattctttgtgcaacagagtccagtgatactggtacagaataagttaggtggtgagtattgggaaatgaggcctgaagtgtagtgggcagccagattaaacaattttgaggctttttgagatagagtttcgctcttgtcacccaggctggagtgcaatggcacaatctctcctcactgcaactctgcctcccaggtttaagtgattcttctgcctcagcctcccgagtagctgggattacaggcggctgcccccacacccagctaatgtttgtatttttggtagagacagggtttcaccatattgaccaggctgatctcagactcctgacctcaggttatccacccgcctcggcctcccaaagcactgggattacagrcatgagccaccactactggccaggacttttgtttttatgctgggtgagataagtagccactggaaggtttaaataagaatgtcatgatctgacgtagatcaaaagatcacgctgggctgggcgcagtggcttacacctgtaatcccagcagtttgggaggccgaggtgagcggattgcttgagttcaagaccactcacaagttcgagaccagcctgggcaacatggtgaaaccccatctctacaaaaaatacaaaaattagctgggcatggtggcgcgtacctgtaatccctgctactctggcggctgaggtgggaggatggcttgagcctgggaggtggaggttgcagtgagctgagatcataccactgcactccagccttggagccagaccttgtcaaaaaaacaaaaactaacaaaaaaacacactctggttatagttagaaggccactaggtaagagacaatggttatttgaacccatgatgattcagataagaagtggtcagatttggggattattttaaaggtagaattgatagaggaggaagagatatccaaggattgagctctggggcaagttttagaggttggggcgatagtgaggaattagactaaaatgaattagctattcattcaggaacaaggactaggagaagtatcttagaagccagttgaaaaaaaaatgttaaaaaaggaaagcgtgattgatcagtaggtatttgttaagctttttgttagagaatagtaacctgaaaaactaaaagtttaagtgaaacacaatgtatcacacagatttaagtgacattatttgatacaggagcttaaattccacagacagtttgggacagtgatagactgacataggacaatgttagaggctaacttctctctgaaggcacctcttctagacgtactagcgcttggcgtatgaggctgagaaagattgtaagttgggtagcccccaagatgtacccagtcctggcacatggttttgagtatctcttgatgactatggtctcagaacacacaacctggagcaacatcttacagctttggagcttgttaaatttcatgktttkttttttttttttcatagacttactaacatgtgtggtcactgtattagtgcttcattccattcttcttttgtatccatgccatgcaaagtgccagttcattgatatgacaagattattttagcttgttgtttgctagatatttttatattcctttaaacattcttgagaatctgggatgcagttatttagaaattgtttgatcctttgaaggaatactttcaggctttgtttggtgagaccagggcagcacttgaggctaattttttcttactactgaggcaatactttgagtactctatttgatgcccatgtattgtgagttttttccactcaggctgatgggagcatgaacgattctgggtccttagtgagccctgaagagggtacctgctcatgttcttggatagtttccttatccacatatgctgatagatattcagctaaaaactcagaggaagcccctgcagatctccagagttcccctctgtatatctgtcttctctggtaccctgctttgaaaattctagccaccttagcctccccaagttctcaactctgtcttctcaactcagggagactgctggactctgtttgagtacccccttttgctgcttcctaggcatgcagtcttagggcttattttgcatgtttcccatcggtccagtgtctgcaaactattgtttcatatatttcatctaatttttttgtttttaaggtgcaagggtaaatctgatctctgattccccataatgatgagaagcagaagtctagtcttgctaatattttgagctcatgcttctrtcattagttgttcttattgctttatgagattattggttgactgattcacgttgcataagcccaatagaagcagattattttaaaattattttatcttccttagtcaagaaaagttggaaaatgtaatgtcaaaagaataagaataggtaacatttgctgagcatttactatgtcttaacatttttaaaatgacttacatttgttaaatttaattctcaaaatactctgatgaggtgggtgacacatgttcatttttttttcgatgaggtggataatctgagtaaatctgttttatagatgaagacactgtagtacagagaagttaaggaagttattaataagtagtagaaactaccattcaaccccacagtatcttactccaatgtctgtggtgttttttgtttgtttgtttgtttgagacggagtctcactctgtcacccaggctggagtgcagtggcgcaatctcggctcactgcaagctccatctcccgggttcaagcagttctcctgcctcagcctcctgagtagctaggattacaggcgaccgccaccacgcccagctaatttttgtatttttagtagagacggggtttcaccacrttggtcaggctggtctcaaacccctgacctcgtgattcacccacctcggactcccaaagtgctgggattacaggtgtgagccaccgtgcccagcctatgtctgtggtcttaacccctcagctgttgttacgggatcctgggaggtgttgcttttctagctagaaacctctgtggctggtgacgcttttgcctgagctttgtttgctcaggcctgctgggcccagttggcccagcaggctgcacttgcctcaagctaccagcctggatcccatgcctccaaagagactggagcggaatagtgaagggtgtgtggcaagtgagcatagggtccggccactgcacgcagtcaggcatgccaactgctgcagcagggcagctagctccaagggctggcatgggtgctagctcactgtgaggctgcatcgggaccaggcgccacgcaagcaacttccacagctggcacaagggaacgcggtggtgcccagaaacttggagactttaggagccaccaggccccaaagcaggagtcacagctcaggctcggggagctctcaggtctggtctctccaaagggctgcagctcttctctccttctctcttctctccttcttgtcgcccacaatgtgttgagcaaggggcatgtttcagctctgtttgtattacagctcttttggccctgccattcggtgggtcccgagttcttgtcctgcatccaaaaggaatgaggtacacagacaaatatagggtgagcaagacaaaggggaactttattgagtgatataatagcttagaggggacccgcagtgggtagctcctatctgtaggcaggtcctcccgttgagtgttcagctctcagcagagaggaggtcctggagtgggtggctcctttctgcaggcaggtggtcccattatctccctatggtccctccctcctctccccaagcctggctgagtccagsggcttttatgggcctcagaggggaggaagtgcatgctggttggtccatgggcggccatgggtgggcccagggaaaagcaccacaagttgcccttgcggtttctgggactggcgacccatcccccaggcttcaggctttccctggcttggaggtgggtcttcactgtggaccagcttctytccacccaggagcctgtctgcctcctgctgctgttcatggtgaccaggctgttcatgctaaggggtgcctgcaggccagcactgggctgtcctcagtgcacccctcagcctccttcccatgcttgtcagtgcccaaagcctggagggggccaaagtggcaagggggttggcatgtcagcactaccccgagcatgtgcacactcagctgggctgtgacagctcccgggctgggtcccaactttgctccgaggttggagtaggcactgacagaggggagaagccaggtagcgggagcggacgattctgagcctgcgaggggcaggggccttcctaggcccgagagttcagagatgcctgggtctgaagctgcagcagggcggtggtggctgcacctggggggctcccaccccaccaactcggaaggggtggggctcccacttttccctggctcccaccgactctgtagagcatgcagccccagctccatctcctagcagtcttgggcaagggctccaggtctgatgcattgtcctgggccaggtgctgggctgctccaacgcatcgagtctggtgctcctggtggtgaccgtgccagttgtttacatggtgatctgctccatggggctggtgaacaatgtgggcatgctgtacttgctgctgtggggtgccgctttcacttcctaccctgggcccctgaagcatggccccagctctgtgtctcgggccagacctctgtgccccatgtgcaagcacgggaccaccctgggcccagctctgccctagtgcccctctctgcctgttcctctgtgcacttctctcccactggcggacggctcagctcagcctggcccaattgtggcagttcccaggggtgggttcccagggcagtgggcctgtaggggggcttrcaaaggagggttccagggactgtccaccttggcgtctgcaccggaagacccgtgtcctgcatctgtaccccactgcagccggcgtcatggcagtgactgcttcatggcagtgacgggctgccactgccatcactgtaatgtttctgatgaaccatatgcaatcgagaatttatttaataaatttacaaactctgagcacttactagctcccaggcactgttcttagcactttaaaatgtaaaggtcatttgcttctcacaccagttctgtgagagagattatcattgtacttatttcacacaggaagcgagggtgcagagagattaaataaattgctcaggataacacagctgtataagtggcagaactgggatagaaacctgggtagtctggcttcagagatcacattcttaacaaccacactgttccatgtctccatctgagatattttcattatgtaatatcatacgttctgaaccaaagtagtttttgcagccttgggtcttttcccaaggtgatgtattaataacattgtttaataaatcctccaatcctgggggtgggaattggtattcccacagtctgttgtcacttctaggtcattacctttattaccttcttgtaaaaacctctgttcttttttttgagacaagttctcactctgtcacctaggctggagtgcagtagcatgatctcggcttactgcaacctctgcttcccagtttcaagcaattctcctgcctcagcctccccagtagctgggattacagacacccgccaccacacctggctaatttttgtatttttagtagagactgggtttcatcatgttggcaaggctggtctcaaactcctgacaagtgacctgcccacttcagcctcccaaagtgctgggattacaggcatgagccaccacactcggcaaaaaaatccctctgtttttttaggcctgtatcattccattttacccctgctcattactgtcatctattaatttagttttgttctctgtactcaaattcacagtccagaacagaatctgtgcttagtgaaaacggtgatgaacctccattctgcaacatctttatgatgaacctctcttactcaatttattaagcaaattagcaagtaaagtagaaagatgagaaaaatggttccagtaaacaatgtgcataagtgaagaactgaaaattgagtgctactggcagtgaatttgactctgagttccagaagagagggaactaggaggggggacttccaggggcgggttccagggactgcccacctyggcatctgcacctgaggacccgtagcctgctcctgtaccccactgcagccagagtcatgtcagtggccatattaggatgtcttttttatctctctttttttaatttgatgagtataactattataggctgaattatgttctactaaaatttgtataggttgaagtcctaacccctagtaactcagaacgtcactgtatttggagacaggatctttaaaggggcaattaaggttaaatgaagtctttgagatagatcctaatccagtatgacttgtgtccttacgagaagaggggattaggacacagacaagcacagagggaaggccatgcaaagacaaagggaggtagccatttasaatccaaggaatgaggtcatagaagaaaccaaccctgctaatgcccttatcttggacttctagcctgaactatgaggaaataaatttctgttggttaagtcacccagtttgtgatacttggttatgtatggcaaccctagtaaaccaacacagctattgaggcatttggctgcattgccccagagttggaaaacagtgtccccttgcatcatagtgtagtgaggactagccctgcttaaggtcttaagcctctttattgactgtatcttagggatggtcttaggaccttacaaattgttgcccgtaataatttgaaggacaatgaagatacagtctkgaaatgatacccactctagctctgtaatacattgcgttttatgccttgattggaaggaatgagtctgttataaacaaacgttgatgctagctcttaagtgtctcagatgggtatgatgaaccktaagaggcataataaatttcattgtgatttgggttaaattaaataaccactaacctttactccatttgcatgtcttctaagaaaatgattccagagtattgattggcactcagatgggggtgttgcatttttagagtaagagtgctagattgactttgtgttgtaagtggtgtccttgaagagaggaggcagttgtgtctctggctattcactggcccagctgtaggcctgctggagagagaagtttgatgttaacagcttaatggaacacagaatgacttaggttttgaatcagttttgaattgccatagactttgtcagccctgaagtaggagggcttgcagcaggaaatccttactagagtgatttttatattggaagcattctagctttatcttgcttcctactgcataggaatttcttccatacaatgtctagcaaaaagctattcagcctttgcttgaacatcttcagcaacaagcagttcactctcaaagctttcatccagtggtaccaatttagttctctggcacctcctatgtcacacgtatgagagacttttggtagacttgcgtggcaaatggacaggtgttcctttgggcctcctccagaactaggcaacctttgaaacccctttttggtagtgtcaaaattatttcctgccaaagagaaagcactattttcattttaccaacacctgcttttcttgtcttgtctttttttaaacaactgcttttcagagtaatttcaaaagaggaacatctcccagaacttgttcttatcctggccctgctgcatagtggtggtaggcagattacttcacttctttctacctcagttctcttcattattaaaatgggactcacaatagtatttcaaggattatagtaagaattaagtgagtcagtacatctacaattgtttagatattacctgggctgctagactggttattttgctgcttccattgttgggagactcagatgttgctaattcttagcacttcattttgcttccattacttttttctttgcttctattacttttctcatattcttattttcccttggatatattgcctaccatatgtccatactgcagaagctccattactggcttaggtgaggcagtggcagctgggtgccctcctgccctctcatgcattctcactaattgtttctgctgaaaactggcctgttggggctcagcaggacatggactgaaatgaaaaacactttgaattacattctttctaaaagaccattttttggcaatgaggaaagtccatcaaaacggtttcaaggtatttcatttctcctcttacagcagggaaagcgcatcttsagagtatcttcagaagaagtgattctcttgttagagtagggaaggttttttgattttttttttttgttttttcattgaaaaggtaaaataatgaagactagtgctgtgctttaacttcaggaacccttatatgcgacagatagtttttcatagaccctggctccaggtgaccctgaatgaagatataatcctgtatggctagatgccaaatggttgctcttgcctatcaggggacctgtcccgataatcatgtaggttcttttatatttttcctaagcgtcggctggcttgagaaataaagggacagagtacaaaagagagaaattttaaagctgggtgtccgggggagacatcacacgttggtaggatccgtgatgccccacaagccacaaaaaccagcaagtttttattagggattttcaaaaggggagggagtgtgcgaataggtgtgggtgacagacatcaagtacttaacagggtaatagaatatcacaaggcaagtggaggcagggcgagatcacaggaccacaggaccgaggcgaaattaaaattgctaatgaaatttcgggcactattgtcattgataacatcttatcaggagatagagttttgagatcaaccggtctgaccacaatttattaggcgggaatttcctcttcctaataagcctgrgagcgctatgggagactggggtctatttcacccctgcagcctcaaccataagagacaggccacgcccaggggggctgtttataagccaatacctccaggcgcgtattctctttctcagggacgttccatgctgagaataagaattcagcgatatttctcccatttgcttttgaaagaagasaaatacggctctgttctgcctgrctcaccggcggtcagagtttaaggttctctctcttattccctgaacaattgctgttatcctgttcttttttcaaggtgctcagatttcatattgctcaaacacatgctgtataatttgtgcagttaacacagttatcacatggtcctgaagcgacatgcatccttttcagctgacaggattaagagattaaagtataaagacaggcataggaaagcacaggggtattgattggggaagtgataagtgtccatgaaatctttacaatttatgtttagagattgcagtaaagacaggcataagaaattacaaaagtattaatttggggaactaataaatgtccataaaatcttcacaatccatgttcttctgccatggcttcagccggtccctctgtttggggtccctgacttcctgcaatacttgcctaagagcaggaagctgaagctttctaggatacttctgtttctagaactaggaaaattttatttactaaattttacattgtgttatggamaaatctcaaaaatgttcaaaagtagaaagactcatactacatccccagtatcgtctacattgtcagctcatggtatactatctcatctacatccccacctattttctttctctgtctctcttgcttattttgaagcaaatctcaaattttatgtcatttcatctatacatatttgtatctctaaatgtaaggactcctgaaaaatgtaatcacagtattattaccacacctaaaacaatagtttatcaatgtaatcaaatatccagtttatgttcaaattttttttgcagttggttttttggaatcagtagccaaactatgtcagcacagtgtatttggttaatacatctcttaagtagggtggtgatacaatttagtgtctaaactaggaaattttatataatgaaagaggattgttaatattactgggacaacagacataaacctgttaaataaaataattgggatgtctgatcactctttctttttttttttttcttttctttttttccttttgagacagagtctctctctattgcccaggctggagtgcagtggcacaatcacagctcactgcaaccttgaactccaggctcaaacaatcctccaacctcagcctcccaagtagttgggactacagacatgcaccagaagcctggctaattttttctattttttgtagagatagggtcttgccgtgttgcccaggctgtactgcaaagtttattttaatctagggtgttctcacctttttttttttccttgcaatttatttgttgcagaaaccgagttgtttgttcttgtagactttcccacattctggattttgctgattgcatccttcagaggtttttttctgacatgttcttatgagctctgtatttcctataaactgggggcttgacctgattgtggtttggttgggttgagggggtgggaagaatacttaacagttggttcagtgtatatctgtcaggaggcgggtaatgtcaagtctctcccttgttttgttagtagtggccattgataattatcacctagattcattattttcttaggagtttgcaaaagatgattctccttccctttattaactacagtacttacacaaaagaattttctcctcattatctgtttttttttaccctgaagtacagataattacccttattcgcattgactcagcttagactctttcctgagtcttcagcctaaagcctgagtgtcctcagttccttggtcagtgtttcatacctgcttattactgcttcgttgtgaagattgtttgcccagagcagcagggggggagttgttggtggtgaagccccttggagtttgccatttacatagctaactgattgctcagctgaggaaaaccttggcttcctcttctggcccacgtwgaaagaggaattatctgtagtagtcatgcttgttatgtagactctgggactctgagaggtgagaatgcatctagaaggcagcagcttttctttcatgtccctagatgccacaagaggaggagccattgctgatcctgatggcctcattttggtagataggatgggcttagggctagagagtcctgctgttaagaaactagcatactggagtagtcagagaaacgattaatttacaataatagatccttgacacagaagaattaattttcatggctttgtttgttaatatatacatatgtgtgtgtaaatagatggatttttttttttggagggctatcttcaggataaattactagaactgggatagctgagtcaaaaattaaatgtatatgtagttttattagatattgtccagtttcccttcacagtctatggttatactattttacatttccatcagcagtttaagataatgtctatttgcacacagccttgccaacaatatgattgtcaagcttttgaatttttgctaatctgagagctaaaaaatggtatctcaatgtagccaagtaaaaagtcatattaaaatattcctaaaggatgaagtttgttttgaggggggatggaatttctctgtcgcccaggctggagtgcgcgatctcagctcactgcatcctccgcctccaggtttaagcaattctctgcctcagtctccccagtagctgagattacaggcacccaccaccacgcctggctaattttttttgtatttttagtagagacggggtttcaccatcttggccaggctgatcttgaactcctgacctcatgatctacccgccttggcctcccaaagtgctgggattacagatgtgagccaccgcgcctggcctgttttttgttttgttttgttttgttttgttttgttttgttttgttttgttkatcttatgtgaagggaatcagtttcctgtcctgggaaattgagatagatgcattcattcattcattcattcatacattcaactgcatactaggccctctgagcaggagaagatgcccacataggcaatagaacacttcgcagcacggggtagagtaaaagggatgctttttatttcataagctttcagccttattcacccctattcagtcattcccagaacttttcaagtgatttctctggatgttagcagaaatatttttttaatgtcaaaattccaagaatagttcaaagagcttttcaccccccaaaccaggggtcagcaaaataaaccccatgaaccaaatgtgacctgtgggctgtgtttatacaagccacaagctaataatgaagtttacattttttaagggatatttacaaaaaacaaggaatatgtgacagagaccacatgtgacctgcaaagcctaaaatacttattatctggcctttacagaaaaagtttgacagcccttgtcctaacccatactgaattagctcctgatatgttatctcatcagccctgaacactttagtgtatacttcctacagagacattttcataacaatacagccattaaaatcagaaaattaacattaataaatattaccatctaatctacaagtttaattcatatttyaccaaatgtcccagtaatatcctttgtaacagaaggctccgatccaggatcatgtgttagaattttactgttattcgtcttctatctcctttaatctgatgcagttttgtagttatttcctcaacttttataacctcaatacttttgaagattacagaccagtttatttgataggatgtcctttaatttgaatttgtctgttatttcctcaggattagaatcaggttatgaacctttggcagaaatatcacaaaaaggtggtattgtgttctgttttttttttttttttttttttgagatagagtcttgctctgttgcccaggctggaatgcagtggcacagtcactacctcctgggctcaagtgatcttcccaccccagcctcttttgttgtttttgtttttttgagagtgtctcgctctgtcacccaggctggagtgcagtggcatgatctgggctcactgcaacctccacctcccgggttcaagcgattctcctgtctcagcatcctgagtagctgggactacaggcgcccgccaccacacctggctaatttttgtgtttttttttagtagagacaggacttcaccatattggtgaaactagtctcgaactcctgacctcaggtgatccgcccacctcagcctcccaaagtgctgggattacaggtgtgagccaccatgcccagtcccaccccagcctcttgaggagagtagctggaaatacaggcatacactaccatgcctggctaagttttaaaaaatttttttagagacagggtcttgctgtgttgcctaggctggtcttgaactcctgggttcaggtaatcctcctgcctcggcctcccaaagggctgggattacaggcgtgagctactgcacccagcaatgttgtgttcttctcattgtgtcctgttaggtgatacaggctttcgttttgtcccattactatgaagttaaccttgatcactttattaacgtggtgttttgctgctgtaaagttttgctgctgtgaagttactctttttttccctttgtaattaataagtattttatgggaatgttcttaaaattatgtaagtaccccattcctcatcaaattttaaccctctgtttttaggatccattgatgttcctggttgcattattatactatgctggtcaccgaatggtatttttacaatttcataattctttctatacccatcagttggcatttcaccatagcaaaagctttcacctctccctattcatttttcacttactttattatactgtataaattcagtggacttttgactgggcgctgtggctcacacctgtaatcccagcactttgaggtgggtggatcacttgaggtcaggagttcaagaccagcctggccaacgtggtgaaaccctgtctgtactaaaaatgcaaaactagccaggcgtggtggctcacgcctgtaatcccagctacatgggaggctgaggcacgagaatcgcttgaacccaggaggcggaggttgtagtgagccaagatcgcaccactgcactctggcctgggagacagagtgagactctgtctttcaactgccccctccccactccaaaaaaaatttagtgratttgtcttatttgatgggttatataatctgttaataccattttagttttgatgctcaaaattgtatcatatctggtcaagggaagtttcttcaggctgacttttgtgtctttttgatgtctctgtcattctttgagaactacgtaactttctgccctgagaagatattcctggctggcttattttgtaccctcactagcccttgagctttttctctaggcagcatagttctttttagtggagaatgctttttaaaagccaaaatatgaatcaggcatggtataatcccagcactttagggggctgaggagttcaagaccagcctgagcaacttagtgagaccccatttctttaaaaaaaaaaaaaaaaaaaaaaaaaggccaagtgtggtggcacatgcctgtagtcccagctactcaggaggatcatttaagcccaggagttcaaggttgcagtgagttatgatcacatcactgtactccagcctgggcaacagagcaagaccctgtctctttaaaaaaaaaaagcgggggggttggggggggcaaatgttgatggtagacatggttgcccatacttaggttcactgctcccgggaaatgtatacatgtaacacacatgtatttatttcttaatttctgttattgaaaactataagctcacactgatacctccacttctaattctagtttggttctagtttttgtttttatatttgtaacttccttctttgaaagtgagaactctggccgggcacggtggctcacgcctttaatcctagcactttgggaagccaaggcaggtaggtcatctgaggtcaggagtttgagaccagcctggctgacatggtgaaaacccgtctctactaaaaatgcaaaaaaaaaaaaaaaaaaattagctgggcatggtggtgggcacctgtaatcccagctactcgggaggctgaggcaggagaattgcttgaacctgggaggcggaggttgcagtgagccaagatcgtgccattgcactctagcctgggcaacaagagcaaaaactcagtctcaaaaaaaaagagaaagtgagaactctgaccccccattacccttgatatatttacttatttttttctagtctctaattactagtttattttcctcaatttgttttagtaaacaaaatattgtatccttctactttaatgaaaaattttaagtttttttttttttccccaacttyagctttagggtcagggggtattgtgcagatatgttacatgggtaaattgtgtgttgtggggatttggtgtacagattattttgtcactcatgtaatgaacgtagtgcccaataggtagtttttcagttctctccctcctcccaccctccaccctgatgtaggccttggtgtctattattcccttccttgtgtccatgtatattcagtgtttagctcccacttataggtgagaacatggagtaattggttttctgttcctgcattaattcacttaggatggtggcctctagctgcatccatgttgctgtaaagaacataatttccggtgggcggatcatgaggtcaggagatcgagaccaccctagctaacacggtgaaaccccgtctctactaaaaattacaaaaaaattagccgggcttggtggcaggtgcctgtatttccagctactcgggaggctgaggcaggagaatggcctgaacccaggacgcagagcttgcagtgagctgagattgtgccactgcactccagctctgttgcctaggcttgagtgcagtggcatgatctcagctcactgcaacccctgccttctgggttcaagtgattctcatgcttcagcttcccaagtagctgggatcacaggtgtgtgccaccacacccgactactttttgtattttagtagagaagaggtttcaccatgttggccaggctggtctcaaactctgcctcaagtgatccacctgtcttggcctaccaaagtgctgggattacaggagtgagcaactgtgcccggccaatttcattctttttaatggctctgtagtattctgtggtatgtgtatatgtaccatattttctttattcagtcctctgttgatgggcacctaatttgattccgtgtctttgctatagtgaatmgtgctgtgatgaacatgtgagtgcatatgtctttttgatagaacgacttattttcctttgggcatatttccartgatgggattgctgggttgaaaggtaattctacttttagttctttgagaaatctccaaactgctttccacagaggctgaactaatttacaattccaccaataatgtacaagaatttccttttgtctgcagtctcgccagcatccattattttttggctttttattaataaccattctggttagtgtaaaatggtatctccttgtggttttgatttgcatttctcagatgattagcgatgtggagcatgttgtcgtgtttgttggctgcttgtgtgtcttctgaggagtgtctgttcatgtcttttgcctattttttaatggggttatttgttttttgcttgttcagttaaggttttttgtagattctggatattagacctttgtcagrtgtatattttgcaaatattttctcccattctctaggttgtctgtttactctgttgataatttattttgctgtgcagaagctctttagtctaattaggtcccatttgtcaatttttgtttctgttgcaattgcttttggtgtcttcatcatgaagtcttccagggcctatgtccagagtggtatattttagggtttctactagggttgttatagttttaggttttacctgtaagcctttgatcatcttgagttgatttttgtatatggtgaaaggaaggggtctagtttcaacattctgcatacggctagccagttatcccagcaccatttattgaatagggattcctttttgcattgcttttgtccactttgtcaaagatcagaaggttgtagatgtgtggctttgtttctggattctctaaccttttctattggtctgtttgtctggttttgtaccagtactatgctgttttggttactgtagccttgtggtatagtttgaaattaggtagtataatgcctctggaattgttctttttgcttctgcttcagattgccttggctatttgggctcttttttggtcccatatgatttttagaatagttttctctaactctgtgaaaaacgtcgttggtagtttgagaggaataacattgaatctgtaaattgctttgggctgtatggccattttaacaatattaattcttcctatctgtgagcatggcatagtttcccatttgtttgtgtcatttctgacttctttcagcagtgttttttaattcttgttgtagagatctttcacctccctctttagccatattcttaggtattttattcgttatgtggttattgtcattgggatttcattctggatttgaccctcagcttggacgtcattggagtgtagaatcactactgatttttgtaygttgattttgtatcctgaaactttgctgaagtttatcagatctaggaacctttgggcagaggctgtggggttttctaggtatatagaatggtaattgtctgtgaagagagagagtttgccttttgtttctttctcttgcctaattgctctggctaggacttcctatgtggaataggagtggtgagagtgggcattcttgttttgttccagttctcaaggggaccgtgtyttttgcccagcatgatgttacctgcaggtttgtcrtagacggctcttattattttgaggtatgttcctttgatgcttagtttgttgaggtacttgattgtctgatcattttttcctctgtgtaactaatctccttttgtaaccaccagccttctgtgtgtatgcccttctcacttcactgggtctccaataccccatgaaagactggcaccactgttctcttcaagcagacaacttccttatccccatcagtctctgacatcccaggccaggtacctcaaccccaacccagccacatggccaccatcatcatcatcatcttgtggcctctagactgaattattcaggaaagaaggagaggaaggaggattctaaagccccctaagtacctcagattcagtctcaggggcctgcacattttgaaacatctgacttgagtttttttaagtttctttattttttagagatgagtcctctctttgttgtccaggctggcctcaaactcctaggctcaagcagtccttccacctggcctcctgagtagctggatctaaaggcattataccaccatgcctgggctttttttttttttctcmagtcacttttgtttttatttattctaatattatttgtttgtttatttattttctttctagaaatgagatctcactacgttgcccagggtgatcctaaacccctgggctcaagtgatccttccacttcagcctcctgagtagctgagactaaaggcatgcaccaccatgggcagcttttttttttaattacagtcacttttattttcattttaaaattttatttatttacttgcttgttcattactttttttttctagaaatgggatctctctgttgctcaggctgatctcaaactcctgggcccaagcgatcctcccacctcagcttcccaagtagcaaggactacaggagtgtgccaccatgcctggctgagacaaaatttacaaagtataaaatatgcccattgtggttgggtacggtggcttacgcctgtaatcctagcactttgggaggccgaggcaggtggatcacctcaggtcaggggttcgagaccagcctggccaacgtggtgaagccccgtctctactaaaaatacaaaaaaattagccgggtgtagtgtcgcgtgcctgtaatcccagctacttgggaggctgagtcaggaaaatcacttgaacccgggaggtggaggttgcagtgagccgagatcacaccactgtactccagcctgggagacagagtgaaactccatctcaaaaaaaaaaaaaaaaaaaaaaaaaaaaaaattacccattgtaagcaattcaacgtaagcgattcaatggttttttactaaatttaattgcctattgtaatctcttcagtgtaagggattcaatggtttttactaaatttatataattatgtattgtcaccataatccaaatttagaacacttctgtcactcagaaagtttacttgtacccacctgtagttaatcctactcttctaattcctagctctaagcaataactcatctgctttttggttctgtattatgtgctgctaaatgtagttttttgtttctggtttctttcacttaacataatgtttttgaactttatacatgtagcatattcattcctttctattgttgaataatgttttattattggatagaccatattttgttagtccattcaccagttgatggacatttatattgtttgcagtttgggagtatcacattaatggtgctgtgtacatttccatgcatatctttgtgtggacatatgtttttatttcttttgggagtcagagaattgtgttgtatggtaagtttatgtttacttttcttttttcttggagatggagtctcactctgtcatccaggttggagtgtggtggtgtgatcatggctcattgcagcctcaatctcctgggctcagggaatcctcctgcctcagcctcccaagtgactgggaccacaggtgcacaccaccatacccagctaattattatttttttatttgtagagatgaggtctcaccatgttgcctacactggtcttgaactcctgggctcaagtgattctcctgtcttggcctcccaaagtgccaagattacaggtgtcagccactgcgcccaaactatgtttacctttttaaaaaacaccaaactgttttctgcagtggactgcatcatttcacattcacagagtttattttttaacattctcaccagcactaattactctctcttcttgattttaaccattctagtggtgtgtagtatatcactgtggttttaatttacatttccctaatgggtaatgatctgagcatcttatctcattgttagccatttgtatatcttttttggtggaatgtctgatcaaatatttttgttcatttaaaaaatctgttcgttttttttttaaatattgagccttgagttctttgtatgttctagatacaagccctttattagctatatgatttgcaattattttctccctgtctatggtggttctttccatgtatttggatggtgtcgtttgaaatgcaaaaattgataattttttattttttattgatcatgcttttggtatctaagaacttacttgcctaacccaagctgttttttttttccattttcttccagaagttttacattttctactcctaaatttaggtttatgatccatttgagttaatatttatgtatggtatgaggtcaaatgtgtgtgtgtgactgtccaatttttctagcagaattcgctggaaagggtatccttctactattgaatcctcttgacacctttgttgaagtcaattgaccacaagtgttaacagtttatttctggactctctcttgccttccattaatctatatgcctatccttgtgctaattccacactatctttgtttaatgtggctttatactaagttttgaaatcaggtggtataattcctccaactttgttctttttcaaaattattttatgtgttttgggtgctttgtgttgctatataagtatgaggatcaatttttcaattttttttkgggggggtggggtcgcaggggacagtcttgcttggtagcccaggctggagtgcaatagcgcgatctcagctcactgtaacctctgcctcctggattcaagtgattcttgtgcctcagcctcccaagcagtgggactacaggcatgcaccaccacacctggctaatttttttgtatttttcctagaaacggagtttcaccatgttggccaggctggtctcaaactcctgacctcgtgatctgcccaccttggyctcccagagtgctgggattacaggtgtgagccaccgtgcctggcccaatttttcaatttctacaaaagaccttgctggcattttgataatgattactttgaatttatacatcagtttgagggagaattgccatctcaacaacactgagttctaatccaagaacggaagttctctatttatttagggtttttttttttttttttttttgagatggagtttcgctcttttgcccaggctggagtgctgtggcacaatttcggctcactgcagcgtccacaccacccccaccccgggttcaagtgattctcctgcctgagcctcccgagtagctgggattataggtgcccactgccacgcctggctaatttttgtatttttagtagacatggggttttgccgtgttggccaggctggtctcgaactcctgacttcaggtgatccacccgcctcggcctcccaaagtgctaggattaaaggcatgagtcaccatgcccggcctatttagctttttaaaattttcttttagtgtttcatagttttcagcatacaagtctcatacttcttttgttaaatttatttctaagtattttaatatttctaatgctattgtgagtggggttgccttcctaatttcatttttgggttgtttgttgctagaatatagaaatacattgacttttgtctatctgtgtcaaagtcaaataaaaatatagagataaatctctaaacaaaatgttttctttgggaaaacagaaatgtaatttcgggcatacaaacagagtagagtagtcttcagtgtgtctacagagcaaagagaaggttgaggattttttttttttttttgagacagagtctcgctctgtcgcccaggctggagtgcagtggcgcgatctcggctcactgcaatctccgccacccgggttcacgccattctcctgcctcagcctcctsagtagctgggactacaggcacctgtcaccacgccctgctaatttttttgtattttagtagagatggggtttcaccgtgttagccaggatggcctcgatctcctgacctcatgatccgcccgcctcagcctcccaaagtgctgggattacaggcgtgagccaccrygcctggcctacraggattttattagaaagagaattgttgcatattgttttgaaagaaaagtcattggtacttgcaaagtttttagaagctggcaagctctgattggtgaatgacagtggtagataaaactggtcttaaggttttagcaggttattttggcagctagcttgcagtataatttctgtgttggtgctttgtgccctgagtgcttttcttttcctcttgtcttgattctacttgggtatgacaagatagctccaattcatataatcagtttttcacacatgtatttggtgacatgaccaaacttatttatataagttttattaggtgtttttgtttttttatttgtttgtttttgtttgttttgacagagtcttgctctgtcacccaggstagagtgcagtggcgggatctcggctcamtgcagcctccacctcctggattcaggtgattctccttcctcagcctcccgagtagctgggattgcaggcgcctgccactgcgcctagctaatttttctatttttagtagagacggggtttcaccatcttggccaggctggtcttgaacttctgaccttgtgatccactcaccttggccttccaaagtgctggaattacaggcrtgagctaccgtgcctggccgttttaatagttttttaaaaatytctttgggattttctacatataggattgttttgtgtgtgaatgataacagttttayttatcttccaatcttttttatttgtttattcctatttgtttttttatttttttgtttttttatttgtttattccttattgcactggctagaacctctagtacaatgttgaatagaagtggtagaagccaacatacttgccttgttcctcctcttagggagaaaagcattcagtcttgttgtcaaatatgtcttctgcatctattgagatggttgtgtagtttttgtcctttattcttgtaatatattgtaacacaattatgaagaagtgtttggagagtaatacattcgctactagaacagtttaggtttgcttttgttaaggtgcgagaagttttacccaccattgcttttataacatcagtgcaaatgccaacccagtgaataaggtaaatgatgtctcaatattcctgtgaaaatagttttgactttgctgtcctcctgaaagagtctcagggaccccaagaggtttgccaaccatactttgagaatcactgtccagcttgattgtagtgggtttctttttttttttttttaactgaaccagctcaagttttacagaattaaaacatgtatgtttataaaggatatggaactgtaattttcttagactgttgctatctggctttgaatcaaaattacagtaatgttgtaaattaacttaagcagctttttcttttattctattttccagcactttataagacaaagaccacttgtttgaaagttttttagttttcttcagtaaagctacctgtggtgatgaggacatggagatgcataatagagttttacacttggcaacatgtattcatgtgggaaaactcagtgatgagtaactcaaagaggtgctgagaattcggtgcttgtacaccatttcatttattttttatttattttttaacttttaggtttggggtacatatgcaggtttgttatataggtaaattgcatgttatgggggtattatataccattttaacaaaggatgattaattgtgaagtaactagacaaaggcttgggctgctaggggcagtaaattgtgtgaaggtgactaggaaatgtttggtaaataagggtttagtaacacttgtcatgtagattcaagtcactgctgtctctagtgataagaatgatctccagtgattaagaatcttcctggtacatgagatagaacacctttacaaatgcaaatttatattacttttacaaaagggaaatttataccttacttttaggcagaaagggggaaggcagagagtttgttgcttcttagtgtctttagccaaagtggcatactttaggataacatttcctggtcccctttagaagaataatacaagattcagtgtcagtgtatggaagccartcaatccccaattctgtcctggagaacacagggaaggcttcagagagaaggaaatttgagctgagaagtgaaaaattaacatgtattaggtatacatttgggataagggtatttaagttgaaacagtagcatatgcaagagaatagagacataatggtatggccttgtttactactggatgtaaagtgtgtgcatggtagattcttggaggcatgatgatgggtgggacaaattagcagggggctataccatgaagagtcttgattgtcatgctcatcactaatttggatatttatttatttatttggccatagcagttggaggattttgaacaggagatttatgtgatcatctgatagtttggtcaggggcatccagactagagtgactccatcttgattaaaggccagataaagccaaacctcctgggttacattcccaaggggttggacactgttggtcacaagatgtttagggttgagggaacaagttaatgatgctaactaackaaaagatgcttatgaaacttatgaaatgtttcagtacttgaagatcaaaaagcattcttagtttaagaataggttttgctttcatacaaaattagctgggcgtggtgacgcgtgcctgtaatcccggctactcaggaaggctgaggcaggagaatcgcttgaacccgggaggcagaggttgccgtgagccaagatcatgccgttgcactccagcctgggcaacaagagcaaaactctgtctcaaaaaataaataaataaataaataaaaaataggttttgctttaaagataataatgcactcatgaatttttgctaaaatccgtagtaacatagggaaataacactactgatagcctgtcacagctgatcacaagcctttgtaatgaagtacactatccttaacaacctatataagcaagcagtatgtttaaggtaggggtgttcctcctcttgaattctgaggatgtcctgctctgtaatagagaagtctctaataaacttcgctatactctgtgacaccctgaattatttcctgcatgagatccaagaacctgctcttggggtctcagacaagacctcttttctagcgacagtcttctttaaacatgccactatagcttggatttgagccatgattgtaccaactaaaatgcacaataattactgccatcatattctcctacctaggtaatatcacttcctttcttgtactctttacatacgtgtaagccacccacattttaaatttaatttttattttgtcaaagaaatatgtggacataatttcaaaagtctgttagttctttaaagctaataaagggattttgaaattcccttaccccattcctaccatccttgatttttatttattgaaaccaactactttaaatttttttatctatttcagtgtcaaattaatacaacttaatattatttctaataaagtcattgtgcattatgattatgtctgttttcttttgcaactttttgttttcctgagggtaataatggtctcacttttgcattgctttatattctatgtagcaatcatttattcaccccaaattttctatcagagctccaaaatgtttttcagtatattacattagatgatttaatctcctaatttaatcttctcccccaccatactccatccttccagaaacatttcttctagagccttctcgtcttctcctccaactcagagtgattattttctagtccccttgcatatttatttgccatcatggtatttccagtatctctctctactgtgggttctgaattcctcagatcttctgccttcctcttggaagcctcctgtccttctgtgccacgactgcctgtgccaaaatatgttgtgagttctcttcttcacatatctaagtctcttcagctatgagcctctgaaggccaaggattgagtatacttgcacctttttgagtattttaagtgcctgacatagaaccttgcaattarctgtcattaaaaaatgactgtggaccaggtgtggtggctcctgccacaagcctttgtaatgcccagcatttagggagactgaggcaggagggtcacttgagcccagcagttcataaccagcctgggcaacatagtgagatcttgtctctatgaaataataaacaaaatttagccaggtgtggtggtgtgcacttattcccagctgctcaggaggctgtggttggaggatcacttaatcctgggaggtcaagtctatagtggactgagattgcaccactgcaatccagcctaggtgacagagtgaaaccctatctcaaaaagactgtgttttctgatcatggcatgtgacaaataatacaaatgaaataaaaaataaaaaattgagggtaaaagaaaaaacagaataataaaaagataaaacaacaaccataaaaatgaccatgatgatactggtctattgaaagtggggggcctggtccttatgtagcrtctctacccatggctgcctcgtagaaactaactgtgttctaatcttttctgctatggaaatttgggcacaggccagacagctgggcaatttattgaggaaggaggtagaaaagaaggattgttactaatacaggatgggtttaatctgtattagtagcagattaaactgtgtattaagtaacagattaaagtatgtattagtaacacttaaactatgtatgtattgggccaaaatacatagtaattacaggacattttgcatttcctgtcaaccactagctctcaaagctactggtctagaaatgtaacctgtgagtgggcttataatttggagcttccagagaaatccagaggccatgggaactagtaaagacaaaccaaatataccacaacttcccagacactatgttatcagggcagtctatactagttccaaggcccatgtttgtggatggcctcagtagtggaagtgtactccattcagagaaaaaaatctatagtctcactggctgctttcctttgattaccaagagatgtactgctttaagaatacattacaaaaccattatctccctttccttaattctccagtctctcccattcattaattctccaaataataaacatgtatcaggcactgtcctggacactggaaatataggcatgcctagaatacccagaatctgaggcagtgcccagtctagggtttttaaatttttctcctatctcttttaccaggttgattccattagaactgtgtgaatgtcaactgcaaataatcaaagacagaattatcttgttttcttggtggtggggagatttactaaggtgtggtggaaaatcctatcctcatcttgagactggggatggagacaagttgcctgtcatgaagggaacttgctactacgtcacataaattattccagggcagaagattgtactggcttatatttggccaatttcctccctctctttatgtcttttctttaaaacccttgattccttccaagtgttcttagtctattaaattcatgatatcttgggcttggcattccaggtttagacctgtatttgtttcttttccctgtaagttgtaactgttgcaggaacatgtagcagagatgtttagatttggctggtataatctgcctgggactgaattatgcttcctttgcattgctggtggtcttttctgctataagatatagtgaaaggattcaggattgttcagtgtagagataatctgtacctctttattttttgtctggctcaagatagcgctctctttattgtgtcctgatatagggttgatagtcacaatagtagtcaaggtggtcacgactaaagactttggtgggagcatactgtttccttagtctctgtcatagcagacctgctccccaatatttgtgcctacgtcagagttttgcaccagtccctagggtacttattgctgtcctctcgtccatgaagttaggccacataaaatgcccttgattttctggatacttgacttttagatcatttgaggatgaagcaccacactaagaaagtccgagggcaaagaaaattcaagttagattaggccttcaaataatgttattattttatcttgacttagggaaagctatgtagcatttcttagccttcagttccttgtccaaataaagggataataatagtcgctgcttcatagggtgtgagatactacatgtaatgctttaaaccagggttgttagttttacaagccaatcttttggcttccctctgccacataggaagaattgtcttgggccacacacagaatacactaatgatagctgatgagctttaaaaaaaaaaaaaaaaaaaaaaaaacccaaacacctcataatgttttaagaaaatttccaaatttgtattgagccacattcaaagctgtcctggactgcatgtggcctgtgggctgccagttggacaagttagctttaaaccaagcccagtgagctcttagtaattgttagatattatcattgttgttttaaatgcatagctgatttcagcagaacatgaggaaaaccctgagggacccaaatcagagagagaaaacaacacctaatcaataagagtagaagtgctagccagagcagtaggcaagagaaagaaataaagggtacccaaatagaaagagaggaagtcaaactacccttgtttgcagatgacatgattctatatgtagaacacctgatagtctcagcccaaaagcttcttttatttttttgagacggagtctcgctctgtcgcccaagctggagtgtagagggcccatctcggcccactgcaagctccacctcccaggttcatgctattcttctgcctcagcctcccgagtagctgggactacagttgcccgccaccacacccggctaattttttgtatttttagtagagacagggtttcatcatgttagccaggatggtcttgatttgctgacctcgtgatccacctgccctggcttcccaaagtgctgggattacaggcatgagccactgcgcctggccccaaaagcttcttaagctgataaacaacttcagcaaagtttcaggatacaaaatcaatcactagcagaaagcactagcattcctatccgccaacagcagccagggagagagccaaatcaggaaggcagtcccatttacaattgccacaaaaagaataaaatacctaggaatacagctaaccagagacgtgaaagatctctacaatgagaattgcaaaacactgctcaaagaaatcggagaggacacaaacaaatggaaaaacataccatgctcatggataggaagaatcaatatcattaaaatgatcatattgcctgaagcaatttatagattgaatgctatttctatcaaactaccaagagtattcttcacagaactagaaaaattatttaaaaaattatatggaaccgggccgggtgcggtggctcacgcctgtaatcccagcactttgggaggccaaggcgggtggatcatgaggtcaggagttcaagaccagcctggctaatatggtgaaaccccatctctagtaaaaatacaaaaaattagctgcatgtggtggtgtgtgtctgtagtctcagctacctgggaggctgaggcaggagaattgcttgaacctgggaggtgaagattggagtggactgagatcatgccactccattccagcctgggcgacagagtgagactccatctcaaaaaaaaaaaaaaaaaaaaaaaaaaagtcatatggaacaagaaaagagcccaaatcgccaaggcaatcctaagcaaagagaacaaagctgacttcaaactatactacagggctacagtaattaaaacagcatggtgctggtacaaaaacagggacataaaccaatagaacagaacagagagcctattttaaaaatcaggggttttaaaatcgtaggccacacacctatgataacctgatctttgacaaagctgacaaaaacaagcaatggggaaaagactccctattcagtaagtggttctgggataactggctagccataagcagaagactgaagctacatagtacccctcctttacatcatatacaaaaatcaactcaagatgcgttaaagacttaaacgtaaaactatgaaaaccctggaagacaacctaagcagtaccatcctggacacaggaatgggcagatttcatgacaaagacaccaaaagcgatygcaacaaaagcaaaaatggacaagtttaattaaacttaagaggttctgcacaacaaaagaaactatcaacagagtaaacagacaacctacagaataggaaaaaatatttgcaatctgcatctgacaaaggtctaatattcagcatctataaggaacttaaacaaatttacaggagaaaaacaaccccattaaaaagtgggcaaaggacgtgaacagatacttttcaaaagaaggcatacatgcgaccaacaagcataagaaaaaaagctcaatatcaccgagcattagagaactgcaaatcaaaaccacaatgagatctatcatttcacaccagtcagaatggctgttgttaaaagtaaaaaaataacagatgctggcaaggttgtggaggaaagggaacacttacacactgttggtgggagtgtaatttagttcaaccattgtggaaagcagtatggtgattcctcaaagagctaaaagcagaagtaccatttgacccagcaatttcattactaggtatatacccagaggaatataaatcattctgccataaagacacatgcacacgaatgttcattatagcactattcacattagcaaagacatggaatcaacctaaatgcccattaatgatagatgggataaagaaaatgtggtacatatataccatggaatgttatgcagccataaagaacaagatcatgtcttttgcgagaacatggatggagctggaggctacgatcctaagtaaactaacccaggaacaggaaaccaaataccgcatgttcttacttataagtgggagctgaatgaagataactcatgaacacaaagaagggaaaacaacagacattgaggtctacttgggggtggagagagagaggagggagaggagcaggaaaagtaactattgggtgctaggcttaatatctgggtgatgaaacaacctatacaacaaacccctgtgtcaggagtttacctatgtacctgaatatgtacccctgaacctaaaaaataataataataacagtgggagccagctttgaagcttccaaaaatggggtcagggaggagatgtgctagtctcaataaccttgaggggaaaaaagatgaggtcttggcttgtttagtgtaagcaattagaatggacaccccctacatacaattaggaccctcaaaagacttcaccctcagtgcaggaatggactaggaaaaccactggcatgtacagataaaaagaactttcttaatctcatctggattttaaatagggcttttaataaaggaaagacgtctcccttgaaaatttctacctgtaagccttcacttaactgaaattgggggttggagtttatactctttgtgtggtctagaagctggttctgggctggtaataactctggctcatctgtcagaaacaaacttaacacttctattaagtgacataccctcaaatcaggtatcataggattctcataaatgcagcttcactgaaggtaagtttgtagtacaaaattacaaaccaaccaaccaatctcccctaagtgaaaatcaatagataaaagaaacagtttggaacttcagaaagtagcattagagggtgggcacagtggctcacaactttcatcttaatactttggatggctgaggcgagtggactgcttgagcccaggagttcgaaaccagcctgggcaacatggtcaaaccctgtctctacaaaaaaatacgaatgttagctgagtgtggtggctcatgcctgtaatcccagcactttaggaggctgaggtgggaggatcgcttgagcccgggagttcaagaccagcctgaacaacatagtgaagtctcatctctactaaatttttttttttttaattagctgggcatggtggtgcatgcttgttttctcagctacttgggaggctgaggtgaggattgcttgtgtcagggaggtcaaggctgcagtgaactgtgattgtgccattgcaccctagcctggatgacagagtgagaacctgtctcaaaaagaaaaacaaagtaacattagagattaagactgtaagattagtatatttaaaattattaagaatataaaagaaggaggctggacatgatggcttatgcctgtaatcccagcagtttgggaggacaagacgggcggatcacttgagcccaggagttcaagaccatcccagacaatatggtaaaaccctgtctctacaaaaaatacaaaacttaktcaggcatggtagcatgggcctgtggccccagctaccctggaggctgaggtgggaggatcacctgagcccaggaaatagaggcaacagtgagtggagattgagccactgcactccaacctgggtgacagagtgatcccctgtctcaaaacaaacaaaaaagaatataaaagaaggaaacagaaacaagagaaaaaaagaccaaatatatttggacaaaaagctaattagaattcgaggaataaaatatatgtattgtgttgttgaaattgaaaatgcaacagtcgtgttaaataatagagctgtggacaaagtaaaatttttatcaagagtgcaagacagaaatgggaagatataaactatgaatgaaagctaagaaatacagaagatatgatcagatggtccaacagaatatggagaaatgggaagaggcagtattcatagagataatgactgagaccttccagaactgattagaaacaaacaaggaacatcttgaagcatggtgagtccccactataataaataaaaataaatccccatctagmtacattgcagtactgcagagccatgaaaacaaagagaatatcttaaagaaccctcaagaattcactaaagtaaaagagctcagcaagaaagttcactcaagaaaattgaaaatatatgttcatgcaaaaacttgtaaacaaatgttcacagcagcagcatctatgataaccaaaaagtagtaacaacccaaataccttgtcattttatgaaaggattaacaattgtggcatggagaatttatgcatgccacaacatgcatgaaaacatgctgagtaaaagaagccaaagactacataatgtatgattcagtttctgtgaaatgtccagaatacgtagagtccacagagacagtgaatccatagagacagtacgttggtggttggttgtggggagaatgggatggagaatgactgctaatgggtacaaggtttctttttggcaatgaaaatattctggaattagatagtggcagtgcttgcacagccttgtgaatatactaaaaatgaatgagttgtacattttaaaagggtgaattttatattgttggaaatatatctaaaaaaataagttaatggttaaaataaagcaaccagacagaaaaagaaaaattaagtacaaaggaacagcacttatgctaagagtaagcttttcaacagcaataacaggagccataagactacagaataatatttttaaagtattgagaaaaaagttactctgaacaagacactagaattatccatacttgctaaattagcagtggaagtgagtgaccaaaaaaagccattttcagaccatcaaaaaccaagagaacaaaatctatagagaagatttattactatcagatcctctctgaaataattactacaggatatatttcagaaacaaagaagaaatacatgagatcccaagagggaatgttaagcagtgaaattagaaaatacatgagtaaatctaagcaagcaattattgtataaaataataattactaatttggcaatgtaaaagtaagatagacctgaaataatagattgtaataataggtaagttgaaagggagtgggaggattggagttaaaagcgatctaggatcttttaattttgttcagaaagagagttgaggtgctggttaactttagacattgttgagacaagaacacctattaaaccttgaataataacaactactttaggacagaaaaaaacaaaacaatatgtaatttctaaaccaatagagcagaggttaaaaaaaaaaacttgattaattcaaggagagttgccatcagacttggaggaaaactttaccttagagcaaagacttttctcctagttcctctgatgcctgctgcccttgcggggaattctractacctgcttctgtggaaatacattcatttgttcaataaacacttgtcgaaaacctcctatgccctgtgtactatttctaggtgattgggatacctcttagagctcactctagaaaagaagaaacagacagtaaacatagtttatgtagtatgttagaagatgacaaatgctattgggaaaaaaggtagaccaaaggggattcaggaaaacagaaaattgggaaggtgacattagaataaagccttgaaggagtgagggattttgccattgtgtagttgaaggaaggacattgcaagtaaagggaacagttaacgctggtcctagtagctagaagtgcctgtgcaaaattagcagcctgtggaaggttttgagcagaggaatgaaataatcagatgtgtgctttaaaagaatcactgtggcttgctcatattaagaacagattagggtagaagacaagagtaaaccagagagactagttaggagggtattgaaatccaggtaagcaataaataatatatcaataataatataatggatacgtaataatatctccctttattggggagggaatatgtatttttytcccactctcacttccccatcttaaccaggacatcttggttgttactctgaaatattatagcatctggaagtgcttgactgtaaccagctccacattcttctttatattgtttacacttactgaaacagaagtgatcttttcctcattctaaattctaaaaggtgcctgccaagtactatccagtcacggagtgctcaagttcctaggagcagctagacctctgagatttggagactggagagacctaagggatctgcaaccagacatcttattccataccctttgttgcttcacagtgggaagcaggcttcctaagtaaatttacagcagctcttgcaggggtcagattttccgagtgcctgctagttgctggagggaggggtttttgaaggctagaaacgatctactactctccaaatgtggttacaattcaacattgtcacagagaatgcacgatatgccttagcccttgttcttgctgttgactgagatgaccatggcgaggtatgtaagaaattgaaatgccaagtctcactccaagtagccaagtgactgggatgatttaacaccagtctttgcatgaggtagctccgggggcttccaggctaccacccrtccgctgagagttagtgtacccaactctgcagatatccagtacttcatcttactggaatgaaagaattaagacttgccctttatcttcttaggatcctggggaaatggccagagcctgttgaaatggaaaaattagccagttccttgttgtggatctcagctgagtcatggtatctgtagcagagtgtctgacctttttttcccctggcagctgttaaagatttgccaagtgagattatgtgtacctttataaaaaggcatgtggcctggaaatacgatctttagtgttttggcttttattttaaattttaaataaggttaaggcaaatgaagctggaattaattatccgtccctgaagtttcaagacattttcactttcagacacaaggatttagatataacagtttgatttacctttcataggccaggtatacatgtatcttctttattttaatccttgtaacaaatcatactcatccattcatttaacaaatacttattgagagcctactgtgtgccaggcagcgttctaggtattgaggagtgcagcagtacacaaagcatacaaaagcccctgccctcatacagtttaatttctgatgagaagagagacaacaaaatgaatgtgcaaaatatataccatcatatatatattggggattagttccaggacccacacggataccaaaatctgcagatgcccaagtctcttatataaaagagcatacataatattcgcatataacctatacacatcttcctgtatactttaaatcatctctagattatttataatatctaatacaaagcaaatccctgcaaatagctgttatactatatttttaaaatttatattattttaaaagttttaaaaaatattttccacccatagttggttgaatccatggatgtggaacccacatgctgactgtagtgtgttagatgatgataagtgctaggagaaaaatatatcaagaaagggggatagagagtttgggagggtttgcaattttaaatagaatgatcggggaaaattcacccagaagattgtacttgagcaaagacctgaaggaagaggggagcaagccttgaggcaacctgggagaaacataggcaaaggaaatcccaattgtaaaggccctgagatgggtggctcgcttggcattttctaagaaaggcgaggaggccggtgtggctggagagtgagcaggagggagagaggtcatggagaatccagaccatataatgccttgtaggccatcatcagaactggctttttctctcagtgagacaaggagaattttaaatggaagagggacatgatgttgcttacattttaaaatttttgtatagttttattgaggtatgattggaatataatagattgtatgactgtgataatgaacatgaagataatgaacagatctataactctcagaagtttcctcatgactatctataatccattccttgcttctcattgggcaactactaatctgcagtctgtcactatagattagttagcattttctataattttatataaatggaattggatcaactaaacaatttgtccttgtgagtcccaccagtgaaatttcttaattgtggtgggtcaaattcaaattttatttttttagtggttctacttttgagaaaatttttatttcacctctcccaatggatagatgtttatttcaagatacattgcaacctattgtcaacacttcaaacctgccaatcattgacttcttgaaggagtgtaatttgttatctatggctcctaaatgttcctcatatcaccaacccttactgtgggtggtacaatgccagtataataaagacagctattcatggaaatttgttcactgcaattgccaatcagcatgagtctgtctttgaaaggattattttttcacaaaatccagcatttccctgaataagtggcttcatcttcccttgttatggtctatggaagtcacagagagagcaactactgctgttactggaatttcagtccatactatggtcagtgtccacaatttctgtcacaaagtatgcaagcattactttgaactacatccgatacagcttagtggtttaggtcattacttgcaaatcagtgagtcctgttttagccacgaaatcaagtgtcactatagccatgctctggagagagaaataatgggcttttggtatggtggatacacccatcagccagctattggttatttggaaatttttggtgactgttctgcccaaaccttgccacctattttgcagtgcctagttgagcacagttcatatcatctcttggcatacatacccaaaacatctagtgctattgaaataaatgcaaagcaaagtgcaagaccatgagaggaattcgtcacaatgtgttggactcgtatttggtcgaatttatgtgggatgattgacttggaaataatgttttcaattcccttttagcgcatgtgtcagaacagtctcctgttaagtaacattatgtttgacttttgtttttagtatattttagtataaatatccagggacaaattttttgattgaatacacctgagaggcaaattgttcaactcatccatgaaagcatacaacatactcttttttgtctggcatcttgctttcagcataattatttgtgagattcatccattgtgtgaatcaattattcattccttgttattgctgagtagaattccattatatggatatactgtgatttgtttgtcactcatctgttggtgcatattttaggtggtttgtagtttcgggctttcacaaataacagcatataagtggatcctgctattttatccagtctgacaatctctgccttaactggctgtgtacttagaacatttatatttaatatgattattggtatgattgggtttaaatatgttatttgttttctaattggcccaactgtacgtgttcttctttttctggcacaatcattggctcactgtagccatgaacccctggagtcaagcagtcctcctgcctcagtcacccaagtagctaggactgtaggcatgtgccaacatgcccagctaattttttttaatttttattttctgtacagatttgaggaaggaaaaggggtattggaggtttaaggagaaaatgtgaattagttgtcttggagagtgagcaaacacattactctggtaaatgtgctaagattgtcaggcagtaatgaggccccacttgatgtttgtcactgtgaatataaagacacatcagccagcatgattctgggtttttcttcagtcactctaagttcccaggtgcagttgcaaaatagatggraagcttggttgtaaagggttgggatttcgccaggactttggtgtccttgggaggtagcaacgtttcatttggagctagaatttaaagcagacactcagaagagaaattggggatataggcagtttgctgatgacatactgagttcaaggaggcaaagtataagcttttctcaaaggttcagagtagtgggagactgtcaggttagagagtggaaggcattccatggtgactgaggtagttaggggtatgggcatgattggattcctcctgatggtttcttaggggaaaatggttatcatttctaatgataatctctttcttgagattgatctcattccttccatcagccctacagagtctggctgtggccttccccatagcttctataacctacttctttttctgtcattctcccctcctgtcatccactcttgacttctttgctatttcttgaacatcccaaatttgttcttgtctcagtgcctttacctttacttttctctctgcctctcagctctacttttgtctgagtccttcatatcattcagctctctcatcagacttcacttccctagttagcactcccacaccagtctcttatttcctttctccttttctccctctccctccctccctctctctctctctccctctatccccctctccccctctccctctctctccctctttctgttctttcttcctcttccttttcccacagcactgttcactccagttatgaggatagagactgttcttttgttccctactgcttccctcctaagacactgcctagtgtgtagtaggtgttcaataaatatttggatgaatataaatggcaaacttccctaatgccttcaaaagatagactgactttcaaataaattgatatagacttttcagtaatagatgttgcatgaaatggcttttcatcaccatctggttttctccaaccagaagaaaaagcttcagacattaacatgtagtggaaagcccgtttatagaagaaacccagggctgttctgacatttattctgaaatgagaatattacttaattcacggactaaacgttctaaaaataataatttcatagattaatagttttggggggttcttagagaatatgagaatattttgacttgtgctttttattttgtaaatcaatttgcagtggtcattcttcattagatactgtttaaaacatggtttttgcccgtagggagctccttgtgtttgcttgggaaataaaactaaacattggaaaagcacagtggcaatacaagatgaaagtcaaggcagtgaaaaaakttattccaaggaggaacacagtgctttatggaatctaactggtgccgagtgtaattgctgacccagttcagtttaaagaagtatactgtgcggcccgtgraatggtgtccctctttagttccttaaaaaccactcaaggtctctgggcccatggtgtggccctattataattcatattttgttttcattgcagttgtcggacaagtaaccgcaagagcttgattgtgacctctagcacatcacctacactaccacggccacactcaccactccatggccacacaggtgagtgcttgaaggttaagaaaggttgaatgaaagagtggccacagatgcccaatttctttcctacttctcatgttgtgcagttccgtatattacattgtcactttacttggctgactgaagcagacagagctcatgggcttgctttctgtacgagaatgagttagcctgcttttgactcttagttgtttcttaccttgttctctcaacattccttttagtcttgtacatatcttggggccaggtatgtgtcctgggtttatggcctctgttctagtgtgttctagtgtgttacagctccattcgtcttgggtcatttgatgaggagtccactaatattttgtactaccrtgcccaaggattagggctcacagagagggtttttcgtctaatgggactcctgttaaccttcctgctcttagattaggagataacaaaagcaagaggagtatgtgtttgtttgtttgtttttaaatagaaacgaggtctctctatgttgcccaggctggtcttgaaatcctaggctcgagtgatcctcccacctcatcctccaaagtactgggattataggtgtgagccactgcacccgggttggagtatttgtttcataatgatactgatattacatactggaattaaagcaaatgacctcatggattcaggctgctctagccctggaatatgggctcttcccgacagtataaggactgatttacatggctctgaagaatagataaaaattatgaggcagctgggcacagtggctcccgcctgtaatcccagcactttgggaagctgagatgggccaattgcttgagcttaggagtttgagaccagcctgggcaacatggcaaaaccccgtctctacaaaaaatacacaacttagctggacatggtggtgtacacatgtagttccagctacttgggaggctgaggtgggagcatcgcctgatcacctgagcccatggaggttgagatcataccactgcactccagcctgggcagcaacagaatgagaccccatctcaaaaagaaaaaaagaaaagaaaagaaatacgaggcttccattgattctggcacattgtccttcccagagaggggcagaagaaagacctcatcggagtcagccatgtgcttctgtgtagaaggtatattcttgtatcccaggggaaccaggccacgggactcagctttgctgaaagggctgcagcacttctgtgcagttcattgctacactctttataatggaagatctaaacctacagttagtggcaattgacaracttagaactgttcagagcttgctgcctgggcatagaaagccatggtcactgttgtcctaagcctggaccttgtctgtctttgggcgttaaagcaggatatcaaagcagtgaaatgggtcagcatcaagctgagtaagatgtgtatattctccatgaatttgtttccttgctcacagtttactgtctttggagggagaaagtgagggtacatgtggagtatttgagggtcctgagagtctggtgattctgaaactgaactttgtccttgggagaaggatctcaccttctttggctcagattctcttagcctagaagccagccttttagtgtgatgatggcccctttccaagaatcagtaaatctctcaatcacaagctgtcactttagaagataccaccaagagaacagggatcccagggaactggagacatacttgacctttaaagcaaagctctcattgtgcttaggtgctttcctctaaaaaaattgactgaaattagctggattagctcaaacagcacatcctagatttttagagaaactcagcatacatctatctgacctgacctttttatcatataggaataaatttaacatgtctagaccttgtatatagttgcacaactaatgtgagtactgagcagtagttactactggctgctcttctctagatgattatctctctatttagattctccacagttagcatttagaactaaatcttcctactcaagtggatttgattgagaacaccacctggccttttcagcctgcctggatctgtagactccagctttgagttaatgtgtgtaacatgcttagtactttacaaatgttagcatctgtattatctcttagcaaatcactgcagaaaatctagggggcaagaatggacataaaagcccagtttgtgactgtagactatacttatccagctgttgagacaggcagcactgattgttccacgcagatcccacatggcattagattatatcctcaaatctttttttttatagataattttattatactttaagttctagggtacatgtgcacaacttacaggtttgttacatatgtatagatgtgccatgttggtgtgctgcacccattaactcgtcatttacattaggtatatctcctaatgctatccctcccccatccccccaccccacaacaggccccggtgtgtgatgttccccttcctgtgtccagtgttctcattgttcagttcccacctatgagtgagaacattcggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctrtcattgttggacatttgggttggttccaagcctttgctattgtgagtcatgccgcaataaacatacaagtacatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgcaagatgatatctcattgtggttttgatttgcatttctctgatggccagtgatgatgagcattttttcrtgtgtctgttggctgcataaatgtcttcttttgagaagtgtctgttcatatccttcgcccactttgtgatggggttgtttgtttttttcttgtaaatttgtttgagttctttgtagattctggatattaaccctttgtcagatgagtagattgcaaaaattttctcccattctataggttgcctgttcactctgatggtgatttctttttctgtgcagaagctctttagtttaattagatcccatttgtcaattttggcttttgttgccattgcttttagacatgaagtccttgctcatgcctatgtcctgaatggtattgcctaggttttcttctagggtttttatggttttaggtctaacatttaagtctttaatccatcttgaattaatttttgtatacggtgtaaggaagggatccagtttcagctttctacatatggctagccagttttcccagcaccatttgttaaatagggaatcttttccccatttcttgtttttgtcaggtttgtcaaagatcagatggttgtagatgtgtggtattatttctgagggctctgttctgttccattggtcgatatctctgttttggtaccagtaccatgctgttttggttactgtagccttgtagtatagtttgaagtcagatagcctgatgcctccagctttgttcttttggcttaggattgtcttggcaatgcgggctcttttttggttccatatgaactttaaagtagttttttccaattctgtgaagaaagtccctggtagcttgatgggggtggcattgaatctataaattaccttgggcagtatggccattttcacgatattgattcttctatccatgagcatggaatgtttttccatttgtttgtgtcctcttttatttcattgagcagtggtttatagttttccttgaagaggtccttcacatcccttgtaagttggattccttggtattatattctctttgaagcaattgtgaatgggagttcactcatgatttggctctctgtttgtctgttattgatgtataagaatgcttgtggtttttgcacattgattttgtttcctgagactgctgaagttgcctatcagcttaaggagattttgggctgagacaatggggttttctagatatacaatcatgtcatctgcaaacagggacaatttgacttcctcttttcctaattgaatatcctttatttctttttcctgcctgattgccctggccagaacttccaacactatgttgaataggagtggtgagagagggcatccctgtcttgtgtcagttttcaaagggaatgcttccagtttttgcccattcaaaactggctgtgggtttgtcataatttattgagagtttttagcatgaagtgctgttgaattttgtcgaaggccttttctgcatctattgagataatcatgtggtttttgtctttggttctgtttatatgctggattacgtttattgatttgcgtatgttgaaccagccttgcatcccagggttgaagcccacttgatcatggtggataagctgtttgatgtgctgctggattcagtttgccagtattttattgaggatttttgcattgatgtttatcagggatattggtctaaaattctctttttttgttgtgtctctgccagtcttttgtatcaggatgatgccggcctcataaaatgagttagggaggattccgtctttttctattgattggaatagtttcagaaggaatagtaccagctccttcttgtacctctggtagaattcagctgtggatccatctggtcctggactttttttggttggtaagctattaattagtgcctcaatttcagagcctgtcattggtctattaagagattcaacttcctcctggtttagtcttgggagggggtatgtgtcgaggaatttatccatttcttctagattttctagttcatttgcatagaggtgtttgtagtattctctgatggtagtttgtatttctgtgggatcggtggtgataacccctttatcattttttattgtgtctatttgattcttctctcttttcttctttattagtcttgctagcagtctatcaattttgttgatcttttcaaaaaaccagctcctggattcactgatttttttgaagggtttttttgtgtctctatctccttcagttctgctctgatcttagttatttcttgccttttgctagcttttgaatgtgtttgctcttgcttttctagttcttttaattgtgatgttagggtgtcaactttagatctttcctgctttctcttgtgggcatttagtgctataaatttccctctacgtactgctttaaatatgtcccagagattctggtatgttgtgtctttgttctcgttggtttcaaagaacatctttatttctgccttcatttcgttatgtacccagtagtcattcaggagcaggttgttcagtttccatgtagttgggcgattttgagtgagtttcttaatcctgagttctagtttgattgcactgtggtgtgagagacagtttgttacaatttctgttcttttacatttgctgaggagtgctttacttccaactatgtggtcaattttggaataggtgcggtgtggtgctgggaagaatgtatattctgttgatttggggtggagagttctgtagatgtctattaggtccacttggtgcagagctgaattcatttcctggatatccttgttaactttctgtctcgctgatctgtctaatgttgacagtggggtgttaaagtctcccattattattgtgtgggagtctaagtctctttgtaagtctctaagttaaggccttgctttatgaatctgggtgctcctgtattgggtgcacatatatttaggatagttagctcttcttgttgaattgatccctttaccattatgtaatggccttctttgtctctcttgatctttgttggtttaaagtctgttttatcagagactaggattgcaacccctgcctttctttgttttccrtttgcttggtagatcttcctccatccctttattttgagcctatgtgtgtattcagtattaaatatctactacataagtaggttacagtgtcagtaatgtcagttcagtaggtacatacccagccattcgagaaatggaaactccctaccttattttttttttaattatttcttagagtagttttaggttcacagcaaaattgaggaagatactgagataaaccatataccccctgccctcacctatatataggctccccattatcagctccctaccagagtgctacatttgttacagttgatgagcctacactgacacatcacccaggcactagtttacattaagattcactgttagtggtatacattttgtgtgtctggrcaacattatcatttaccattatagtatcatacagtcttttcactgtcctaaaaattatctgtgctctgcctatttatttctttctccccttaactcctggcatccagtaatcttttgactgtctccacagttttgccttttccagaatgtcatatagttggaatcatacaatagccttttcagactggcttctttcacttagtaatacgtactgaagtttcctccatgtctttccatggcttgatagctcatttctttctgaataatatcctgttgtctggttataccacggtttatttttatccactcacctactgaagggcatcttggttgcttctaagttttggcaattgtgaaaaagccgctataaacatctgtgtataggtttttgggtagacgttaatttttaacttatttgggtaaataaggagcacaattgctatattgaatggtaagagtgtatttgattttgtaaaaaamaaamaaaaaaaaactcttcaagctgggcgtrgtggctcacgcctgtaatcccacactttgggaggccaaggtgggcagatcacttaaagtcaggagttcaagacaagccgggccaacatggtgaaatgtcgtctctactaaaaatagccagacatggtggtgtgcacctgtaatcccaggtacttgggaggctgacgcaggagaatcgcttgaaccagggaggtggaggttgcagtgagccaagattgtgccactgcactccagcctgggcaaaagagtgagactctgtctcagaaaaagaaaaagaaaaactcccaggccgccttccaaaggggtggtaccattttacattcccaccagcagtaaatgaatagctcctgttgcatcatatccttgccagcatttggtggtgtcagtgtgtggatctgggtctttttttttttttttttttttttaaggcagggtctcacgccatcattcaggttggagtatggtggcacagtcacagctcaatacagccttgagctcttaggctcccagattttggctattctaatctatgcgtagttgtatctcatttaattttcaattcctggcggagcacgatggctcacacttgtaatcccagcactttggggaggcccaggcaggcttttttttttgagagagagtctcactctgtcacccaggctggagtgcagtgatgcgatcttgggtcactgcaacctccacctcccaggttcaagcgattctcctgcctcatcctcccgagtagctgggactacaggtgtgtgccaccacacccaactaattctgtatttttagtagagatgacgtttcatgttggccaggctggtcttgaactcctgaccacaagtgatctgcctggctcagcctmccaaagtgctaggattacaggcgtgagtcactgcacctggccttgcatataacttttgactgccccgaaatttaactactaatagcctgctgttgaccagaagccttactgataacatagttaattaacacataatttgtatgttttatgtattatatacgatactcataacaaaataagctagagaaaagaaaatttgttaagaaaatcactggaagagaaaatatacttactgttcattaattggaagtgtatcatcataaaggtcttcgcctcatcatcttcacattgagtaggctgaggaagattaaggattagtcttgctatgtcaggagtggcagaggcagaagaggtggaggaggtggaaagggatgcaggagtggcaggcatacaacttttactgaaaaaatttgtgtataagtgaacccgtacagttcaaacctgtgttgttcaaaggtccactgtaatccaaatcaaccttcaaataccactataccactttgccttatgatggcaaaatacacctaaatcctctcttcagtaccttgtaattttgctgtcattcatttcacttatatataagcacatgtgtgtacgtgtgtgcataatgtatgtaaaagcatacctaatcacatacattgttgctgttacagattaagcacccccagtccaaaaatctgaaatccaaaatgcaaaactttttaagcaccaacatgaacctcacaggaaatgcttgttggagccttttagattttgggctttcagatttgggatgttcagctggttagtataatgcaaatatttcaaaatcagaaaacaaatttgaaatttaaaacacttctggtctgataagggatacttatcctatattatgttgaacagacttatctattagacaaattaagaataagaaaaacaagtttttagtttaccttcatcacttctccagtgtgcttgcttgtttcatgtagagttcactttctcccctatrtaattttctctctgaacaacttcttttaacatttcttgcaaggcagatctactgctatagaatcccccattttttgttagggaaaatctttatttcttcttcacctttgaagtataatttcacagggtacagaattttaggttgcttgcttggtttttttgttgttttttttttttgtctctcaacagttttaatatttcactccactatcttcttgcttgtgcggtttgtgagaagttggatgtaattcttgtcttcgctcctctgaagataaggtgttttttccctctggcttctttcagatttttgtgtacctttggttttctatagtttgagtatgatatgtctaagtgcagtttttttctgaatttatcctgcttggtattttctgagtttcctgaatttatggctttgtgtctgactttaatttggggaaawtttatgtcattattgcttcaaataattcccttcctttctctctttttcttcttgtattactgctgcatacgtatcacaccttttgtaattgtctcacagttctcggatgttctggtgttggttttttttttttcggtccttttttctttgctttttagttttggaagtttctgttatcatatcctcaagatcaaagattatttccccagcagtgttcagtctattaatgagcccatcaaaggcattcttcagttctgttacagtgatctttaacattttcttttgattcttccttagaatttctatttatattatccatctgttcttgcgtgttgtctacttttcccattaaagtgcttagcataattaatcatcgttttgaaaaattcctagtctgatcattgcaacattcctgtcatatctgactctggttctgatgctttttctgtctcctcaaactattttttgctttttagtgagctttgtaatttttttgttaaaaggtggacgagatgaactgagtaaaagtagctgtgataaataggcctttagtaatgtattggtaaggtgtaggggaggagaagtgttccatagcagggatccgcaacccctgggccacggaccggtacttctcatggcctgttagaaaccaggccacacagtaggaggtaagcgtcagacaatcaagtgaagctacatttgtatttacagccgctccttatcactcacattaccgcctgagctctgcctcctgtcagatcagctgcagcatttagattctcataggaccatgaaccctgttgtgaactgtgcatacaagggatctaggttgcacacttcttattagaatctaatgcctgatgatctgtcactgtctcccatgacccccagataggaccatctagttgcaggaaaacaagttcagggctcccactgattctatattatggtgagctgtataattatttcattatacatcacagtgtaataataatagaaacaaagtacacaataaatgtaatgtgcttgaattatcctgtaaaccccttgcctccccacttcctggtccatggaaaaattatctgccatgaaaacagtccctggtgccaaaaaggttggggaatgctgttctatagtcttgtgactaggtctcagtcttttgatgagcctttgtccctggactgtgaacttctccagtgcttctcagtatttcccccacaccatagctgggacaggatggttcttggctgctggaattgggtatttcttcccccaagtagagctggcattgatgaaatcccagcaagttagatgcaaacaaaatagtttctcccaaggacaggcttgttaagaacagaatgctccggcgcgtatcaaaacagttccttttccctcctcctgctggaatcatgagattttcttcagtaatcactgtgaggatccagtaaggctcctttggataaaacttacaaaaatttgggagcccccccatgactagatccccctggagtttttaactctcagcataatccacactgagcttccagcaattcctcagttacagttcaggtcttcctgccctggcactggttgctatggaggtttctgcttaagaatttctgctcctgccgggcacggtggctcacacttgtaatcccagcactttgggaggccaaggcaggcggatcacgaggtcaggagttcgagaccatcctggctaatatggtgaaaccctgtctctactaaaaatacaaaaaaaaaattagctgggtgtggtggcagctgcctgtagtcccagctactcaggaggctgaggcgggagaacggcttgaacccaggaggcagagcttgcagtgagcccagatcgcaccactgcactccagcctgggcaacagaggaagactctgtctcaaaaaaaaaaaaaaaaaaaaaagaatttctgctctggtaagttgtacctcactgtgtctgctgtctgtctgtccagttttgggggcagtggttcatcctgtgatgtcacttcgctgacagactaagaagtgtttttttttttttttttctcctccagtttgttcagctttttacttgttaaaacagagtggcaactcctaagctctttacatgccaggccagaactggaagtcagtttatttatttttataacttgtagagtatttcattgtataactgtaccacaatgtattcattttcttattggtgaatattgcatcagtctaggcccaatcaggagacagataacagacaagcgattttaaaaagttttaataaaagtaatacaaactatgacaataagagcctaacttccataggctaccatagagctgaaggagagttctcaaggaagaactaacttggaaggaggattctctaggctggattcaggacttgttgtagttgcagcccactggatgtagttgcagcccactggatggcagagatgttttctggtttgcccagaccaaagctggtccacagttactcagcaatcagggaatagccctctggagcacaggtgagtctcagccagtggtcaggcctagagagagaaagtagaggtgctgctgtgagcactttgtgtcctcaggaaggacgtgaaagacaaatcctgggggtcggggtgttgagcaagcaaacagagagagtcagtggggacaggcctggagcacacagtatctttgtaggtaaggctgtggaaaggtgtctgtgtgattggggcagagcaacccacatatccacgttcccacaccactgactgataatgcagttgctagaattagcaccaagagcctgttctttctgcagtgtgcctccaataccctctactgagaaagtttaacatcatgctcactgtagaggatagatgatgcttaaaggaattctcttctttatctcagagcaggtattgaaggattaatttgaagcttagtggcattaaattgataaccagcatagacatttagattgtttatacttttccactattatagtcatcaatgctacagaaacatccttcttcatattctttttgtatatatgtacacagactttttctggcatatatatggaggcatggaattgataagtcttggaataaactgtataaatttttaggagtaggatcaataggtcaggaggcatgcatattttaatgttgtttgttacatatcatctaattgattttacatgagtattctggaactaagagtgtgccttccataaaagcattcagtccctatcattcaaggtcaagctcaagccctagtgtcaagcaggaagatccagctgccaattccaggtgaggactcctgctgcatggaagatgactaagatcgtaataatgccagccgtcagtaggagtccacagacctcggcccactgcatcttctttgggtttgaagctgtcaaggaggactcaacattcagcacactggttggaacagcatttcactcacagaaaggacagatacaacaagatcagagtctgtgatgtgcaccagtggcaaagatcccattccatcctgtggtgggcagatacactggtggggctggccgtgtgccacatgccacacacacttaagcaatacaaagaagtttactccatacccagaagaggggaaaagtttctgytaataaggaagaagaatctgtggccaagtgacagcttgccacacagcttccttatgagggaaagttttagacccaggccactaattgggtagtcttggagaggggtggcaggtcatgtgacggctacatcccttacagccagtaatccatccctctttactccctgacacgtatagactcctcacctctatctgcattgaatctatttgggctaatttcattatcccttactcctgtttatgcccattgccacaggaaccctcaggttacccgcaccccatcatctacatgcttaattcatctaaacctctgaacattccctgctctgtcttatccctccctgactctggaaacccttccagtgtaccttttggaattccagttctttatcagcaagatctgtctcgtaatctgttctctaaacattctttcttcttcctgttctagtggaatcataggggaagagggagagcttagaacactgattatctgcagactactcaagtgttaacccttttctcataatctcaaagcattgggtctagtagtaagggtagatgtcctctgttttttcattattttcactgtcttctccctaatctccccaaacttagaatcttayatatcattaatttgtatcatttagtacctatcattgcagctgtaaaactcttcatacattgcaattgtaaaaattttagctcttgactmcaattactctcttcagttctactcctgtattattctttttttcagtctgtttgtgagctgtaatgtgttattcttggtggtttcgatacacccgtagttgataactccagttcttaagactttctgttctttgaactcctgtcttccagtgaacctctccactaccctacctcaatcacttatgccctagatctgtactttagaccttgtctccataatttcagtttccttcttcctgctctctgagcaccacctctaatctttctatagcttgtgtcatctagaaaccccacctttgaaaaacagtcatttgatcctgggacctttaatccttgggaaccttcgataactatattgagatgtcttccagacatctgtgtgaataattcagtatgtttgtcttgatttcaaggaaaaaatagggctagagatacaaatgttggactttcaccatataaaaagatcttaaatctgtgtgtctagatgtcatcacctagggagtgaacatagacagaaaggactaaaggtacaaggactgaaccctgggacattccagttttcagagaccaaaagaatgaggagagacccaaaaggaaagaggaaaacttagaatatatagtgtcctggaaaccacataaaaagagtatttcagaaatagcatgtgatcacctgagccaaatgatatagacagatcaagtgacatgaagtctgagtattgccagtgggatgtagcaatgtaatgtcagtgttgacattgattagctgttttgatggaatggtgggggcaaaacctaattggtgagtcaagaaagaaagggaaaaagaaaatggagataataactaaataatttgtcaaggagttttgctgttagagcagaaatgaaatgcaaagatgggtagagagatcaagagagttttcttatttgaaaaaagtaacagtgtctatgtacatacactgatggaagtgattcaacagcaagagaagatctgataatgcaagagaaaggagaatggctggcacagtgtccttctatagttgagaggggatgggatctagtaaataagcagtaggttagcctagctaggagcacaaacagtccttctctaggaataggggaggatgtggggaatacagtgcagattatggctgggtagatgtggtaaagatagcttattgaagttcttctctgattagttgaggccaggtgctgtggctcacgcctgtaatccccacacttcaggaggccaaggcgggagatcatgtcagcccagtagtttgagaccagcctaggcaacatggtgaaaccccatctctacaaatgatacaaaaattagctgggcatggtgttgcatacctgtagttccagctacttgggaggctgaggtgggaggatcatctgagtctgaggagttcgaggctgcagtgagctgtgattgcacggaactgtgattgtgattttgagacagagcaagaccctgtctcaaaaaaatatttttttctcactaaaatggaaagtgaggtgattagctgagcctgaagagagaggataaagtatgatacagtcttttaaaaggatgggagaaagartacactaagaagtatggtctgatttccagtagtatgaagagccaaagttagtgatcatacacataaagtgagactagtcagcttttctatatgactttctgaaacttctcaggctaggattttggaaagattgtgtgaagatactgaaattactcctgacagaaggcatgataaaaagaatgtgagtgatacaggaataaaatccttaaagagtgaaggggatttcccaaaggtttgtatgtgacttttagcaaggaggagtaatggttgttgtagtctgatgacatcatttcaaacctgggtgtttttatggagaacagagggagaatgcctgaagatgaaatgagccagcaggatgtctaccccacctctaggtctagtggtacaaagggcatgtgaaatccaacagccatcatttgagagagctgccaaggaagctgcatccacaggggacagtcaagttgcaacctgttcagggtatgttaagggctgtactaaatgtgtgtccagggtgcttgggagtacaaaagtaaagatttgtaacccaagctagtcattaagcaaggtgttctttttggaggtagctcattgaatgaggtagaaagctcattctaagatccgtatgaaatagaattatatgattaggaaattaacagtccacagcattatagttgcctggatacgatggctcactcctgtaattccaacactttgggaggccaaggtgggaggatcacttgaggtcaggagtttgagactagcctaggcaatatagtgagtccctgtctctacaaaaaaaaaaaaaaaaaaaaaaaaaagccaggtgtggtaatacacacttgtagtcccagctgctcagtaggctgaggtgggagggaggatcgcttgagtacaggaagtcacggctgcagtaagccgcggtcacgccactgcactgctctccagcctgtgaaacagagcaagactctgtctcaaaaaaaaaaaaaaaacacagaccataaaaaagtacagatcgtttgttactagattataaactgctaatcaaatatggatgggtaggcagaaagtcacggagggctatatgcagtgctaaagggatgaggtatgaggagtccatggcatggactcttttttacctaagatccatggaccctgagtggttttacaagtgccataaatcccctaaaattatattcccaattttgtatatatgttcattttcttgtggaggcaagatttgccaaaggtggttttttaatctaaaaactgaatactttttttttttttttgaaacagaatctctctctgttgcccaggctggagtgcagtggtgcaatttcggctcaccgcaacctccacctcctgggttcaagtgattcttgtgccttagcctcccaagtagctgggactgcaggtgtgcaccaccacacccagcaaatttttttttatttttagtagagacggggtatcaccatgttggccaggctgcttttgaactcctgacctcaggtgatccgcccacctcagcctcccaaattgctgggattacaggtgtgagccaccacacccggggaaaactaaatactctttaaggcttgaagaggcaaagtggtccgggcacagtgagtcacacttgtaatcccaacactttgggaggctgaggtgggcagatcacttgaggttaggaggtggagaccagcctggtcgacatgataaaaccccatctctattaaaaatacaaaaattatccaggcatagtggcacatgcctgtaatcccagctactcaggggccacaacatgtgagaagaatgcaaggaaaactctggaaacattaaaatcacattgttctagtggtgattacctgtggaaaaaagtaaaaaagcagctttaactttttattcaatttgctacggtttttggccataagaatttgtgaattgtacgataaaaatgttaaaataaaagttattaacagagggcagtgctggcagttggaagaccagttaagaggccattgccattatcaagatgttaggggaatgtttgaaataaagaaaatatatgactatgagaaaaatgtaagagattaaatcagtggcatgtggattgattgtcttcagattccctgagtgattaatgccatgtgttgatacccttaacttagataaggaatactaataggaagagaagagttagggggaggaagacgaacccaggatcaaatttacacgtattcagacacttgatttatgacaaaagtggcactatagagctgtaggcaaaatccattggatgtttgtatagagaaattggaaaacgtggctcttcacaagaaaatcaattccaggtgaattataattttaaatgtgaaaggtaatacagtaaaacttttagaaggtgtacagaagaaaatctgcatggccttaaaatagggaaattttttaaaaacaggatataaaggataagattcctaaatttgactacatttaaaatgaagaatttcaccgggcacgtggctcatgcctgtattcccagcactttgggaggccaaggcgggtggatcacctgaggtcaggagttcgagaccagcctggctgacatggtgaaacccggtctctactaaaaatacaaaaattagccaggcgtgctggcgggcgcctataatcccagctactcaggaggctgaggcaggagaatgggttgaacccgggaggtggaggttgcaatgagccgaggtggcgccattgcattccagcttgggcgacaagagggaaactctatctcaaacaaacaaacaaacaaacaaacaaaaaggccgggtgcagtggctcacgcctgtaatcccagcactttgggaggccgaggcgggcggatcacaaggtcaagagatcgagaccatcctggctaagacggtgaaaccccgtctctactaaaagtacaaaaaaattagccaagcatggtggcatgtgtctgtaatcccagctactcgggaggctgaggcaggagaatcgcttgaacccaggaggcggaggttgcagtgagtcaagatcgcgccactacactctagcctgagtgacagagcaagactcttgtctcaaaaaaaaaaaaaaaaagttctggttatcaaaagatactatgaaaagagtgaaacgagaagccacaaggtgcgagaagataatgtgacacataaaagtaacaaaggacttgggttcagaatatataaagaactcctggggccagcacaggtggctcctataatcctagcactgcgggagccttaggtgggcggatcacttgagccgaggagttcgagaccagcctgggcaacatagtgaaaccctatctcttatatttaaaaaacaaaaacaaaaaccacacaaaaaaacctgtamatcaataaaataaaaagatagtatgattgaaaaatggccaagggacttggacagttcacacaaaagagatccaagtggtcaataaatgcatgaaaagataatttactctcattagtaattatgaaaatgcaaaagaagctgggtgcggtggctcacgcctgtaatgccaaccttttgggagaccgaggtgggcagatcacttgaggccagaagttcaagaccagcctggccaacagggcaaaaccttgtccgtactaaaaatacaaaaaaattagctgggcatggtggcgcacacctgtaatcccagctactcaggaggccgaggcaaaagaattacttcaacctgggaggcagaggttgcagtgagcaaagatcacggcactgcactccagcctgggcaacagagcgagactctgtctcaaaaaagaaagaaagaaaatgcaaaataaaatcacaaaaagatattatatgaccaataatggcttaaagagtgacaaaaccaagtatagatgagtatgtgaaacagtaggaatccataagtgctgctggtgagtgtataaattaatacaactattttgcaaaacagcttggtgttttcttacgtaaagtacagaaacaagcaaactagaacacaaacggacacatattatataatctcatttctatgaaatgtccaggatacacaatttcatagaggcagaaagtagattagtagtagccaggggctcgtgtagatggaaatgaagagtgactgctaacactcgagtagagggaaatgaagagtgactgctaacaggtatagattcatttttgggcgataaaaatgttctggaattatataatggttatgattgcatagctttgtgaatatactaaaaacctctaaactgcacacttaagggtaaatgttacatgaaagttatatctcacttttaaaattgtatgagagaaaaactagagtgtttagagttgcatatttagttggtaaagctataaggaaatgattatcataatattgactttagatggggtaaagggaggggttttgatcaggagggattatktggagggattttggaagatggcattgttaaacctagatggtgtttacacaggtgcttgctatataattatattcctttataactagttaaactgtataaatgaagcagctgattcaaggtcaactgactgctcccagttttgtttataacttgtttctctgggatgaatcatcacttacctttgaactgtctcctccagctgctaaaatcgattcttaaagtggaaaaagcctgcttgctaggctgctagattttctgtcagattttttgtttgtttttttttttttggtcccattgagccagttattgccatccttaaggaaggattcttctcaataatgtcattttttctggagctagaaccgtgaatgtaagtcattaataacaatcagcttagctgggcacagtgactcacacctgtaatrtcaacacctggggaagccaaggtaggggaattgcttgagaccagcctggacaacatagtgagacccccatctcttccaaaaattaaaaaattatctggcttttccactttatgatggcttacacctgtagctcctgctcctcaggaggctgaggtgggaggatcatttaagcccaggagttttgaggctgcaatgagctatgcctgcaccactgcactcctgggtgacagaataagaccctacctgaaaccaaaacaaacaaaaaaaagtagctataaaaaagaatgaaatcactgatgcagctggaggctattgtcctaagttaattaaggcaggaacagaaaataaaatactgcatgttctcccttatatgtgggagctaaacagcgggttactcatggccataaagatggcaacaggccaggtgcaatggctcacgcctgtaatccagcactttgggaggccgaggcaggtggatcacttgaggtcaggagttcaagaccagcctcgccaacctggagaaaactcatctctactaaaaatacaaaaattagcctggtgtcatggcacacgcctgtaatcccagctactcaggaggctgaggcaggagagtcgcttgaacccaggagatggaggttgaaatcgccccactgcactccagcctgggcaacagagtgagactgtgtttccaaaaaaaaaaaaaaaaaaaaaaggcaacaaaagattggagactacttagagggggcaagagttgaaaaagtagctattgcgttctgtgctcactacatgattgatgagatcaatcgtaccccaaacctcagcatcacgcaatatacccaggtaataaacctgaaagtgtacccgctgaatctaaaataaaagttgaaattattttttatgtgaatttttaaagaatcagtttaaatattttcttcagaatgttttgttgtttttgcttttgtctttggagacaaggtcctgctttgtcacataggctgtagtgtagtggcatgatcacggctcattgcagcctcaacctgctgggctcaaacagtcctcccacctcagcctcccgattatctgtgactacatgtgcgcaccactatgcccaactaattttttaatttttttgtagagacaaagtctcactgtgttccccaggctggcctcaaactcctgagctgaagtgatcctcctgccttggcctcccaaagtgctagaattacaagtgtgagctaccatgctggcccagaatgttgttataacatcttaatcttccttcccccaaaataagaccagttcaaattgtaaccatccaatgggtcctccttgcccactgtccagatagagccaatttatcaaaacaggggaatttcaatagagaaagggtttaatatacgcagagctggccaaacaggagactggagttttattactgaaatcagcctcccccacatttctgaggctatggttttgttttgttttgttttgttttgagatggagtctcaaaaattgcactccagtgcccaggctggagtgcartgacgcgatctcggctcactacaacctctgcctcccatgttcaaatgattctcccacctcagcctcctgagtagctggaattacaggtgtgcatcaccacacctggctaatatttgtagttttagtagagatgggatttcaccatgttggcccgtctggtctcaaactcctgacctcaggtgatccacctgccttggcctctcaaagtgctgggattacaggtgtgagccactgtacctggctgaggctagggttttttaaggatagtttggtgggcagggggctagggaatgggggaatgttgagtagttgagtcagggatgatgttatctataggagaatctgtgaggttaggaatcttgtggcctctggctgaataactcctgagccataatttttaaccttgtggccaatttgtcagttttaccgaagtggtctggtccccaatccttcagagggtattttcccagcaggagctgttaccttctttgtttcaaagtaaactaaattcctaccaaagttagttttsgcctaagctcagaaatgtacaagggcagcttggaggttagaagcaagatggagttggttaggtcagatttctttcattgtcataatattcctagtcagatttttctcactgtcataattttggcaaaggcagtttcaaaattattgattttattctgtcaacaaactttaaaatggtggtaattttggcttttttttttttttgaaagagtcttgctctgttgcccaggctggagtgcagtggtatgatctcagctcaccgcaacctctacctccctggttcaagcaattcccctgcctcagcctcagcctcccgactagctgggattacaggtgcacaccaccacgcccagctaatttttttgtatttttagtagagacggagtttcaccatgtttgccagactggtcccaaactcctgacctcaggcaatctgcctgcctcggcctcccaaagtgctgggattagaggcgtgagccaccgcgcccggctgtaattttggccttttaagstaaatgtatattggagaaatagagaaaacccaataaaagtagcacacatttttaggccttagcatctgtggtagaataaagaatttctgtgatctttggtccagatgtaggcacagagcctctgaaaaccttggaatttcctgaaacataggattgtcttgttataccagtgaggtgactcgtagtgggcccctggatagtttcaggttggggactgatcacaagaaagacaaaccacattattagaaggttgagatagaggccgggagattgagttcagtcatttagccaatcatttaatcaatcatgactatgtaatgaaaattaaaactctggacaaccttaagctcagtagagcttcctggttggtgaacacaggagggtgacactcccggattccacaaggagagggcacaggatctctacttcccctcccacacctcaccctgcctttgtgtatcctttataataaaactgtaataataagtatagtgcttctctgaattctattagttgttctagtaaattattgaatgtgggagggctgtgagtactccctgaacttgcagctagtcagccagatatgctggtggtcttggcccctccccctgccatccccacaaagacttatgactggtgttggaagtgcggcagtcttgttgaggactttgctcttaaactgtggggtctatgctaactctatatggatggcatcagagtttaattgcagtatacccaacttgaggtagtgtcagaatagcatcttctgaaaagtctgcagagcctggccagttggaaagaatgcttgtttattatattgttgcttgcagttggtgggaattcatcattacttccccttgcattacagatgccttttgccaaagatttccatcacatatatagtggtctgttttttgctattaccctggcaacaactccataacttggaaaccatttcttttctccaacgttggccatatttggtaatgtagaatgttgaattgtgaatcagctctaaaaatcctaataaataaatgaaccttaaaaattgattacttaataagtacagtatttaccttatttatataagagcaaagacttatcatatgatgcctttcattctggtaggtgtcaccaagaattcaatataagactcagaaaaagtctttgacttagaaggtgttgtaaactaagcacattctgatttcattatcatggccttatggaagccctcatcacttttcatttggcttatcgaagataccccctaactccttttccctctctattctgtccattctaaattttagagtaagacacttttttttttttttttgtctgagacaagatcttactctgttacccaggctggagtgcagtgacatgatcgcagctcactgcagcctctaccttccagggctcaagcagtcctcccacctcagcctcccaaatagctgggactacaggtgtgcaccaccaccctcagctaattttttttagtttttgtagagatggagtctcactattttgcttaggctggtcttaaactcctgaactccagaagtcctcccacagtgttaggattacaggcccaattttcttttacaaaatatgttccaaatatgccaactttttctgtgctaacaagtgatttttagtagtatactccctaggagatttgggataaggggcacaaacactctttttagggcgaaggtgatattttatcattgagtgcaaaggtagctacactttaaaagaaatttgtgccatgaaaaaagcaatttgaagatggacgtttagaaatgttaccatctatatgtgattttggttgaaaaatgttatgcctcctccaaaagctggtaagtctatcatttgaaaacattggaaatagaatgtttctaatcttccaaaagaaaggttcaatttttgatctattgtttaaaaatataaaactataatacctcttcattaggttccaagaaaaattgctgacattacagaagataaaaatttatcatcccttggagggaattgaaaaacaagtatcatgatttaataaatacagccaacaatgsacttcttccattgggagctacatgtctttgtgaggtttattttattttatttaatttttaattttttttttttttgagacagagtctcattctttcaactaggctacagtgcagtgacacaatcgtggctcactgcagcgttgacctcctgggctcaagtgatcttccacctcagcctcccaactaagtacgaccacagatgcacaccaccacacccagctaataattttttaaatttttgtagagacagagtcccactgtgttgttgcccaggctggtcttgaactcttggcctcaagtgatcctcctgcctcatcctcccaaagtactgagattacaggcaagaaccaccacccctggcctattttttatctataataaaagcaagtcaaaatctaaattaaaaaaccaaaccacagaagggtttagacctaagatttttaaaaataagagccatctgatcaggcacagtggctcccacctataatcccaacactttgggaggccaacgcgggaggattgcttgagcccaggagttcaagactgcaatgagctgtgattgagccactgtactccagcctgggtggcagagcaagaccctgtctcagaaaaaaaatccataaaaatgagtaaatgagtacataaatatgagctatcttcaatcacattgcattctaaatgaaaaggtaaaaaattttgtaccatgaatatgtaaggtatttaatatatttgttttacttatttatatttatttttaaacaaatgttactgtgataaaattgatatacagtattcaaagtataaaattagataaatttctctttttttgagacggagtttcactcttgttgcccaggctgaagtgcagtggcgtgatctcagctcattgcaacctccacctcccgggttcaaatgattttcattcatttgaatgaaacctcaacctcaacctcctgagaagctgggattacaggctcctgccactacatcctgctaatttttgtgtgtgtgtgtgttttttttttttagtagagaccaggtttcaccatgttgggcaggctagtcttgaactcctgacctcaggtgatccatccgccttggcttcccaaagtgctgggattacaggcgtgagccaccgcacccagccagctttcgacctatgtatacacatctgtgcagccatcatcacgatcaaaattgtgaatacatctgtcatctcctaaagtttccctaggtccttttgtaattacttgcaggcaaccactgatgtgctttttgtcactcrtagattactttggattttgtagaattttatctaaatggagttatatagtatgtactgtgttttttgtctggcgtcttgtcctttgtatttccatatgaatttaaaaatcagattatcagacaggcagctggtatttttattgggattgtgctgaatctgtagatcagttaggagtgaattgacttcttaacaatatcaaatcttttaacccatgaacatgctttgtttctccacctatttagatcatctttaatttctctcaacatgttttctgaagttcttatgcctcttttgtcaaatttatcactaggtgttccatatttttatgcaattataagtggtattgttatttttcatttctatttacagtatgtataaatgtagttgattttgtatattgatcttttatcctgcagccttgctaactctcttattccagtagctttattgtagattctgttgtattttctggagatactcctgttgtccatgaagaaagacaacttgcctattccactgggctggaactcccagtataattttgaatagaaatggtaatcgtagatattcttgccttgttcctgatcttagagcattttgtctttactattaactgtggtgttagctctaagtttgtcatagataccctttatcaactgaagaatgtgtcctattcctagtttgctaaaagtttttatcaaaaattattattgaacttttgtcaaatgcattttctatgtctaatgagatgattatatgtttttttcttgattagcctactaatgtagtgacttatattgattgattttcagattttaagccaactagaattcctgagataaacgttacttggtcatgatgtatttgctcccacctcccattatttagagaatattcgtttatgccgggcacggtggctcatgcctgtaatcccagcactttgggaggccgaggcgggcggatcacgaggttaggagctgatcaagaccatcctagctaacacagtgaaaccccgtctctactaaaaatacaaaaaattatccaggtgtggtggcgggtgcctgtagtcccagctactcagaggctgaggcaggagaatggtgtgaacctgggaggcggagcttgcagtgagccgagattgcgccattgcactccagcctgggcgacacagagagactccgtctcaaaaaaaaaaaaaaaaaaaaagaatattcttttgtattagtctttttatatgttgttgtatttgatttgctgaaattttaatatgtatgcatctatattcataaggaatattagtctgtagttatcttataatatctttgtctggttttggtgtcagggtaatgctgacctcatagttatgaattgggaagtattccctcctcttcaattttctggaagtgtgtagaattgttactacttctgtcttatatgtttggcagaattgtccagtgaagcctctgaacctagaatttgwgggaaggttttaaattataaacttaattttgttaatagatataggattagttaggttatctgttactgagtgagctttggtagtgtatatctttcaaagaattttcagtctcctctaagttgtcaaattaattaacataaagttgtttacaataattgacaaagttgttctgataactgtagaatccatagaaatgtgacctttctcattcttgatgttggtaatttctattttgtctttttttttcctgattagtctatcattttaattttattgatctcaaaaacctgtgtatgttctttgttgggttttttggtttgttttttgagacagggtctgtcacccaggctggagtagggtggcacaaatatgactcactgaagcttcaacctcctgggctcaagcagtcttcccacttcagcctctcaagtagccaggaccacaggcacaccgccatacccagctaatttttaaattctttgtagagatggggtctcatcgtgttgcccaggctggtcttgaacctctggattcgagcaatcctcttgccttggcttcccaaagtgctggaattacaaacgttagccactatgcctggcgttgtgtatggttttatacattttctctcttgttttccagtggtttttttattaattgatttctactttggtctttatgattacctttcttctgggtttcatttgctcctcttttttaaatttcttaaggtagaaagtgagagcatttcttgtttttttttttttgattttttttttttttttttttttttggtttggtgttttttgttagagaccaagtctcactatgttgccccaactgatcttgaacttttgggttcaggtggtcctcccaccttggtctctcaaagtgctgggagttagtctttcctttctaatatagtgtagtgatataatttcctttctaatataatgtagtgatataattttccccctaagaactgctttagtggtatgacatgtgttttcatttttattaaaaagacatagtcttgctctgttgcccaggctgtagtgcagtagcctgatcatagcttactgcagcctcgacttcctgggcttaagcgatcctcctgcctcatcctcctaagtagctgggaccacagttgcctgccaccacacccagctaatttattttattttttgtagagacgtggtctggctatgttgcccaggatggtcttgaattcctagcctcaagggattcccacaccttggcgtcccaaagtgctaggattacaggcatgagccagcacacccagcctctaatttcccttttgatttcttctttgacccacaaattattcagaagtatattgtttagtttatgaatattkggggattttccagagatgtttctgttactgatttctaattctatttcattgtagtcagaaaacatattttatatgacttgaatccttttaaaatttattgagttttgttttatgactcagagtgtgatctttcttagcaaatgttcagtgttcacctgaaaagaatgtatattagtactgtttggtagtggtctgtaagtgtcaattatgtcaagtttgttggtagtgttgttcaagtgttctacatcctcactgatcttcccatttatttattcaatcatttatatcagtatgaactaataggtatttattatctagatcagactgtaatccattaatactttagtttttttgcttaagttgttccgttttggccatcaaggtcctttcagttggctcctttccccccttgacttacatcaatttggtggtttttgtttggttggttttggttttggtttgttgttgttttatccctttccttactatctgcgattataagatattccaggctcatgttgtatatttctgaccccagtcctagaatcagccgtttctccaagaggtctggatttttaaattggagaacagtattacaaatcaagatctgggttctaggaatgcttgtttctactggggtgtcctttttctagtccctcttagctgattgaccaaagacatatagtattagtatgtatactaacctgtgaatatacacatatctataaatattttatatgtaattgtctgtatttatattaaacatgaattcttcttgatgtctctggctccaattcaatatcacatggatcattctagcttcttcttccctttgctgatctgtaaatttccactccaacaatgagaaacctgggtcccatcatccaccatccatacacataaactactcagttccagtgtacgtgtatagcagtatcaaaattattaacccatactccttgagaaacaactttatcaagttgagttcagtacttacctgtagttcctttgatctttagtctaactgatttcattcatttccaaagtttcttacgtcagcacttttcccttcaccctcttcagtgatgttgtttcatacatttgtaatacagttagattctcttgtcatagtctgcattcttctctgggatcctctgatctcataagttatttttttttaatttgcctttagaggtgacaaaccaaggcttaaatttttttttcccttacattactctctaggttataaagttctgtatgttttgacaaatgcgtaatgtcacgtatctgccactacagtatcatacagagtagatttatttccctaaaatagtgcacagtacttcacctatttgtccctcatcatcttcccgctggcaccattgattgttttactgtctccatagttatacctaccttttccaaaatgtcacaaggtcagaatcttatgacatatagcctttcaaattagtttctttcacttagcaatatgccttcaaggttcctgtcttttcataggtggatagcttgtttatttttatcactaaataatattccattgtatggatgtgccacagtatgtttatccatcatctattgaaggacatcttggttgcttccagttttgggcgatcacgaataaacttgctatacacattcatgttcaggtttttgtgtagacaagttttcaacccaagtaagtaattatttagagcaattgctggattgtgtgggaagactgtgtttagctttttagaaactgccaaactgtcttccaaagtggctgtaccattttgcattcctactaacaataacaagagttcctgttgttccccatcctttttagccattctaataggtatgtatgagtatccaattgtagttttaatttgcaatgtcctatgccaaatgatgttgagaatctttttatatacttgtttgctatctgtatatctttggtgaggtggctgttcagatcttttgctcatttttaaaattgggttgtttgttttcttgttgagatttaagagttctttacacatttgtcttttatcaagtatgtgggtttttggttttgttttgttttgggggttgggggttgggacttgacttttcttgtttgtttttgagacaaggtcttgctctgtcacccaggctggagttcagtggtgcagtcacagcccactacagcccaagctcaaatgatcctcccacctcagcctcctaagtagctgagaccaggtgcgttaggctgccacacacaactaatttttaaattttttgtagagacaagatctccctgtattgtccagactgatcttgaactcctgggctcaagcagtcctccatcttcagcctcccaaagtgctgggattacaggcatgagccaccatgcccagccaagtatgtgttttttacagatatttcctcctagtctatggtctgtctttttcattctcttaacagtatcttttgcagaagttcttaattttaatgcagtctagcttattaatgttttttttcatggttttgcttttggtttcatatcctaaaaattcatcgccaaacccaaggtcacctagattttgtcctatgttatcatatacaagttttatcrttttttgtttttacatttaggtaaatcttacattcggatcattttcatgacccattttgagttaatttttgtaaaaggttgtatctagattcatttttttgcatatgaacattcagttgttccagcaccattcgtcaatgagaatatatattttcttcattgaattgccagtgctcctttgtcatatatcagttgactatatttgtatgggtctgtttgtggagtctctgctttgttctgctgatttatgtatctgttcttccaccatgttgtcttgatcactatagctttatagtgagtcttgaggtcaggtaatatcagtcctctaaccttattcttcttcagtattgtattggttgtttaggttattttgcctttccatgtaaactttagaatcaatttgtcaatattcacaaactaacttgcttggattttgattgggattgcatttaatccgtagatcaaattgcttataattaacattttagtcatattgagtcttccattatgatcatgcaagtctcatttatttagatctttgatttctttcatcagagtttcgtaatttacagtgtatagattttcagtgtatttgttaaatttatatgtaggcatttcagtttttctgttaatggtattgtgtttttaatttcaaattctgattattcatttctggtataaagggacacaattgactttttaatattagcattgtatcctgcaaccttgttgtaattgcttattagttacaggattgttgtttgttgattctttagaatattctacatagacaatcatgtcatctctaaacataaacacctttatttcctccttcccaatgtatttaccttttatttccttttcttgcctttttggttttgttttgctttttaatttatgtattttttttagaaatggggtctcactrtgttgcccaggctggtcttgaactcctgggctcaagtaatccccccaactcagcctccgaaagtgccaggattacaagtatgagccactgcacccagtcgtcttttcttgccttattgcactggctaagacttccagtatgatactgaataggagtagtgagaggccatccttgccttgttcctgttcttggagaaaaaatacccggattctccccatgaagtattatgttaacaacaagtatgtcttctgtagatgttcttggtcaagtgaggaagttctcctgtattcctagtttgctgagtttttatcaaaaaagttttaaatgggttttagatttagtcaagtgctttttctgtatcagttgatgtgaccatatgatttttcttctttagtatgttgatgtggtaggtaattgattttcaaatgttgagccatccttgcatacttggagtaaattctatttggtgatggtatataacttttttatacattgttggatttgatatttctaatattgagaatttttgcatctgttttcataagaggtatkggtctgtagtgtttttttcttacaatatctttatttggtttgggtaatagagtaatactggccccatggaatgagttaggaatcatgttacaatcatctttgcttggaagagattgtagagaattggtatcatttcttctataartgtttggtagaattaatcagtgaaacatctgaaacaggtgctttttttggagatgattagctattgactcagtttctttaatggagtctttctttttttaaaattcaatctaacaagctctaccttttaattggggcatttaatgtggttgttgatgtggtttgtttatgtctaccacctccctatttgtttcctaattattccacctgtttttttctccttccgtgatcttttgctgctttatttggggttaagtgtgtatttttattccatttatgtcctttattggcttataggctataaccctttattgtttagtgtttgccttagcatttatagtgtatatctttaacatatccctcatatcaatcttcaaataatattataccacttcacatacaggataagaatcttccatttctccccttccagcctttatatagttgttttcaaacttttgatcctcatgtgttgtaaatcccacmctattatttaatagtaataatattattattaattaaacatttactgctttttaaagagatttaaataataagaaaatgtcatgcatctttttccatgtagttaagtttcccattgctcttcattcttttgtgcagatccatatttccacctggcatcctttgcttctgcctaaaggacatttttaaaacatttttttgtagtgtggtttgctgttgagaattttatttagtttttttgtttgaaaaagtatttattttttacctctgtcttttaaaaatatttttgctgaggccgggagcagtggcttttgcctataatcccagcactttgggaggctgaggcagtaggattacttgaggtcaggagttcgagaccagcctggccaacatggtaaaataccgtctccattaaaaatagaaaaattagccaggcatggtggcgcgtgcctgtaatcccagttacttgggaggctaaggcaggagaatcttttgaacccaggaggcagagcttgcagtgagccaaggttgcgccattgcactcctgcctgagcaacaaaatgagactccatctcaaaaaaaaatttttttttgctggtacaatgacttctgacactaactatcccaaattaggccaaactttacaagggcccaggctgctacaaaactgccctcactttatacaccaagcagaagtttgggggttcccaggtcacccatacttctgacaaaatggatacaaatttgaggtttcttactacctcctgagttcagtaattcactagaatgattcacagagctcagaaaacccctatacttaggtttacaattttattgtggcaaaaaacataaaaatcaggtccggccaaagaaaacatgtgtaggacaaggtctgggagggtcccaacacaaagcttccagtgccttctccctgtgaagtcaggatgcatcaccctcctagcacatggatgtataacaatacatacaaattattattaagcagggaagctcacaggagctttgtgtccagagtgaggttttattttataagcatgattgattgactcattggccatatgactgaacttaatctctagcccctctccatttctgggaagtcaggtttatgtcagactgatagcaagtggctcaaagccctaaccctctttttttttttttttttttttttttgagaaggagtttcactctgctgcccagccaggctggagtgcagtggcatgatctcggctcactgcaacctccgcctcctaggttctaagcaattctcctggctcatcctcccaagtagctgggattacaggcatgtgccagcacagccggttaatttttgtatttttagtagagacgggattttgccacgttggccaggctggccttgaacccctaacctcaggcgatctgcctgcctcggcctcccaaagtgctaggtgagtgctagcactccctggtgctaggtgagcctcaaagccccaaccctccaattacatggttggtctttcaggtgtggccagtccccatcctgagttatatcattagcgtaaagtatcaggccctgtcataaataacaaaagcactcctatcacttgggaaattccaaggatttacaggctccttcccaggaactgggtactaaggccagtcaaattctttactacacaacagctgggtctagaattctaggttggcaggagaatagccatatcttccataattttttttttttttttgagacagagtctcgctttgtcacccaggctggagtacagtggcactgtctcggctcactgcaagctccacctcctgggttcacgccattctcctgcctcagccttccgaatatctgggactacaggcgcccgccaccaygcccggctaatttttttgtattttttagtagagacagggtttcattgtgttaaccaggatggtctcgatctcctggcctcgtgatccgcccacctcagcctcccaaagtgctgggattacaggcgtgagccaccacgcctggcccatatcttccataatttaaatatattgctctgctgtcttcttgcattgtttccaacgagaaatctgctataatccttgtctttgttcctctgtataacatatcttcttctcactttactgagctccaccaagctctagccactctaaagatttttctctgtatcttgagttttgagcgatttgactgggtattctttgatgtacttctcttcttctttctcatgtttgggattcttagagattcttagatttgtgatgttacaagaaaaacttgggactgcaacgtcccatctaaactgggaaggagccatgagaccaaagaatgactcagacaaatttaacttgatgagtagacgagtttattcaacttacatacaaggcactcctggacggcagcaggacagctctagagatccacgctgcctcctgtctctaaaccgcattttttgtttgtttgtttttagacatggggtgttttgccatgttgcttaggctggtctcagactcctggactcaagtgatcgccctcctcagcctcccaaactggcatgacaggcrtgagccactgtacccggctccctctaaactgcttttaagctaattttcwggatctttgcctactgtgtttgaacaatgatactgtttttcttgagagattctcagatactctctgggatgtttggttggttctcagggatacctgctcctcagctgggtaccattgccatgggcctagccttcaggtttcaggcagtgaacatatgtacctttaagtratctggtaaaggacccatcacacaacatgtgggtatatggtttttatcaaatttgcaaaatggtccgccattatttcttcctatcttttttctgtatcccctgctctcccctccccctgcttgaagttgtcctacagctcagtggtgctgtttatttagtttttttgctgcttttttttcccctctcggtgttagctatttctgacatacgtgtgtgttatgtaaccctagctgtactatgcgcacctggaagattctttgtacctctgtaaccagaccgatccttggaaggctggtcattgtaggatgctcatgtccaggcatctccttgaggctttagctgggtagttttgggaaccaacaaagggcatctgactttgcatgtcaagaatcaaactgtgggtatttgttaatctttgacatgagatgacactatcaaaaaagaacagaattttttttaaaaaaataagcyttgatacttctgaggaggcctgatccttattaagtcctggctaaggaaacagctactcaggatcacktcccttatatcctggtgcccactagccagaagatggggagaggtcataacagatatccctgacacagagcatggaaaacccagagttcatgcaatgttgagagcagatccactggatgaagttgtatattttatgcacctgggggtgagaagaactgaaaatgcctcttattatttcaaccaaaaacaatgccattatataattgatacagaggtgctgctgcatagggtagtaggagcactgattgagaggctggtttctactagatcagtataaaaagacgttaagtgctatataagccctattggatagagatagtgggaaacaaaggggtaggtttttggcaacttggaacatccatacactgtgcaggaaacatactatccaagagaaagccagcgcatgttgaagtaccaggcccctgggaggtaagcacagaagtgaggaggtggacaggggttagaggggagccagcacagcatggagtatggtgcttacttcaacatggccttttgagtagagtcatattaacaactgccaactaggggctcctacgtaccagtccccagctggaagatagcccagagaagtatggcaggcttaggtttaagaaccattgggattaatgcaaaggtaaacttacagttttgttcaaagcttctgagctttaagttagcaagttacagggaacacgtgaatactaattaagaaatggcggtatgctttgtagacttgggggccttgattacgaactrtcttaaggtttactactatcctgagtccctacctgagaacttctctttccccttaaaacacacatgttcctggtttagcccttggatacagtgcgcagagatatatatgcaagaaacttttggattagggktcctgttgccctttgagaaagtgtgaacatttggctataccctctgactgaatgagctctttaagccttctgaatgttggttcacttgacaaagacagattgaagtctcaggtgtgttcctaggagggcaggaaatagtcaagttgctgctagatctagaatggttatctgagagacatgggttgttacagcaaacttgggaacaagggagaaaacctctgggctatgaaacttttacagaaagagactcattaaactgatagtggccctgagaaaataaccatataattgccagtgctaggggaatatttcttgcccgaaagtcatgtccaccctcctcacaagcaaacctcacagagttttgtttcttttcccatccacaggtaacagtcctttggacagcccccggaatttctctccaaatgcacctgctcacttttcttttgttcctgcccgtaggtaagttgataggaaacctcctctgggaccagcacatgtggcacttgcatgagggttaattgaatgtcagattcctcctttaagtgtcactactctttcaagtgtattacctgaagctcccatccatcaaaactctgtctttgctttcctctcctaggttgtaatgatcgtgttctggttttgctttataggtgccccatgtatttgtgtttgaatgtttaaacaggagagtagatattaagtaaaagtagatttatttgtataattcacttttttttttaagtccctgatgtcctacgggtatgttccaaagcattatactctcaatttagaactgtcctacagtgatgaatgagaaaataagctctcctccaggaggacccaaagttatactctttgtcctctctaactcagctagtttaaagcagctgaaagggctctttgtgcctctctccttgactttgagctggagttcgtttgggggataaagasactacagggacttcacttttccttctatgaatttagaaagatttggtgcatacagagccatgcttacagtcctcctcccatgtttcttccctcttgagagtgataacaaacctgtctctggcccatggcagcaacgctgacagctctgcctgtggctggaatatcatcaggcctttagagaaagctgaatgagattaatccatccaaatcacatacctaggctctatacacacatgatttcttgtcagaacttttctaagattctttgccagagtttatatttattttattttattttttaatttttaaaattgttcttggttagagttagtccctggtataagacctccaggaaaattatggttccagatttgtaacctttaatggatggagaatgtaatatagctggagaccaggacagttttaatacttagactactttttttttttttttgagacggagtctcactctgtcacccaggctggagtgctgtggcatgatctcggctcactgcaaactccgcctcccgggttcacgccattctcctgcctcagcctcccgagtagctgggactacaggcgcccgccatcattccgagctaatttctttttttgtatttttgatagagacggggttccaccgtgttagccaggatggtcttgatctcctgacctcgtgatccacccgcctcggcctcccaaagtgctgggattacaggcatgagccaccgtgcccggcctacttagactactttttaaaaaaagacatattaggaaaaagagaggctcctggaaatggtgttaactcactattccaatgataacccaaaataaatccatcctctttccaggattctttgcagctgaaaagaacatgaacaggttgggataagtttgatagctgacgtgggtttcctccttcaacccacttaccttattcaaaacaaattttatccaggtttgttccacgggctcatctctcctaccctatggaacttccaatttgttaagcaaggatccagataagatcacttacagtataagaatatgctggtttgatgcatttgtttgtccaacccagctggaaagacttatcccagacttcttgcctggactatatataaactgtactctcagagtaggtacgagctgggacaccaagacctgtggctagatccccataggtggcattgagttatttctcattcatttgataaatatttgctgagcaccaccaactagagtcaggcgcactcggctgggtgcttagttatgtagtggtaacaaaatagacatagtccctacttccctgaaactcaggatgtaggagagtctgtgtactggttgtttcctctgtaaggaatgctgttccctcagatcttcatttagctaactcattgttatgattcatatctcatcttaaatgtcacctcctcagagaggccttccctaaacattcaatctaaaggggccttcttgtctttctccatcaaatcatccaattttattttcaaactagtacttttcaattcctgatattatcttatttgcatattttctgtctcaattcaaccacagtcaagtcacctttaatagagataccttcatttgttgaaagctgtgtcctggcgggaagacaaatgagtagtgggagagaaagacaaacaaatatatgtttataaattatgacaagcaccayagagggaaagagcatgatgctgcatgaaagaacaggaagagggccgggcacagtggctcacgcctgtaatcccagcactttgggaggccgaagcaggcatatcacttgaagtcgggagattgagaccagcctggccaacatggtgaaacaccatctctactaaaaatacaaaaattagccrggcatggtggtgcaggtctgtaatcctagctgctcgggaggctgaggcaggagaatcacttgaatccgggaggcagaggttgcagtgagccgagatcgtgccactgcactccagcctgggcgacagagcaagactccatctgaaacaaaacaaaacaaaaaaagaacaggaagagactaaagccagagaacctccactgggtggctatgtaaagcctctctgaaggatgagaagcagctgccatgttaggtgcgaggacccaggtgtgtgtagaccattccaggcagagggaacagcctgttccattgataccatgggtctgtttcattgcctgggtttaggagtaggaccaactaggaggcttcagggcctggttttttaccactgagacccaaacaggtctatgctaagtggcatgacatttgagtcatgtgcatggaacatggatctctgggctgtcctcttatacaacatagtaagaaaagctgctggttattggtgggatggggagaagtgtttcaaccctgccaaacagagtatcaggaatygtttgtttctgtgttactggctggcgctttggaggatcacattggtttgcaatgtcaaacaaaagacagattgaattgaacactaaggatagacccattggtcctacaatttcacttcaaactatcacacattcctaaacagaaggaatgtgccaagctagaccaaataccaagattcaaaaagatcactctctctggttcctttggttctcactataatgtgtatttttttactacagccatagccacagagctgacaggtaatagcgggtataatggggagaggggctgggaaactgctatgcatggccagacaatatggtttgtgaygttgtggttggtgaaaactggttgtgatgattcttctctgactgtgggtatgaacattgggcctttcatgtcttgcaaagaggcccaaagggatctccctctacctgctggaaccaaggctcagagctcatatgcttggaggcaggaattgctgaatagttccaaacttctgagcttagggacaagtcacccttattcccacagctttgcacagtcagatgactgcagtgaccagatagaggaaatagaggcatcatgtggtggcatttcttcctgactctggtggcccctgctgttcattatacagagaaattgctgccatgcagctagttttcatttctatctaaggggaggaaaactcacatgtacaaaagtgtatttgacaagggtttgggaaatccatccctgagttatacttgtctcatctttgctgagctatttcctggaaccgacttgttttattgtgtggtgctcccaggacccagcaaagaggtcaaagagaacatcatgtctgagcaccttcctggacatgtctgaacctcagagactaggttccagcagagttatagcctatatgtgctgctgccagggtggcatgaagtttgagtcatgtgcatgtggcatggaacctgcggctcaccccttacagaacagagtagaaaagctgctaggtattggtgagggtggggaggagtgcttcgaagggagaagccccagcaagatttattcctttttgcttcttcttctccctgtccctgccataaccatgaagccttgaacaaaccacccaaatctcaggatcttagtgttttctctgtaaattgtaatatgaacttataaagatcctccattgctgatagtctcaggttctgtgagtaacagcaaaaaaactttgtatctaacttcaaccagagcaggctgtacccttaagctctacaaaaaagaatacaccacatcccacagtccaggcaaagaatcacacgttcatattataaaagtttcaaactagatccctgcttgatctttcccctctacagtaaagcaaataactgtggcggggtgggggggcatgttttgtttgtttgttttgatgagagctgtggggagcatccttttgagagcagcaggaagcctcccccaaagtctcatatacagctaagggtatgtcacctcccttctctttcataaagttactgtcactcttcgacagacattcccaaatattggttttatgagtcctaacggctcctaggcagcctataactgtttcccattgattagctcagttcagacccagatggtggcccacttcttcctgttgtcagccagtggcctggggaagaccaaagagcccttaacacggagccttcacaaatggaaatagctgcatttcagtggcagttctatcttgtaatgttgcctatagctggaatcctctgtcattgtttctatgaaagtaagttgagagtatgaaaatatatattccaaaaccacagtattatatgacagatgttcttctgttatacaaagttatggactattttatagtcagagatgtctgtctttgcagggaaaacaacaataagccctctgtaggggagagatataaaagcatgtactggactgagcagtaatgtcttaaggaggagccctacagtgaatcaactgcccccaaaatgctgatgaacagacaggcaggttgtgggtcagggtgtagtcctgcagaaactgcctaatactttttcttgcatacaggactgatgggcggcgctggtctttggcctctttgccctcttcaggatatggaactaacactcctagctccactgtctcagtaagtagccaaatctgtggccatacttccttcaccctaaggaagtacttccctttgggttatctagtgtcacaaaatggttctcaactttttctccaaagtcaaactcagagaggttgctgagagatgatgttgggtgcaacagagggctggggtcccttcccaaccatagccagctccataagtgccttcggaaaggatgaccagtgccctctctgggaatcagttacttctagtggaggcagaggagagcttgaggatgaacttttgctttgacagtgagaccagatatggggactcctaagcacacttcccctactcctccatccttatttctagaactggaaccaagagcagatcacctttctcatatctgaagcacttggtagactctcccctctttttcacctttttctttcaaaaaagaagggaagagtgattgttatttgatatccaagtttgatgcatatgaagcaaaaagctggacctgtctctaaaacgtttatttcttttggagaatgttttagcctaaaacacaagagctgtactaattgctgctatgcacaattgacccttaagccctcattgagcaacttttttttttttgaaagagtgtcactgtcacccaggctggagtgcagtggcgcaatcacggctcgctgcagcttcaacctccccaggctcagatgatcctcccacctcattctcctaagtagactgggactgcaggggcatgccaccaccctgtagcaggctaattttttgtagagagggggtttcatcatgtttcccaggctggtcccaaatttctgggctcaagcgatccatctgccttggcttcccaaagtgctaggattacaggcgtgaactgccacacccagccgagcaactttttattaaaaccacagtgacaaggttggccaactttttctgtaaagagcccaacgtggagtaaatgttttagtctttgaaggccatacagaagcaggccgtagacctgctgaccccatccccattacttgcagcattcttcaggtcttccctgctcagtgtgcctttattcctgaatctcgagcagggaaaaggagtacatttcctctcccaacctagatactactgtcacattaatccaaagatgtcattggtctttggcaactgttaagtttaagatctttctctaataaacattccccttcccgggccaggcrcagtggctcacacctgtaatcctggcactttgggaggctgaggcaggctgatcgcaaggtcaggagatcgagaccatcgtggctaacatggtgaaaccccgtctccactaaaaatacaaaaaattagctgggcgtggtggtgggcgcctgtagtcccagcgtctcaggaggctgaggcaggagaatcgcttgaacccaggaggcggagattgccatgagccgagatcacaccactgcactccagcctgggtgacagagcaagactatctcaaaaaaaaaaaaaaaaaaatcccctttcccataactcttcactcaaacaagtgatttttttagaaccaaggtaagtctcatctgcaaattttaagacttaactcattgctccagcttattaggattctttaaaataccagttttgcccactgtagtttacattgcctcactagtttcatgttagctatagctggtaagaatattttttgcaactttgatccaaatcatttattaaaatggggccaagaaataaccctgtggagacatctcactcgctgtttataacttcatgtattatagcattctatgagagaaaatgtgcactgttagcaaaaaagaaatgctgatttctcacttgtttattgagcctgtgacaacagagttatctcagtgtggtgctttagctttgattcttaaatggatttagatatttaaaccttggctctgggagcagtagctcaggcctataatctcagcactttgagaggtcaaagcaggagttccaaaagaccagcctggacaacacagcaagaccctgtcacttaaaaaaaaaatagctggacatggtggcatgcacctgcagtttcagctgcttgggaggctgaggcatgaggatcacttgagcccagaagtttgaggcagcagtgagctatgataaygccactgcactccagccaggacaacagaacagaatcctgtctctaaaaaaacaaacaggctgggcgcggtggctcacgcctgtaatcccagcactttgggaggccaaggcgggcagatcacctgaggtcgggagttccagaccagcctgaccaacgtggaaaaaycccatctttattaaaaayacaaaattacccgggcatggtggcacatgcctgtaatctcaactactcaggaggctgaggcaggagagtcacttgaacctgggaggcggaggttgcagtgagccaagatcgtgccattgcactccagcctgggcaacaagagcgaaactctgtctcaaaaaaaaaaaaaaaaccccagatcattgattagtttggtaaatagaacttgggctggccctgacttgcctgttctctttgtcagtcttgtcaggtaatggaggggggagttccctgatcctgggactgaatgggtgcttcagcattagctgcgcctgtagaagtcctgtgatagccgagcaccctccctcagatggcctgttgagattggcagtgctgttgtgaggaatcctcagtcactgagccatgtttagaattcatgagtgttttcaggtcaagcctaatcttcaggtccagatgtaaaagtaattttcttccctgctggattttcttgcctgctggacatcaggccatagttggtctgcaggctgtagtttgctaacccctggcacaatacattggccagcttgagtgagtctgggcacagcyttcacagccccagcaaaggcacttctcctccagatagcagccaaaaggaaayattgctgagctgcccccagggtggctctctcaagattgtggaagggcgaacttaagaggatgttatttgcagctgggtacacctaaaacatgtcccaagtgaggaagcatgatttattaactacttttgcagctctaaaattccatgaaggtctgggcccaactccctgcacaacccttgaaggactccagtatattgaattcctcagggctgagggctctgaagggctggagaaaaacaggatcaagcacaggcaaggctaagggagtaggggaaagaagacctgctttgggtttatagtgactgggaagttccctgaccattttcagtccttccccattcttggactgctctgggacatgtctttaatgccacttcttaatgttttcccctctagtcatcatgctcctcacaggaaaagctgcatcagttgcctttccagcctacagctgatgagctgcactttttgacgaagcatttcagcacagagagcgtaccagatgaggaaggacggcagtccccagccatgcggcctcgctcccggagcctcaggtgagggtgctctctgcccactgttccagtgcatgtggatttcagcttgtttgcataacacagaggtgggcacactrtgctataargggccaagatagtaaatatttttaggctttataggccatatatctctgtcacattcctcaactctgctgttgtagtatgaaagtatccacaaataatatataaactttatttacaaaagaaaaaaaaaaagtagcaggccatagttagtctgcaggctgtaatttgctaacccctggcataatacattggccagcttgagtgagtcaagttcaacaaagcccaagctatttttggcttcaggtacagctcaacccatcaccccaggagatatttaacaatactgtcaagtggtccctctctttttctgtttaaaggtagttagcagcagaaatatactttagattacatctggtaaaaggagaacaatggtatcatcaattctgatggttatctggctccagaacccattggccctgggtgtatgatctaggccagctaaaaaagttgctgctgaagacaggttgctggcgtggggaagaagcccatttcaaaagcagaattaaatgtccatttgaatatgtctttattctgtgaatcacctgggcacatcttcatcaaaccaaactaaccttaacagctgctgattaattttcgattctctttgtcattagctggtaaatcagtgccagaattttaggttaaggaaggtgatggagattaaaatgaacatgactttaatgactgagctcagttttgcagggtccctaagaagtaattaattggctaagatgtgcagggtaggatcccagaggagcagcagttcctcccagaaagaatcccctcaggtaatgctggcactgcaccaggagtgacagggagtaagctgggccagaccacaatgactggttcaggtgtagagattgatgaagatggtatctgaggctccagtgcctttctctgtgtcacagaggaacacctgagtcttggtgttctcaacaacccatacacagagaagggtaccttttaggccagttgagattgagaggcccacagtgatgctcagagaaatccatgctatattactcttaaatccttggtaatgtgcagcagtacagcaggcaaaacatggcacattccagggaagaaagacagagtgggacagttgtgaacctagaacatctgggatcatgtgtcaggggcagtaaactgggcaagacccacatacccattcaactgtgtggctccaactttgaaatttttttaaggagatacaatgacacatgagccagagggggagatttaggttatcagggaagacaataaattaaggcagaaaacatatcggctgccttcagtaaatcacccagatgtataactcacaacagtctggactggcctcattcatccccaagttaggtccatggctgcagctagtttggaaaaaaaatgtacgtgtgcaccgtcttcctttggttgctttggtagtttttttatttgttttgttcccaagaatatgctggggcacacccaaccctattgaccaaaactaagaagacacagagaatcctactccaggggagkttatcctgggaaagccaccagtgagcttaggagtaggtccctttctaggtctttctagcctagaagaggtctttgtgaaaaccaagcctagctccatatagtaccattttgaactgaacaaggtacrctggaaactccaggaataagaaaggctctagaactcagtacccgttaaagtgggagtatgtagctgctgaagatggtgggaggggcagggtctctggggwtggccatctttcttcttgatagttccatagcactaaagtaacacaatcatttctttcttttttagtcccggacgatccccagtatcctttgacagtgaaataataatgatgaatcatgtttacaaagaaagattcccaaaggtaaggatccatttaaaaggagagtggcaatacccctccgggtggctgcctacagccagccccaatgggagactctggagtgaaggaatgaagtgctacctccagagataaccaagaagaagaacagaaagtcagccaggaggctgtggacacagcaacaagggcttccagactgcttgagaaggagacagcaggaagctatgagtttgggaactgtatttgcagagcctttgtttcttcactacccagaagtagagttatccagaggggaatgtcagaaaggtagcccaccatatattaaagaggaaagaaagaactggaggctttacttctcactgtgcacatgaggatccatgagtcagggttcactcattacaggatttgccctctggtggcatattcatttgatagagatttcttaagcagcacctcattatcaggtgtcagagagtacacagacagaagtaggctgcactggcaagaaggccagagagagcagtaggagtgggagacagatctcagagttgcttgctaacatctgaattttcattttcaagcaggaaaatgctgaggaaggaaagtaggttgttatcctgagatagctgagaagtagcattcgtaactctgctgcttggctgtgaacctccttgtatatggaactaggatcttgtttcycatttgcatgtctctttttttgttaagagatggagtcttgctctgtcacccaggctggagtgcaatggcaccatctcggctcactgcaccctctgcctccggggttcagacaattctcctgcctcagcctcccgagatgctgggactacaggcatgcgccaccacgcccggctaatttttgtatttttagtagagatgggttttgccatgttggccaggctggtctcgaaatcctgacctcaggtgatccacctgcctcagcctcccaaagtgctgggattacaggcatgagccagccactgtacctggccccatttgcatgtccttttcaacaccacatgcctgtacgctctgacctggcctcctgaagataggccctgttcctgactgagaggggatactggactgcagaacctgtgccctgtggtctgtgctttccagctttggagtgggcactagacaataagcatgaagaaggaggcagaacaaacacctagsaattcattttgacgtatatggtgtttatgaagtttgcaagtatataatgttgagaaatgtatctcatgcttgtcctcctcctccttgtatgttaggtgtttttgtagcattggatgtttgtgtttataggcatgtttccagttccttcctataggatgaactattgttggagaaaatgtgttaagattccttcacttccttctttctcctctactcccactttttcaccctcttcctctttcattctccatgtagacacaccacatatatatgtatgtaggtatacatttgcctaaacacacactggaaatcagaaatcaccacctggtagcaaaagaaataaggcagagtcttagatagacagcttagataggcagctaagaactcgttcacagatgtgtatctgtcattttgacatgactgtgtagttaggtccctaagaggtttggagccagacctccattctcctctgctggggatccaggccaggctcatgttcctatccacagtccccccattccaactcaccatctgtgaccagacaggttcactaagcagctctccaagcacctgcctaactcccttgggtcctaaggttaagtaagaggatcctgagttaratgaaactctctctcacttaacaaacttcccggtttagaaaccagcagtgcccatacactaagtttacacagttgggaggtccagtggaagaacagaggaatggaaacccatttgcctggggaaatgaaagacttcccagaggagacacaatatttgaactgagattagaaggagaattaggagtttgtcaggcaggcttggcagggtgaaaaagccacacactgggaagagcataaacagacaggcatgaaacagcatagtaaaggaggaagatagcaaacacctgtgtgtccgtacagcaaaagagcttgccctggagggagttgggggagatgggcaagaccaggtgaaagagggccttgaatataaagctaaggcatcttgagttgactttacttgaaggtgatctattaatgtcttcagttatcaggtttcccaaatggcagtttaaggaaaccaggatcagagggagcccattattttgctatttccaggtccttcaggcttagctccaactgagctggaactagaagggaagtgtttctttcttgcttttcttcccaggccaccgcacaaatggaagagcgactagcagagtttatttcctccaacactccagacagcgtgctgcccttggcagatggagccctgagctttattcatcatcaggtgattgagatggcccgagactgcctggataaatctcggagtggcctcattacatcacaatacttctacgaacttcaagagaatttggagaaacttttacaagatgtgagtgtccttgtgctggggttctgaaaaaacctccacctggtattggatttgtaatcccaagctaagattagggcattagtggtattctcagtcttcacagactgcttgttacccaccctcaaaggtagagctgagggacttagattcctcctcagtcccctgcaatactgagagaagcctgcttggtatcaaaggaagtcacttctgttccttttctaaatccaaaattrtattactttgttgtattacrcgaagctccaccatgggtagtagtcataagtatttgactaggaggtttgctacccaaagccaaaaagtggctccagtggctgtgacgggctttcttctactggaaatactggtttaagcagagccttcagactatttatcctcagccaagggaaaacaggtatgaggcttgcacaatgggtttagccatttgcatggtgagaagttctctagttgggacttacatgttttgagacctggtcctcgctggtgtgaaaaaatctctgggaggctaaaggtaaagtaatccagagatggccaagaccaaagcacatgagagttcttaagcactgcttcctgcacgagtgcttcctttgctatcagcctcttgattaaggtggccagatgccatctcactcagaccacagcggctccatgttatccattaatacagtttgggagagagaggatatgcctgtccccscagagctcatcacatcactagagaatttcccagtccagaaccccttattacctccagaccaagacctctctctctggagtagtaccaactgagctgagggcccagggctaatgatcaaaaggacatcagtgtgttcgtctagaaataagaaggagcagggagtttaaacaaattttcagagaacagttgaatctagagaaagggtgactaaagatgatcatgattattgttgtcaagtagtagaaagtttctcacatataaaagagagcagattgttcttaatacccctgaaagacataattagtccagtgggcagaagttacagtgagaaaggttttgatttaataggtgaaaaagtagttccttctacaaaaatacctttttgtgatttcaaaagaaatacttaaaataaaacattgtagaagtataactttagaaagccagagtcccatgaaaatcactggtagctgtttgtttctgttcaagaaaaggtttctgacagttttccagcaatggaaaggggtaccccagagacatataggaatcagggattactgcatcaggtaaaggattaatgtagagtaacttccaagtttcctggtatgtttaagatttatcttctaaaatgctaaagtcagagccttgcccaaaacctttaggcattttcccagattgactgcttgtgtggttaggttgtttgatacaataggaagagcactgaatttggagccagtttgttcatctgttccctaatttgtgaagcccttggaatgcagaaaagaattcagtgcaggctctatcttagggaatttgccatcagtgaggttacagacccatcaacatgtacttaataaaaataagttattactatactgaatactttatatgaattctctcacttccactgactgcaatacaatgtgattgacgagcactagagataagtaggttctgagcacagaggaggatatgctgactctttgtggaaagttcagggaaggctagatcttaacaggtaggagttcactgaagctagaaaacagcataaacaaccttttgcttgggcacagtggctcatgcctgtaatcccagcactttgggaggccaggatggaaggatcacttgagcccaggagcttgagaccagcctgagcaacaaagtgagaccccgtctctacactagccaggcatttcaccatgttggccaggctggtctcaaactcctgacctcaagtgatcgccctgcctcggcctctcaaagtgctgggattacaggtgtgagctgctacaaatgaccagctggcagatgaatttgaagagttggactgggggccagatgctgaacggccttgtgaggagcttagattgtatcgtgaaggcagtgggtatcatccaatgtgacaaattgaaaaatgacctgatcagattttagaataataaaagtcagtaacatttatggagcatttartacatgctagacactgcattacctcatttaatttatctggttaaatcttcacaaccgtgtaagaaaggtacttaatattatttcctaaatttacagataaggaaactaagttagctcaagataactgatttttttaagtagcaaaaccaggacccaacccagatttggcttattccagagcctaagatcatacattttcaaacagtcaacaaacattgactgacatctgctgtataggaggcattctgctaggcttagcatttgaggaaagaaacagggccaggtgcggtggctcactcctgtaatcccagcactttgggaggctgaggcaggcagatcacctgaggtcgggagttccagaccagcctgatcaacatggagaaaacccatctctactaaaaatacaaaattagctgagcatggtgacgcacgcctgtaatcccagccgctcgggaggctgaggcaggagaatcgcttgaactcagtaggtggaggttgcggtgagccaagatcatgccattgtactccagcctgggcaataaaagtgaaactctgtctcaaaaaaaaaaaaaagaaaagaaaaagacacagagcctctttactcactaggcccagcagtgtagctgtagagacagacagctcattatgaaacagcatgacagtaccatgtggtatgcatgaacagccaagagaacatgttaaagacagcaattctttttcttctcgtgtgtgtgtatatgtgtgttgggaacaggagacaggttttaaaagaataaatgggatttcaccaactgctcaacctttctcttcatttcataaccaatactttaaaagaagaaaagtcctcatttactgtgttttttttccgaagaaaaataattttaaaataatttgtaagcaaaaataatcctaattaggcattcatgggaagatatttaggaaaatgtggtacaatttgaaaataatagccattagaatctaagatattattggtaattatatcttcgttttcattgatttttaatactatttaatttgattatgtatttttcttttttttattattattatactttaagttttagggtacatgtgcacaatgtgcaggttagttacatatgtatacatgtgccatgctggtgtgctgcaccaattaactcatcatttagcattaggtatatctcctaatgctatccctcccccctccccccaccccacaacagtccccagagtgtgatgttccccttcctgtgtccatgtgtcctcattgttcaattcccacctatgagtgagaatatgcggtgtttggttttttgttcttgcgatagtttactgggaatgatgatttccaatttcatccatgtccctacaaaggacatgaactcatcattttttgtggctgcatagtattccatggtgtatatgtgccacattttcttaatccagtctatcattgttggacatttgggttggttaagggatcaattcaacaagaagagctaactatcctaaatatatatgcacccaatacaggagcacccagtttcataaagcaagtcctgagtgacctacaaagagacttagactcccacacaataataatgggagactttaacaccccactgtcaacattagacagatcagcgagacagaaagttagcaaggatacccaggaattgaactcagctctccaccaagcggacctaatagacatctacagaaccctccaccccaaatcaacagaatatacatttttttcagcaccgcatcacacctattccaaaattgaccacatagttggaagtaaagctctcctcagcaaatgtaaaagaacagaaattataacaaactgtctctcagaccacagtgcaatcaaactagaactcaggattaagaaactcactcaaaaccactcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaacacattcaaaagctagcagaaggcaagaaataactaaaatcagagcagaactgacggaaatagagacacaaaaaacccttcaaaaaattaatgaatccaggagctggttttttgaaaggatcaacaaaattgatagaccgctaccaagactaataaagaagaaaagagagaagaatcaaataggcacaataaaaagtgataaaggggatatcaccaccaatcccacagaaatacaaactaccatcagagaatactacaaacatctctacgcaaataaactagaaaatctagaagaaatggataaattcctcgacacatacaccctcccaagactaaaccaggaagaagttgaatctctgaatagaccaataacaggctctgaaattgtggcaataatcaatagcttaccaaccaaaaagagtccaggaccagatggattcacagctgaattctaccagaggtacaaggaggaattggtaccattccttctgaaactattccaatcaatagaaaaagagggaatcctccctaactcattttatgatgccagcatcatcctgataccaaagccgggcagagacacaactaaaaaagagaattttagaccaatatccttgatgaacattgatgcaaaaatcctcaataaaatactggcaaaccgaatccagtagtacatcaaaaagcttatccaccatgatcaagtgggcttcatccctgggatgcaaggctggttcaatatacataaatcaataaacgtaatccagcatataaacagaaccaaagacaaaaaccacatgattatctcaatagatgcagaaaaggcctttgacaaaattcaacaacgcttcatgctaaaaactctcagtaaattaggtattgatgggatgtatctcaaaataataagagctatctatgacaaacccacagccaatatcatactgaatgggcaaaaactggaagcattccctttgaaaactggcacaagacagggatgccctctctgaccactcctattcaacatagttttggaagttctggccagggcaatgaggcaggagaaggaaataaagggtattcaattaggaaaagaggaagtcaaattgtccctgtttccagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagccaaatcatgagtgaactcccattcacaattgcttcaaagagaataaaatacctaggaatccaacttacaagggacgtgaaggacctcttcaaggagaactacaaaccataggatacaaacaaatggaagagcattccatgctcatgggtaggaagaatcaatatcgtgaaaatggccatactgcccaaggtaatttttatagattcaacaccatccccatcaagctaccaatgactttcttcacagaattagaaaaaactactttaaagttcatatggaaccaaaaaagagcccgcatcgccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataacgcygcatatctacaactatctgatctttgacaaacctgagaaaaataagcaatggggaaaggattccctatttaataaatggtgctgagaaaactggctagccatatgtagaaagctgaaattggatcccttccgtacaccttatayaaaaattaattcaagatggattaaagacttaaacgttagacctaaaaccataaaaaccctagaagaaaacctaggcattaccattcaggacataggcttgggcaaggacttcatgtctaaagcaccaaaagcaatggcaacaaaagccaaaattgacaaatgggatctaattaaacgaaagagctgctgcacagcaaaagaaactaccatcagagggaacaggcaacctacaaaatgggagaaaattttcgcaacctactcatctgacaaagggctaatatccagaatctacaatgaactcaaatttacaagaaaaaaacaaccccatcaaaaagtgggcgaaggacatgagcagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttatactgttggtgggactgtaaactagttcaaccattgtggaagtcagtggggcgattcctcagggatctagaactagaaataccatttgacccagccatcccattactgggtatatacccaaaggactataaatcatgctgctataaagacacatgcacacgtatgtttattgcggcactattcacaatagcatttactgtttttctttccttgtatcctatttactactcaatcttctgccttccagtttcccttcccaccagtctaccaaaactgttcaggcaaaattcaccaaggaactcactggccaattgccaaatcctgtggccactttcagttcccatcttctgccacctctcggtggagcacagtgaatacttcctaaacttccttccccagttgtcaattcactgttctcaccactcttgctgcctcttcacaagttcctttgctgcccacctcttcctactggtgtgtcacagggcaccatycggcatgcctggtctcccctttctctttcctccactctctctctgatgtcttgccacctgctcccatgtcttcagttgtcatctctacgctgaggactcccacatgtggctgccactcttactgttctcctgagcttcagatcagtgcacccagctgcctgctggactcctccactttgacttccctatattggttcttattctttggttgcacgtaatagaaactgattcagaatagtttaaacagtaaagggaaacattataagagtaaaaggagtaggtcttagagaattgaagcgagggatataaccaggccttaagaaggaaccagaactagaaaccagaagctccaggaagctcaggaagtcttcattcttcctttttctgtatgcatcttttcctctatttccatggtaggtatgcatctcttttcacagttcttaaacggttctgccacactgacgttaacagttgtctttctatccttttttaaattcctaggaaagtgatcctctctggtcagctattagaggtgggagggaaggtacasacacacagtacaaatgtggctcctagaaaccagagcagttctcaggaaaaaagagaaaggcccatcggccaagcagatacccaagagactctcatataggtgcctgaaactgcacgcccagaactgagcttatcttttctgcctagctgttctttctctaaaaccaaatgcagtacattctttacctatcacctaaatggcttcttatagttactatttcacttattcattgtaattttcctaaaattgaagttgtagttgccttctgtcgtgcttctttcaccccttatctgcttctgtagtaacccacgtctatccccttgtctgcattcttctgccttgacctatgcctttttcatctgaattattagagttgcctgctaatgggttttcctgcatttagccttgccctctttagtgtactctctacactgcagccagagtgatccttctgaagtactttctggtcatatgactcctcagctttgaggtctttctactccttacagtctagggtggaaagtgaacatcagtgaaggcaccattgagagctgccccttgagctagggtctggagggtaagtgaggcttgttggatggaggagcaggtacagctgtatgtctgtgtggcatttcttggtgtcatgtagtgttgtaaagcagaaatggttccctatgagcaactcgctccctctcacagccagccagccttctctgagttccttgctttgcggagctctctatgctaccgaattgtttctccctggagtcagctctgccctgtctggtcctgcttagcccagccacactgggccaatagattaagcaacgcttcttttctctataggctcatgagcgctcagagagctcagaagtggcttttgtgatgcagctggtgaaaaagctgatgattatcattgcccgcccagcacgtctcctggaatgcctggtgagtggactctaggaaagtcaggtgrgcagatttagaggaggactatagaggaagtatcctgatgacagcaaaactgtggtggtaaccactgccatttctgttgcttaggtccttatttaaatatgatttgccaccattgsgggactaaacaggtttttgtgaggacaaatgtatgktcctgaggggatgyggcagggagaattattagtctaggccacccccacatgagcagggctcacatcagtgggggtcttgggggtgagaagcgtcaggagcatagcccagtttagtttgtacaagttgagtccttcattttatcttcagcaatacttgactgagtacctacttcctgctagacactggagatacagacatgaataaagcacagtctctgatcttgggatgtttcctctacagtggagttgggaagcatgaggcatgaggacatgtaaatagtaattacaatactgcaagaagtgttgcagttgaggtcagtacacagcgtaacgggaacctggaaaaggaagtgctttagtcttccctggaaggaacattcagtgaatgctccctgggggacgtgaggcttattcagcaaacygaaggatgagtctaagtttcccagatcgggagcatgggaaggagcattcagtggggcacagggtgggtttgaagaagtgctgaggggtaagcctggaaggtaggctgtgacagggtcatggagggtgtcgggttctcggctctggagtttttcattacccttacggccacttggagacaccagaaagtttaggtaagaatgtgacatggccgcatttacttttttcttaaaaaatattattaaggtataattttcatacaataaaatatatccctttgatggtacagttcattgagatttaacaaatacacacttgtagaatcgtggccacagctgacatagagaatatttctgtcatataagttcccttgtgcccctttgaagtcagtcctctcttcctcctgctcccagacaataacttaactgctttgtttcactagggatgggtttgccttttgtacagtttcctagaaatgaaaccatgtttctgtgtggtttctgtagtatgttctgaattctttcactcagcatgtttgtagaaattcatacatgttgttgcatgtatcagtaattggttcctatttatttctgtgtaaatattacatcagatttagtcctaagaaagattactttggctgcaacatggatagtgaattggaagagagggcaggatgagccagggacatcakgggagaggtactcaaagcaaattcatgtgagatggggtggccagaactcagacagtgaatggtaggataatagagagaaagaggtggattagaggggtatttatgagagagacattctgaccaaataggagctaaggaaggataagaagttaaaaggacttccaggtctggcgtaggttatatccagataggtacagttctccaaaacagtgaggccacagggaatgagaacagagttcagggcagaggctatgctgtgatagagcagagagcctctccctcaggaacatgaagtccttggctaagcaggggcttggagtcagacctgggctgaatgctggttttctgttccttcctactactgtgattatggacaaatcagtgcatccctgaaagccttgatttcctcagtgaggtcaaagagttgctagagggtttaacccagtgtgtggcacttagtaggcactcagttattatgtgcagacaaggattgtgcttttcaatggatytccagcctctagcacataggaggtgcccagtaaatatttgaaggtatacatgcaccagtagggctttgccaaagctcttgtgagccataattgagtgtgtgccaggacwgctgtggactgggcatctgaatacaccagacagtgccacctggctgatggaaagcatgggaccagatcaataggctgagctctctttagagtaaaacctctagttcttactgccaggaagacagcatatgcttagcatgtccaatctggaggtgacctgtaagacatctttgtccccattcctgtgatccctgaatcatgttgtttctgaatattcaggggtgggagtgtcctatcacagagaaagtcttgttcatctcagtctactatatgctrtaaaaccraagatgccagcagctttcgcttatatctgtcaccactgactatctctctcccttggtacaggagtttgaccctgaagagttctaccaccttttagaagcagctgagggccacgccaaagagggacaagggattaaatgtgacattccccgctacatcgttagccagctgggcctcacccgggatcccctagaaggtgagcatgctgcctagtggctgcaaagaggccccactgctgctggcaagctctaacagcagggaagctgcttggaaaagagacttagcttggacatggacacaacatggccccrggggcctcaggattttaggagataccctgtgatctctgtgacaaaacagtctttactttggaactgctgttcacatctgcctgatagatcccaacctggattgcatyggcccggctgagttgcatttagaacctcagttccaaagaggtcaacaacaaagggccacaatcacatttgcaaaaatggtcacctcctctgcaacttgcctctactcttggccaccttacaggtcttcctgtgtctttggggtagtccaacacagggcttcagaggatactgccattcttctgggcttcctgctgaacccctgcagcaaccatgggcttccaagtccctggtctgtaggtatcctgctcctgccttctgtgcttcccagccccatccagtgaagcagtcttggccagcaggatgggaactagtaacccagtttcaggccctgttttccaggaaatgtccccagtttatagaatttgccaggccctgtgaatggcaatggacttctggaaatgggagtagcagtaggatttggcttgtttcctgatccaaaagctgggactacattgggtatagtgccatgggactgaattcacatcytaggctgatgcaaaaagcattaatgactaccctacatgcacctgttgtgtgatctgaggatactgctgagatacctgacattgccacgcacattcttctcttgtatctttgtttccagaaatggcccagttgagcagctgtgacagtcctgacactccagagacagatgattctattgaggtaaaaaccctgagctcctaccccattcctggagcctgggccctatgaagcaaagagctatgaattctctttaagagaatatctgaggaagggatgggggagttggtgacagcaaacactgagaagtcattctactcccagaagaatgagcaggagactgcactagagctgacagctgagaagatgctagagccacagcttctgcaaggatatgggctctgagaagcatgcctgtctcctgccttttcccttgtcttccagggccatggggcatctctgccatctaaaaagacaccctctgaagaggacttcgagaccattaagctcatcagcaatggcgcctatgggtaaaggcaggggtcagggtgtggccaggactgaagccgggtcagcctttgatctcttccrtgtgagagtgtatgctgcccagtcctctgggcagatgcctcggggtggaccttctcactcccagaagcctcctgggtgggcaggagttcagattcctctgacatccgatcattgttcctttcccagacaagattcccacgcctcttactaccacgcatcctccattccctgagctctggggaagcattgagccgtgtcatcaggacatggtctatcaagaagtttaagagttctatggaccagggggtcccagacccttctcactgatatgcatgcccttgcccccttgttctgtgcattaattaaggtgtgagagaaggcagtttgggtggcagagagcacagctcaggtgctgagggtccatgggggatgggccggactttgtttcccagggctgtatttctggtgcggcacaagtccacccggcagcgctttgccatgaagaagatcaacaagcagaacctgatcctacggaaccagatccagcaggccttcgtggagcgtgacatactgactttcgctgagaacccctttgtggtcagcatgttctgctcctttgataccaagcgccacttgtgcatggtgatggagtacgttgaaggtactgaggcaaaggtggcctggcatggaggccaaggcacagtctgagacttagccttaaacagggaccagcagctttgtacagaggtgaagtttcagggcccagctttccagtccacctttggcattggtttctgcctcaggatcacagagaccatttggccacagtgggcacaaagctccctgcctctaccatgagaggcattctgggataggatgtagcaggccagcagctatagaatcttgcaccccaaagcctgcacgctctctactgctggtatcagacagcaacagaggaggcagcagagctacaaaagcccaggattaggtgctaggaggtttgcatctggaccctcagaagaaaggaaagccattaattaccctgactggcttgcaaaggggacaccccttaaaaccaagcaaaatgctctgagaatagaacagaagagcaacatggggcatagttctggagggaggcagcagctttgccagtttcccttccctctcaccttctcactgtgtgtacagcctccaaagatactgtgcctagtcttgaagctgaagctgaacaaaactgtcctttagtgtttactgggtacatgctgggagttcatagtgttactttactcagaaactaaaagccagtaagaaggaagtaacatgaacagatgttaacatctcagccagatgtgtttacagtatgcagtattcctgtcctaaaaaacattaggctggtacaaaagtaattgcatgtttgccattacttttaataaaggcctgggttccttccctctctggcctgaaaaatgtccatgacagctattagcagattcactttactttccacccccctccataccctgtgtattttcatgctgctaataaaggcataccagagactgggcaatttacaaaagaaagaggtttagtggacttacagttccatgtggctggggaggcctcacaatcatggcagaaggtgaaaggcatgtctcacatggcrgcagacaagagagagcttgtgcagggaagctcccctttataaaaccatcagatgggccggacgtggtggctcatgcctgtaatcccagcactttgggaggctgagccaggtggatcacctgaggtcaggaatttgagaccagcctgaccaacatggcgaaaccccgtctctacaaaaaatgcaaaaattagctgggtgtggtggtgcacgcctgtgatcccagctactcgggaggctgaggcaggagaatcgcttgaacctgggaggcagaggttgcggtgagctgatatcacaccactgcactctagcctgggtgacagagcaagactttgcctcaaaaaaataaataaataaaaataaccatcagatctcatgagacttattcactatcacgagaatagcatgggaaagacccacttccatgattcagttatctccctccaggtcccttcccacaacacatgggaattatgggagctgcaattcaagatgagctatgggtggggacacagccaaaccatatcaccctgtctcccacccatgccagcagcaaaggggctagaatcagagtctccagcaccaggatattccatgaagctgtctcctctgggacctcagaaactgccagatgggagctggctagctagagcagggaactgaatcctttcctcatggtagcctgggcttgttgcagggggagactgtgccactctgctgaagaatattggggccctgcctgtggacatggtgcgtctatactttgcggaaactgtgctggccctggagtacttacacaactatggcatcgtgcaccgtgacctcaagcctgacaagtatgtccacagtctgtgtcccttgtccagggtctccctcttgggtctccagataaaatgttggcaagcacagtagctctaaatctatccagatggctaccgggaaaacatgctcctgtgtgtgtccatctgggcctagttctctagyyccccgaccaccccagatgcagatcattgcctcaaggtctggctggaacactataaggcttcggtgacatggaagagtcattgaggagccccactgaagaaaccaagcaagaacaaaagaataagcacatctagtagatggctaaacaagtgtcctgacgtttactgacatctactctgtgccagcactatattgtgggtttttaaatgtagtccctggcatgtagaacttaagtctacagtgggagacagaaatatatgtatataggcttcttctcagagggtattagtcaagtggaaaaaggaagacctgctttctaaagcaggagagcagaatgtgcagagtcacacaggtgcaagagaacagcacttgttcaggaactacaaatagtgcaatatggcgacagcttagatggtgagagagtagtaagagaaaaggctagagagagaggcaggaactagttcatcaagggcccttttgttatatttgggttttattctaaaggggcytagagagtcttggaagggtstgctaaccaaagatatgatagaatggcatgcccagattatggttcaggtttagaaagctcactctgccggtgaaaagagacactgagaccactgccaaagagataccgagaccagggaaagacagcaatgcctgcagcagaacagggagtcaggatagaaagaagaggggtagtgtggggaagtataaaggaaagaggatcaggctggggtgggggtaggaagggaagtgagggaacagaagaggctgggatgtgttccagatttccagcttgggactggtgcagggtgataagcctctgtggaagaaagtggctttgacataagacagacctgaattcaaatggccactcttctgcttattaagtctgagtttgagtctactaattaaagtttccctgaccctcacgttcctcctttctaatatagggaataattacacctacctttgatgtgttactctagaaaacatttcaggggccagaatatttttaaagcacttagcacagagctcaacagataaccaaaattattgtttttcactgaggaggggaaccagttgggaggcatgactttgttttggacaggttgagtttctggagcctgtaagacacatgggcagttgggtaggcctggagctcaaaaaggaagtcagagccagaggtactatttggggaatcattagaataaaagggtggcagggtaaagccttcagcacaaaatgagtggctcaggcagagtatataaagggatcttagttctagtttctcccaactaaccctcctcccaagaccagccatggacatggaacaaaattatgtgtgccccctgcccctctccctgaaacaggagtattatgggccactcagattgggagaggggactaggaatggctccagcagctgccttaggatgaggctgatctcagctctgtagaagaaactctgttcctcaactgaatgactcctgcccccaacatagaatacagttagggcaataagcagaaatggagttgtgggaatgggcaaaaggcaggttcgttgcttgtgcagaatgcagcactcacacagccagagcgatttacgtgtccacacctgcctgtccccccagctgaagctacccagcttgtgtctcacagtacccccatggaagcctgagtggggaaactgggcatatactaaaatcagtactctcagaaaaccaggaataacttcttaattttatttcttcgttcttccagcctcctaattacatccatggggcacatcaagctcacggactttggactgtccaaaatkggcctcatgagtctgacaacgaacttgtatgagggtcatattgaaaaggatgcccgggaattcctggacaagcaggtaaggaagggtagttgatacactgggggttaaattctaggcccttgtcctggcgcagtgtcttacgcccgtaatcccaaccctttgggaggctgaggcaggaggatcgcttgaggccagcctgggcaacatagtgagaccccatctctacatttgtgtacacatacatagattccaggccctagaataaggccttggggccatatgcctaccttgtagctagatgttaagattgggaacccctatcttttctacctttgggttccagagaggcactgagataggtagcacatttggaaaacaggatgagccttgagaatcatatggatataaaatccaaagtcatcttcctcctcagggtttggggaaaataggtcatataactgttagcacagagtttcatatgagatcagtcctgaatctcccagcctgaatcaagggcaaggctctcctggagcctgaggttcttggaacacagctctgaatttccattgggctgtggcccagtgtcctgagaggcagcctctggatgttccctggtttgacatttcaggttgtgactgttcaccggtccctgtagttgttacatgactgatagggtctgttttgttagaggctggagtgcagaggcccattgtgggatcacatgccagaggtgggtgttgagggcttaagggatggtagttccgggctagaatgagacatttttgttaattaggaaatacctactgacagttccgactcttgttccctggggcttctgttgatcttgttcattaactaaggtgggctgagtcttcattcagagattcttctgctcgagatgggagcatcccccatctccggctgtcatgccagtcagcagcctcaggaggctgagccagcctggcttttctgtgcccaggtatgcgggaccccagaatacattgcgcctgaggtgatcctgcgccagggctatgggaagccagtggactggtgggccatgggcattatcctgtatgagttcctggtgggctgcgtccctttttttggagatactccggaggagctctttgggcaggtgatcagtggtaggtactatgcccctggcccagtggggaaacagagtctgaatccacaaatatgatgtatgcaggcagctcgtgaggcctgtgagctcttgttctgaactcatcatgtgtgtttgtgatgtctgctgctttggggatgggtgtctctgtgtttctgcatgtacatacatgtgcacactgtgtcccttggggcttcacatgtctctcatagacacctggtctctcatatacacctgggtgttcctgtctgtgtatgtgcacatcccataagtgtgaggggtacgtctgtgtatgttttgtggagtataaaagcagggtgagctagagctttgcagtgcctgctgtggatcaaagatcaagctatggtctaggaacctatagaatttaaggactggggtcccaggcaaggctttcagggrctccaggctgggtcctttttgcctcctttcctttcactgttctgggaccctcttctgcatctctccactctacccacaatttctcctttccctctcacccctgatgacttcagatgagattgtgtggcctgagggtgatgaggcactgcccccagacgcccaggacctcacctccaaactgctccaccagaaccctctggagagacttggcacaggtagggcaggccctgctaacttttctcactacttggaaaaggggtaagggaggctgagtcatgtaccctggaggttcaggcttcggttacgggcagcccctctggatcctgaaactctgccctgctctgtaggcagaaaagggaagatgcttkagctgatcccctaggtrtagcttctgaaggtctggcttcttrctagatttgctgacctagactccatgctgctcatcctacccscttgcccatgtcctccctgtccacaggcagtgcctatgaggtgaagcagcacccattctttactggtctggactggacaggacttctccgccagaaggctgaatttattcctcagttggagtcagaggatgatactagctattttgacagtaaggccaccgatgggtggggtggaggatgggtcctacctgtttgcctagaaacacctgtgcacactgaaattgcattgggagcaacttctcagggctctgctgaaatctaatggggtcacaaggaggccaccagcagggctctgaaggaaagtgtcctttatgtctggcccagcccgctcagagcgataccaccacatggactcggaggatgaggaagaagtgagtgaggatggctgccttgagatccgccagttctcttcctgctctccaaggttcaacaaggtgtgactgaggaggcccagaatgggcagaacaggctggaggatcagaagaagagggcctgtcaaagggcacacctggggcaggctcagggagttggggttggggccacctctagaaaaagaggagctaagggttggggctacatatagctatatataggtgcttctagaaccactgctgtccctgacatgagatgccaggtcagatcagtggaataactccttccccaaatattcagcaggggtgtgtgaaggagggatggaaccgactggttcaaattcctaggtttccgatgccaaggatgctttatgccacttgggaggtacggctgccagagcccatccccagcgcatcccctgtgcccacaggtgtacagcagcatggagcggctctcactgctcgaggagcgccggacaccacccccgaccaagcgcagcctgagtgaggagaaggaggaccattcagatggcctggcagggctcaaaggccgagaccggagctgggtgattggctcccctgagatgtgagcacccagagttcacccagggtgggcgacacagctatccctgcattgtcacagatcatgggagagattccgatgccagggaggagtgcaggtggcagggagggggcattcacaagggtggctcctggaggaatgtctgcggaggmaagttctgttactataacccttgtgtgcccctaaggagacctggcaggaggagggggaccacctgggtcactcaccccaggccttgtgtctcatagattacggaagcggctgtcggtgtctgagtcatcccacacagagagtgactcaagccctccaatgacagtgcgacgccgctgctcaggcctcctggatgcgcctcggttcccggagggccctgaggaggccagcagcaccctcaggaggcaaccacaggagggtatatgggtcctgacacccccatctggagagggggtatctgggcctgtcactgaacactcaggggagcagcggccaaagctggatgaggaagctgttggccggagcagtggttccagtccaggtatggcccagtgggcggccaaacgacctaagctggaggatactgcagggcagggaggctcagcggcatcgcgggtctcactgcttacttgggcctacagctatggagacccgaggccgtgggacctcacagctggctgagggagccacagccaaggccatcagtgacctggctgtgcgtagggcccgccaccggctgctctctggggactcaacagagaagcgcactgctcgccctgtcaacaaagtgatcaagtccgcctcagccacagccctctcactcctcattccttcgggtgaggcccctggggagctgggataaaactcacaggaagggccttgtaatctctaggccttgggagggttctgcacgtggcaggtgtgtgtgtgtgtgttaagcacagatctgactgtggtctctgaaggtgtgtattggtgtctggggttgtgtatacatgtgccagaaagcaggacagcaccatgtcacaagtgcaggctttggggtagagagctcacactcaaatcctggctccatcactaacaggctcttgaccttgagcaagttgcttaacttctctaagcctcaagtttcttatccaaaaatgtggatataatagaggccagctgataggttgtgacatttaaatatatatgacaagcttatatagtccctgatacacacataaatgctagctgccatttctcatcaccaccaccgtctcttggggtctggacacgggagagggcttcacaggtcaggggctgtggggaaaatggacctaggctcaggctctgtctgtgactagagttgtgctgacatcaacagactggaccaggggccaggccaaagccctctgacccactaagtcctggcttctccttctccagaacaccacacctgctccccgttggccagccccatgtccccacattctcagtcgtccaacccatcatcccgggactcttctccaagcagggacttcttgccagcccttggcagcatgaggcctcccatcatcatccaccgagctggcaagaagtatggcttcaccctgcgggccattcgcgtctacatgggtgactccgatgtctacaccgtgcaccatatggtgtgggtatgtctgaccatccagacctgctgtctccctgcttcatcatccttccagcttcccctttgtggagcccatctgtccctgctcgggggtcaaagggtggtggtgaaggggctcacagcttaatgtccagaaccaggccccatacttcgtgttcaggctccagtctgagtactgttctcttcctggcacagcacgtggaggatggaggtccggccagtgaggcagggcttcgtcaaggtgacctcatcacccatgtcaatggggaacctgtgcatggcctggtgcacacggaggtggtrgagctgatcctgaaggttagtgctgggcgtgctgcctgcatggtccctgaatgacctcagcctgtgagtctgtgatggcagttaggggagtgggtgagttgggtgcacacacatctacaccgagtatggatgtaggtacacacaggccgggcgcggtggctcatgcctgtaaatcccaacactttaggaggctgaggcaggtggatcacttgagaccagaagtttgagaccagcctagccaacatggtgaaaccctgcctctactaaaaatacaaaaaaaaaaaaaaatgcctgggtgtggtggctcacgcctgtaatcccagcactttgggaggccgaggcgggtggatcacctgtggtcaggagtttgagaccagcctgcccagcatggcaaaactctactaaaaataacaaaaattagccaagcgtggtggtaggcacttgtaatcccagctactcgggaggctgaggaaggagaattgcttgaacctggaaggcagtttgcagtgagctgaggtcataccactgcactccagcttgggagacacagcaagactctgtttccaaaaaaaaaaaaaaaaattagccgagtgtggtagcacatgcctgtaatcccagctacttgggaggctgaggcaggagaagtgcttgaacccaggaggcagaggttgcagtgagctgagatcgcaccactgcactccagcctgggtgacagagtgagactctgtcttaaaaaaaaaaaaaaaagatgtaggtacacacagaacttgaatgtggcacaacagagagttttctccacaaggcagtaccctccctgactaaggcccwgggatccttctgagctgtgggtagggctgcagaatgggacggattagcctgttttctaccttcttaccccaaaccactctggggctccaatgggagccatttcctcatctgtaaaaacaataatataggcctgtggttcagatgtgttggtgcagggacaaaaagctggagctgtggtatagccatgccagaagggaaggattgggggaggggaggggcaagaatatggctccagcttagcctaggcctcatgctctgctccccagagtggaaacaaggtggccatttcaacaactcccctggagaacacatccattaragtggggccagctcggaagggcagctacaaggccaagatggcccgaaggagcaagaggagccgcggcaaggatgggcaagaaaggtgagccaggcgcagtgaagagggttttctctgagccacatgagtgctggtacgtggtgggtgccttggccctgggggtccagtgtgtgctgtgctcactgcaccgactcagcctttgacccttatccccgcagcagaaaaaggagctccctgttccgcaagatcaccaagcaagcatccctgctccacaccagccgcagcctttcttcccttaaccgctccttgtcatcaggggagagtgggccaggctctcccacacacagccacagcctttccccccgatctcccactcaaggctaccgggtgacccccgatgctgtgcattcaggtacgaagggctccctgcagatcagtgacaacccctgggaaataggaaagttcctaggccctgtgtgcttctgacagatcccactctgagtctctcatttagcccaccccctgaaagatcctgtagtcttggggaggaattaattgatggggaagggggtagcttggtttctgggacataacagggctaagccctgtcttgcccttgagtcacttctaacagctaacactgctctgcttttgtctgtctgtctgtctgtctctgtacaaagtgggagggaattcatcacagagcagctcccccagctccagcrtgcccagttccccagccggctctgggcacacacggcccagctccctccacggkctggcacccaagctccaacgccagtaccgctctccacggcgcaagtcagcaggcagcatcccactgtcaccactggcccacaccccttctcccccacccccaacagcttcacctcagcggtccccatcgcccctgtctggccatgtagcccaggcctttcccacaaagcttcacttgtcacctcccctgggcaggcaactctcacggcccaagagtgcggagccaccccgttcaccactactcaagagggtgcagtcggctgagaaactggcagcagcacttgccgcctctgagaagaagctagccacytctcgcaagcacagccttgacctgccccactctgaactaaagaaggaactgccgcccagggaagtgagccctctggaggtagttggagccaggagtgtgctgtctggcaaggggrccctgccagggaaggsggtgctgcagcctgctccctcacgggccctaggcaccctccggcaggaccgagccgaacgacgggagtcgctgcagaagcaagaagccattcgtgaggtggactcctcagaggacgacaccgaggaagggcctgagaacagccagggtgcacaggagctgagcttggcacctcacccagaagtgagccagagtgtggcccctaaaggagcaggagagagtggggaagaggatcctttcccgtccagagrccctaggagcctgggcccaatggtcccaagcctattgacagggatcacactggggcctcccagaatggaaagtcccagtggtccccacaggaggctcgggagcccacaagccattgaggaggctgccagctcctcctcagcaggccccaacctaggtcagtctggagccayagaccccatccctcctgaaggttgctggaaggcccagcacctccacacccaggcactaacagcactttctcccagcacttcgggactcacccccaccagcagttgytctcctcccagctccacctctgggaagctgagcatgtggtcctggaaatcccttattgagggcccagacagggcatccccaagcagaaaggcaaccatggcaggtgggctagccaacctccaggatttggaaaacacaactccagcccagcctaagaacctgtctcccagggagcaggggaagacacagccacctagtgcccccagactggcccatccatcttatgaggatcccagccagggctggctatgggagtctgagtgtgcacaagcagtgaaagaggatccagccctgagcatcacccaagtgcctgatgcctcaggtgacagaaggcaggacgttccatgccgaggctgccccctcacccagaagtytgagcccagcctcaggaggggccaagaaccagggggccatcaaaagcatcgggatttggcattggttccagatgagcttttaaagcaaacatagcagttgtttgccatttcttgcactcagacctgtgtaatatatgctcctggaaaccatctttatgtcttttgcttgcttgttttccttcggtcaacccacatgtaactaggtcctgtgttgctgctgggaatatagtggtgaataaaacagtttccaccaccaggggagggccacctaacccagcttgacttcccaaaggctttgacatttgagctcaaacatgaagaatagatgataggtagtagtttgctgggtgtggaagagtggaggttggcataagaaaggctgtccaggcaacgtttagcacatgcagtatacctggcatagtcaaggaaccaaagataattcaaagtagaaacgggtctggcaagtgaggcaagggccatgtctaatggtcttccaggagatttgacttcgtgaaggtgatggggaaccagaaaataccatgtagcaactaaaattccttcatagataagggcactaagactttgatgcccatggtaatacagtagcttgggtagaacgggggttagaacgtaggtctcccttggactccggaactcacatctctcctaactaggattgcctcagccaggaaatgaggaggggaagaagtgagagaaggcaaagagtttaactttgggtgcgtttgagataaaagagaagacagaagcagcaaccagcagagtcataaagtctatgggaggagttttaaaatggacagagaagttaacgataaatgccgaggtgagggcgagattaaaacagctgccagtcgtatttagtaacaagcccttcataattgtagccagtgagctcttcctgggctgttgtaggtagaggcctcagcactggaggtggatggacatcgtgtgtgtagcccgcattgagtagaacttcatttgatggtagtgtgggaggaagggggaggacataagtgggaccagtgccaggggagtcaggaggtggcatcacagggcaggcagtggggcttggtagagcaccaaggctttgtctccatagtgatagaggacttgagaaactgtcttgcactggttgcactgatcgtcccacaatccagtgcctaggtctgaagaagacgtgttaggaggcctgaagacgaaaatgcctctgggccattgcctgggaaggctgtggccaccagagggcgcactgtatccacagtggcagagcccatttatgcagatatttggcccctcagccttctagtcctctccacttcttcattcattcacagcggaccctgggctaatgtaccgggacctgggcagacagatcacaggttgtgagctggagaatggcaggggcatggctgaggtagcaagtgccccgtgcatgtagggatctggtcagaagcaccataccacaggtgaaaaggatgttgggaactgccctcctagagggttggaaatggggatgggaggaggaagcagagatgctaaacatcctataccacactgggcaactgccccaagtgtcagtggtgttccccttgagaaactggtgggattatcctgagggtagtgaagagtttctaaaaggtaacttcagggaagtggtattatcatttgctttaggaagatcactcgctgcagtatagagaggctggagtggagtgagcgtaccacagaggatgtagtgacccattttggtggtctgaactagaacagcaacagtgaggaggtaaggaaggaaagggtgggaagctggacatctagatttgggagccatcaggaagtagagggcaatgaaagccacaggagatgaggactgtccagggaacatacgcagaatgaggaagaagtcccgaaatactggcactagctgagggggatagagccagtgaaaagttgaaggtggggattgagatcctgaatcagggagaagccagaccatctaattttgtaattcaccctaagatcaatggagacttatttaatgttttacatcggttcagatttgtattttgaaaagatgactggttgctataatgagaatggatctgagggggacaagaatggaagaaggggggccttccaggatgaagggtgcagatggtagtgaagcagtgaagttagaagtgatgttttgattgacacttggtgaaggactttaggtatgaagcagagggctatcaaggatgatgactgactacatttttgacttatataaccagatgaattgtatttccattcaccgaaataagaaacaaggaagagaaccagggctaagtagttcagtgctgcattccatacgctaaatatgaagtagcttccaatagaggtctgggcaaatgaaataaacagatgtaatcagcctagagatggtaggtggattcatggctgtggataaaactgccaggtaaaatggcattgagaactgaaggaatccaggagatgtaaaagaacagtcagatgtcagaagaatattagattagtgagttgtgatagagtccatgaaggagctttccatggacaggatagttaacagcgatggttattgaaggcatcaagaaaagcagtttcaaacagtggtggaaccagtactgaaatatttgagatggggaaataaggaaatttaagacagttctttccaaaggcttggctttgaagaggagaaaagagataaaggtatatgggatgattgagtagggattaggggagtagaatgagaaccaaccaaccatgtttaagtgtcagtggaaatgatccagttgaagtagagaaagaattgatcttaatcttgggagattcctgaggtggaagaaaatagattccaaaatacatgtggaaggattgactttagttggaggggactattgtaatttaacagatgggagggagaatagttatgtagatatagataaggttgtaggtttggtggtaggaaggtgaggaaattcatagccaatcatactttttctgacaagtaaacaagtttgcttttttgagacagagtttcgctctgttgcccaggctggagtgcagtggcacggcctcagctcactgcaacccctgcatcccaggttcaagcaattctcatgcctcagcctcccgagtagctgggattacaggtgcatgctaccacgcccagctaatttttgtacttttagtagagacggggtttcaccacgttggccaggctgttctcgaactcctgacctcaggtgatccacccgcctcggcctcccaaagtgctgggattacaggcatgagccaccacgcccagccccaagtaaacaagtttgaagtgtcggtgagatacccaggagcccagtggaaacatccagccagcgggtagagttcagaagaaagaactgggaaggagctaggaatttgagcatcctaaacacagaagtgcgaacaactctgggattaggagaaatccgtagttcctggcagtggtcttgggatgctgtgtagctaaagtgtagtggggagaaaagacataggcaaggtcacttagaacaacaggctgttccctgcccaatctgacttatttataattgagtacacatgggtggggcctgagacatggatgagcgctgcaatatcctatgcaacaagaggttatcgcatgttggctcattacgttcccagaatacaggaagctcaacagtgtgccttggcaggagatgacaagggcctggggcaataagaggatagattataaagctgggcccatttccccctcccccagagtagaatgtggaaacacttcattctgggcagaaatatgagaaccaataaacagcttattaggagtgggcagtgaggtgtggaggaaatggcattcagttttaattttctcagagtcagtaagacttcctgtgtctgtgttcggtggacaggactctggcatcatgcctagttggagtcaatgtcctcccctaggaagaaaagagcctctggctgccccagtactagtcttttggtgcttactggagagaaggtttggaagtttcaagggctgttcaacacctgagtactcttctctcttgacccccactctgcccccagcccacccccttcatagcatgaagacaaaaaattactttattgcaatgtctttattgcattactggagcaagttggccagactgtcccctcttggggaaggtattaaacaaaaagaccaataagtatctcctctcgcctttccccctaccctccccaacaattgcacagcaatgtctgaacacatctggtgacaagaacaatttgtaaagtggtctagcaactacattatgaactgtcccatcacaagacatacagttggctttcttgtgagtcagatatttttacgtaaactacacgaattttcttggacacatcaaagacaacagaatagatttttcacaagtaacggcaccaaagtcacatgctggaatttgtaaggaaacgaggttgtttgccacaagtggctggagctaaagcaggtttgagcagttggcagcagagggcccaagcaggccccctatctggaccctctggtttctgaggccactgaagcctcacagaggcctactctgggttgttaaatagcagcagagaccaccttagaaaacaggaattgcccaggtgcaattctcagtttaagagaacacatggggctgattacttgtagcaaaaaagagacccgtggaagacacattggctctcaaagcttcttcaaagcacatgaggcctaaataagtggaggtcccatcaaggcttggagagggagtgaaagtgttgggagggcctcattcttggccagatcagtggtaaggacgcaggcagtctatccaggcccgaatcatggcgtgccatctaaggccaggtggagacaacactgttctgtgatgaaagcttcacctggaaacaatgggcctagtacctgtgtccagccagccccaagctgcttgcatgtcagtagctgggttctctagccaggggtataatgaacccctctgatcttggtctctctttgccctctgcctcattgaaactgcagttaagatgccaagacagtcccagggtccagatcatgggacaggacatggcactagactctcatgaaggaggccaagacctgctcccaagtcatgggcgtagagaagcaccttgctaccctctccccctctacacaccaggcccagtgggtagtagactggtccctatgccatttccacaggctcagggtcaagcaagtcatgtggcaactggtcagaaaagatactgtcaaacctctcaaatgacccctgggtcttagatcccacaaaacaatgaattcaagaatgaaaaaaaaaatgaaggaatgtaggactgaaaaaaagcagcccttctccacaagccagcccaagtgtagataaagatggtacttggtctctccctgcacaccgctggtgtctgcccaacaaggagcagacacattactgaatactacagccctgtatctgtatttccattttggtttaaaagacactcagaacacactgaaattttagtaccagatgggagggattccttgcacgtaatcttgagcatccacctgcttcagcaggttcaacaccaggtgcaaagccatccaggtgtgcccaacagcaattagcttggtattattcagtaaaactttcagttaagatttcaattgacagtttggggaagggatgtgctggctattagttaaatgactttagaggggggttcatttgtctctgtctcacccaatcctgaaactgcagtgtaaccaagaaaaagccaaagagaagcacttccctttctatcctcgtcactagtaactggaggtttttccaaaattaaaaatctgtgtctacatcatggtccatattttagaccctgtcatggaaataagtgctcaggtaaactaatatttttctttcacccccagaactagagctttcctagctgtaagccttataaaccaagatgcaggtactggcttctctagctcagccagggtgcctgactgcacagctttgggttcaaacagctgactcactctgagcctattatggtcccaggattggctcagaggcagctggactctatttgtcaaatgagtgttgactgatgggtgtggggcatgatgggggcaggaatagatgcctgcccccactccatttgcctagct
